United States Patent 9,567,581 (SELECTIVE REACTIVATION OF GENES ON THE INACTIVE X CHROMOSOME) - sequence listing, part 54

SEQ ID NO: 5654 - DNA, 408100 bp, human
ccgttttcgaagccctccacgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgtataattacgctggggaaaagcagggaatcagattaatcacagtgctgattgagaattaaatctgcagttcctcatctaattgtccattccttaaatctattttgaatagtttccttttcattcttgtcaaacagtactccaagtgcacaatcctgctaatttgcttgtgaaggaaatgctggcaatctgaagttgatttcctaacacagcgtgtattctgcggctttagaagttgaggagataagatttaagagcaaatttttgcttaataaggatcgctagagctaacattgaaatatcttacctctttttttttttttttttttttttggaagcggtgctttattgtctattttaaggtccacagttgggaaatgaaaccaagaccttaaagcagttggccctatctcttttaagttgtctgcagtactcaatttcaatttgagtgctaatttgtttccttttctttccatattgaggtattacagtgttgcctcacatggtgaaattgtgggtagagcttgctacacactttactcagacccaattgatgtgaggacatgttactccttgccctattgttacatgaccagccagacttaaaaggaaagtatccaaatgtgtcctgttaaagtgcttgtggaagtgttctagaacagcactgtccaaaagatatattatgagccacatttgtaatttaaaattttctagtagccacatttaataaaaacatacaggtgcaattaattttaataaaatattttatttaaccctgtagatccaaacttaacatttcaacatgtaatcaatatgaaaaaatattaatgaaatattttacatcttttatgctaagtctttgaaatcccaatgtgtattttacactaatagcacatctcaattctgacactaagctacatttctgatgaaaatcagaaatacttaatctgtatttaggtttcataaaatttgcgtttgcaaaagtatattcacatacccaagttgttcccaatatacataaaagttttccaataaccgaatcaagtacctttttctaaatttaaattttaattaattaaaattaaatacaattcaaaattcagtttcccagtcggaccagccacgtttcaggtgcccagtagccacatgtgaatagcacagttctagagagaaaaatgcatcaaaaatctccttggtttcctcattcttaggagcacccagtgaagataaattaggtgtttcccaaaagcctccaaatgactgtatgtgtgggtgaatgatgtttgttgcatcttagttatagctgatgtaaatgaactaacaaagtcataattggaaaatgtgagattaaaatgttaattatattgtgaagatgtaaaatagccatctctgaatcagttttggtaactagttctgattccttaaagtctggaagggtgatgatgtgatctctttggatatcaaaaagaaatggtcagaatcacattaacacagtccatattctgctgatttgtaattgatagaatatttttcaggaaacacccctgggagaaaaaaattcatcttttctgactgtttcagagctgcataaagaggggcagcaagctaattttgaggtgataggtactctatggctaccttaactactatgaactgtgaaatctcattcatatcctacaaaatctgacttggtcagtgccaattataaaatgccattatgtgaaataatgaattcaagctagccttattgttaaagaatgtaataatagtgttcctcaatctgagtaaaggttgaaggtttctctagtaaattgtcttagtatatattgatctggaaattgaaattagcttgagattttcttgcagggaccttgacagcatacatttttaacttataatttgttcacctctgaatttgaacagaaagcccttgaagatattcacatgtactgaaaacctttttattgatttctatccaagttctatggaattttgattttcttttttaccaaattagtatcacaagttgtttttcaccactagatcttaataggttttaatttttactaaggtactttaaaatagatttcacttttcaagactaattgactacccactcactcctctacctacgcaaccacctactcactcacccactgtgtacttggccttacttgatggcataaatgaaagttctcgtttaatttagacccttcagtgtgtttttttcccccttggttgagaaagataacttacagagttaatgaggttttgaaatataagatcattatttggaatatgttttctttccagtggttgcagcctttacccttgttaaagctgtctttgagggaacatgtgcccaatttgttacaaatattggaaggatgccgtttccctttttaaaaattaaaactcttttccctgtgtttctcatttttgaaaatcttgcagaaactcctttgagtgactgttggttctataacattttctatgtaactatcttttaaatgactgaaacaaatctccaataataagaccttatcatagtcccaaaacttcttgtcttagcaaatgtagcgattactggaaaggaagggcgttatgcaaatgaggttaatgactaatttttatgtcatgatcatttactgtatcttttacaattataagtaagtgtacaaccggtaatactacatgaaggaaatttaagacaattcatcgaaattaaaacatagaaaaatgcctactttcttggtacagcagtgtgtatgaaagggaataacaaaatacataccatttttaccttgtgttaggtgaatacttgccctgtttagtagcctgtagcttcagactttcctgctctggtaggacatacactaaaattggaatgatgcagcatgacccttgcttaaggatgacgtgcaactttgtgaggcatgctgtatttgcttactcctcgagagcacttttatttaattacagttacttatttatggatctctctagttcactaataaggagcttcctgagggcagggaatgtttcttacacatctttctccattaacacagtgcgtgcaatgtaactgcctttcattagctgtggaatgaattgagtagttttaataaaatctcattaaaaggcaaaaaagcatgtttgtcaacctcagagcaattattgtccgaagagcctgcattagtttaaagtagtggttctccacctggctgcatattagaatcatccggggagcttttaaaaaagatcaacgccagagccctgtgtcaaagcagtgaagtccgagtttctgggactgggtcctggtcactgacatttttttaaagctctctgtgtgattctaatatgcagctataatgaggaatcattggcttaaaacttagattatgtatgtaatattttgggactggcttttcagaggcttacaattcttacaaagtagaataaattctttttggaaggtattgaagctaaatggctaaaacatggattttatcttctatgcacttgtgtttctcagccttattgtgtaaaaatttagttttagcttgtgtttggctttgatttcttgggccttttaagatccacattgatttatgacactcatctaatgctaacatggcgattgtctgacgtttggaacaacacagaacaaggattgcttcaataacagttgatgatggttttccactataatggcttgatttaatatgaagaaatttatcagtttagtatggattgtgtttgtacatacactctattaaaagagtatggttaagttgcttgtatgctttaaattacatacttgtgattccagtaatgctgttagctggagaattgagttaatgcagcctttatgtaaatactggattaataatacgtaaagtatataattcagcatacagaaaaattcagctttactaatttgtactaattactatgactttcacatgtattgattcatgcagtgatttgggtttctagtaccatagggagaatttcgcattgtgttgaaaaaatgtttcccggaaattttaactagactttgtaggtaaactagtttttaatgttaggaaaagatcaagtgtttgcctgaaggaaccgagaattttccagaaatgagtagatattccagaaataccagtgatcgtgaaagcagtgcatgatcacagtgacagccaagtaacaaggtaaaagaagtgatcagcagctaaattgttggtggcccagaaagaatgcaagccatgggagttaagctgtacttctacagaggaaaatccttttgaactcagggtgtggatgctacagatagcaggcctcaatgggagtggggaagcaatattgattcctgatgatcctaggatcatttggagggagaacagagctactccgttgcttttctgcatgtatacaaccttctctagtctcttcctgtctgctttttacagattgctttagggtgtgttgtttgaagttgtcttcataaatacttcctgtggactcccttaatttttatgtccgtaacacgcttctatgtacttgacatacgcagttcagctctctccattttttccttgtatctgcaacagtttcacctgatgaactacgtctcaagtgtccctaaattgtgtacctggatatttcctttaaactgaaaattctgtctccagctgtagttctactcaataaattgaaggagcagatataccttgcttcttgagattattcttgaattattacattttcttaaacgttttcacattttaaatgtggtaggagcactgcatttaaaggaactttgacataaggttgtttaaaaaacttctataacttaaagcttactttataaagggattgacatttatccctctaatgttaggcattttggatgtattatttaatcatacccattttacagagaacactgagattcagagggggtgatcagtaattcgcctaagatcacacagattccaacgcggttccatggttttaaagtctgttcatttcatgctgcattctgctgctaattcaagttgtgaaaatactgtgttggattttcttaaagacacgtcttcattttcagagtttctatactgcaaattttagttgtttgactttctggttaaatttcttatttcttcagtagaggttccatatactattcattctttcatctgtttcttttttatttttgtctttctctttaatgaaacatcagcatttgttaccaaactaactggtaaatctagcaatggaaatatagactcttggccatctgtccaaaatataatttgttttggaactttctctacttcttttactctccaaattttttcttccatttcccttgccccaacagacaggatagttgattaattacccctaacttgccaaaccagaagtaataaggtttcagaggtagatgtttgttggaagtggggtggagtggtttccaaaggatagttattcctttatcctgtgataaaaatacggagattgttctctctgattctgaaaaccgtgtagtgagctgcagccgctgagtctgtgagcttctagctgtttgccagcactgtacaccttaaataatcaagagactgagttaactattgcagagcaggtaccggaccccagccaacaagctgatgggatgtgctgttctcacattttttggttttattttttagttgcaactgacagtgaagattctagaagcaccaaatatggctctggatttatgctgtgggatttaagatgctacagaacttgctctccttcctttctgtcctggagccactatggtattggttgtagagcccaagtcagtatagagtctctgacttctaccctgggaaaatttcatttccgaagctagtttgttttgaagttaatgtttatttccaacattgagatttaataattttgtgttacttttctttattaattagtttttatacagtaaattataaaagtaatgatgcacgtagtaaattttattttctttttttgagatggagtctcgctctgtctcccaggctggagtgcagtggcacgatcttggctcactacaacctccgcctcctgggttcaagtgattctcttgcctcagcctcccaacaagctgggattacaagcatgcaccaccgcgcctggctaatttgtgtgtgcgtgtgtgtgtgtgtgtgtgtgtgtgttttgagacggagtctcactctgtcgcccaggctggagtgcaatggcgcgatctcggcttactgcaagctccgcctcccaggttcacgccattctcctgcctcagcctcccgagtagctgggactacagacgcccggctaatttttttttttttttttgtatttctagtagagatggggtttcaccatgtaagccaggatggtcttgatctcctgacctcgtgatccacccgccttggcctcccaaagtgctgggattacaggcgtgagccaccgcgtccagcctagttttttatttttagtagagacggggtttcaccaggctggtctcgaactcctgacgtcaggtgatccacctgccttggtctcccaaagtgctgggattacaggcgtgagccactgtgcccagccatacaatttaaaatataggtgatacaaagataagtagtgagtctgtctcaattctcctaccatccatatccccattctctagaggtaaccattgttcagtttcttctccatctttctggaagctttttgtttaaaagtgagatatttgtatactatgctgaaatattgatttttcatgaataatagtatatacttgatgatcttgtcatatccatcaatgtatctgtctgtctctatctcctctttagctgctgcccagtattctgtcatatggattgttactttggctttggattgagtgcaagccaattgtaattttacattgcttgaaatgctgagctggaatttgggtgagaggtatggaatggcagtgaagatttgggagtcatctgtgtggaagtaaaactgagtgaacaagttcttgggggttgactgctctagggctcgtggtttggagtataactcatagagttagaagaatcaggataatgggctgcacagaagtttaaaagaggggggaggatcaataatgtaaaatgccaatatactctgaggactaagaacacatgtggctataacagagaaacaatttaaagcacttatcaaaatgaatattatgtttaatagtcaattcatgatgtgtctgaaaagctaggtctggcttcttttctgtggatactagtaattttatactatctctctgtaaatctatctcagaaccaacatatttagggtaaaaacaaagtagatttctttttcactctaattgtgttttgcagatttctgatgactggcttttaggtaaaatcatttggttttcctaagattatgtccttttcattcccgagcttgtgcatgactgtcaattaaatggaagcctttcatgaagtgacaaagtaagttttagatactttacatttactttaagttcttggtatgtgtcaaaccactgttattgtcttatatctttctactataggaaactgaattctttctagcctcaaggatttttgtccacgttggatgaatgtagtactgtcctcctctttcacatttcttctcccatcacctcctaactaaatttgttcattggctatttttggttgtccacatccattcacaataagaaacgattgcttcgttgtacataagccagttttttggtatctaagtgcgtgctatttcacttcagcttcttgtattctatttattactgggctgttgtacattgttttttctcccaatctttgtgatttcttttaatatactttctttcctttttgctttgtaatcattgttttgagtatttgaatcatttgcaggtaagaatgtggattgttctgtctctcatgtagtttaataatatccaaaatatactatgttcagtctgtatttcaggcttttaacacttaagttagagtattttggtatatttaaatctaggatagaagtacactgtattaccattcaactacatgcagattttaatgttttcttaaattaaaggatgatgatattcattcagttacagaggtctctctctctagtccttccatggtgtgcagattaccattatactactgctatttcatagattctaatttgtgtttttagaaaacatcatcaattcttggccttctttcttacccttggtatgtgatttcccctaaaggtatggaatgcggttgctctgtggcttgttaggcagcccccttctgatctggtaacctttgggcacagtgtggctattttctccttatttataaaaggaatgatagctgcttcacaaaccatttgtgtggattagtgaattgtaaagtgcagcataagtattttttatttctagaatgtctctgagatactcaaattacttttggcagttatgtacgtaagtttcaacaatttccaaatgtgcacattctcagtgctaaacacaggctctattacataaataatatggtgaaatgaacattcttttctaccatgtgtgtaaaattgttagtggtgctaacttttattcattgttcatttatgtattcatttctagctatgaggtcctgggcaagttagttagcctctctgaccctcagtttctttatctgtaaaatgtggttaatggtatatactttgtaaggttgttgtgaggattgaatagcatgatctatgtgaaatgtctaaaggttgttattttaattgccattgtcattattattattttttaaattttattattattatactttaagttttagggtacatgtgcacaacgtgcaggtttgttacaaatgtatacatgtgccatgttggtgtgctgcacccattaactcgtcatttagcattaggtattgctattcaccaaacacttgagttctctggcctcagggagctcaaatgagttattcacacactcatgcacatatcctctgcgtaacttggtaaccaacagacacacatagtaaaatatttggtcagcagttgttgaatgagtgagtacattaactgagaaatccagagactgtgtgaccacctagtaggagaaggaagttggggaaatcattacagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaaagcgctgcgattacaggcatgaaccactgcacccagcctaagaaatatattgaagagtcctttctgtctttttaaaaactgtccaggccgggtgcagtggcttatgcccgtaatcccagcacgttggaaggctgaggtgggtggctcacttgaggtcaggagtttgagaccagcctgactaacgtggtgaagccccgtctctactaaaaatacaaatattagctgggcatggtggtgcgtgcctgtaatcccagctacttgggaggctgaggcaggagaattgcttgaacccaggaggcggaggttgcagcgagccaagattgcaccactgtagtccagctggggcaacaagagcaaaactctgtctcaaaaaaaaaaaaaaaaaaaaaaaacagaaaacaaacaaaaaaactgtccagtgagctgtaatcactgcactccaacccaggcaacagagcaagacactgtcttaaaaaaattcttttaaaaatgtcattgctctcattgttcaactcccacttatgagtaagaacatgcagtgtttggttttctgttcctgtgttagtttgctgagaatgatggtttccagcttcatccatgagaacatataggcacagggaggggaacatcacacaccggggcctgttgggggttggggggcaaggggagggataacattaggagaaatacctaatgtagatgatgggttgatgggtgcagcaaaccaccatggcacatgtatacctatgtaacaaacctgtacgttctgcacatgtatcccagaacttaaagtataataaaaaaagttaaaaaaaaactgtcattgcctcttatgtacatagaaaatacagtattgagttacagattttcataatttgtttccaagtctgttctagattataattccgtagtgttgtgaaaaactcccaagattgttaaaagaaggaattttgtatcacacttcttatgtttgcatttagacaattgacagattaattaattgttcataatgtgaaatttcaagactgaaaaaaggaaaatcccagaatatatatttcagaaacacccatatataggatttatgaatattgtagtgttcctttatgtaacttcccaaaattttattacaacagcaatttctacatcttaacagtgagcaaaatgaggtggaaagattctgaagttgtagtctctgacactactgggcactgaatctaaataacctaaaaccacagaacagtatttcatcttctagttcttattacattgtcaggtgtaagaatgatcatgttgaaattgagtggttggtctgtttagatcacttctatggaaatactgcttagattggtttcagaaatccttggacagtattatttatattgcattatttaggttagaaatttttgctgacttccatctgagttattagttcaaaagcagaatcatcagcctttatatggaatctctgctggtgctcatcttaggcttagtatcttcttaactgggtttttgttagcagtatagtgtggcattaaatttgagactatctttttaataaattttttaaaaattttgtcagttgtagaataattagatacttgtaaaacaagcaagaagctgttttcactgaggactttctttaattacatttcatataaatttaagagaactgttactagaatattaaaatcacaggttaaagtgagaatgtatttcacataatcaacatacataacatttttaacagcatgctaaagatggaaaaaacctttaccaaccatacatattataggcaaagctttaaaaaaaacaaaacattttgctcttatggatgtgaaagtaatctgtgtaaatatgtatttaaatgaaaatatctattcattatcattgcagaaggagtgtgggtatctggagagggagcattctaaacttgctgctctactttttggattatctacattaatatttctcccattgctgagtatttctgttatactgctggatcatcatacttccataatctgtgacccacttgctctaatggtagagtgggctttaaactgccatctgattaaagttcaggtttcttagttagacttgcctgggtggcttcagaattaggcccacaaatatgaatatggacttgaagatcttactagaacaatattttccccgataaagacacatccataaacatggtcctaaaaagatatgtgtaagttggatttgaaaaatgcaatttaagagttactaggaaaaagggattttaaggaaacattttaagtaatttgtgtgatatcaccagttggtttttcttcagtttcttcatcttgtaaaagaaggatagtaatggctatattatctacctcatgagattctcatgcacataaaattacataattcttaagtcttaaactaccttacgtatattattatttcaattttattgaaataaaacactttttttttttgtgatggagtctcactctgtcacccaggctggagtgcaatggtgtgatctctgctcactgcaacctccgcctcctgggttcaagcaattctcctgcctcagcctcccgagtagctgggactacacatgtgcaccaccacgcccggcttagtcttgtatttttagtagagacagggttttgccatgttggccaggctgatctcaaactcctgagctcaggtgatctgcctgcctcggcctcccaaagtgctgggattacaggcatgagccactgtgcctggcccaaactaaaacacttctaatggacttgtactttggctgggcacggtggctcacacctgtaatccctgcactttgggaggccaaggtgggtggatcatttgaggccaggagttcaagaccagcccaggcaacatggtgaaacctcgtctctactaaaaatgtcataaaattagccggccatggtggcgtgtgcctgtaataccagctacttgggaggctgaggcgggagaatagtttgaacccgggaggcatagtttgcagtgagccgagatcatgccattgcactccagcctgggcgatagagcgagactaagaaaaaaaaaaacaaaacaagaacatgggctttgttgacttttctttgattttgtaagaatcatttacctttgtctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaatcttcatttttcccaattcttactgcctttttacttcctcaagagaaaacccaccttgtgactgccaagtttagggattcatgtgagctgtttggaatgtttgtttgtttgtttgtttgacagagtcttgttctgtcgcccaggctggagtgcagtggcacaatctcagctcactgcaacctctgcctctcaggttcaagcaattctccctgcttcagcatcctgagtagctgggattacaggccaccacgcctggctaatttttctaatttttgtattttttagcagagacggggtttcaccatgttggccaggctgatcttgaactcctgacctcaggtgatctgcctccttcagcctcccaaagtgctgggactgtttagtgtgttctaagccaggggtccccaacccttgggccgctgaccagtaccggttcatgacctgttagaaaccaggccgcacaacaggaggtgagcagcaggccagccagcattactgcctgagctctgcctcctgtaagatcagtggcagcattagattctcatagaagcacaaaccctattgtgaactgcacatgcgcgggaactaggttgcatgttccttatgagaatctaatgcctgatgatctgagatggaacagtctcatcccgaaccccctacccccaccccggtccccatcgtccatggaaaaattgtcttccacaaaaccggtccctgatgccaaaaaggttaggtaccactgttctaagccattgaaatagtgccatcccttctggaaaattgttacccttgtcctggagtgctgtagtcactggtatttcaccaggatgttagggtatttcaccaggatgttagtgagcacatagatattgaatatttcgggcaatcttagaatgtttactgggagagttttaaaagttagccttcccacatccctccaagaatagctgtttctctttgtagctggaatgtcatgttgtactcttgattctcctttgtacctgttcttagccattaaggtgattggtggtcaacttcgtataaaatacaactcaattttaccattgttcttattgatgcacatgaatgtttctctttatgcatatcactgagggaagtatagtagcctttgaaagaaaggccttcttgtagtctcccctggctctggtagcaaggtcaggcaaaagtgttgtttttgcagttgtgactccatggttgtgtttttctttacataactgatgttttaagtcaggaaatatgactttgccaaatgatactgagctatattactggtgagtttgtttggttcctgatttatttcagtaaatctgggttgaatagtttagtagtagatgctggggaagatacaggaaatagtgagtttgagactagaaatgattgagttagacatttaatttaggctttcccaatcaacttacttcataccttttgccctgcttactcatcccagaggtgaggaacaatgagaagaggggtcaggcaaaggccatccctcagaatgtggttacttaggtctgtcgccaaaggcaacctatctactggaaaatttgagctttactgtcttctgcagtatagtgttggaaatgcagtattttaaaaactaaattgttatttatagcagtgaataaaatgtgaactctttaaaaaaagagcagtgttactgtcccagctagcacaatagccacccacatgaatcatctgaacaacctcctcatttctgttttatctacctgaaataggggtcagcggtaggtgatgatgaaagcttgggaaatcatgccatgcattaggcaggagaaatgctgtggtgactctttctgtgttgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatattgtagccactagccagatgtggctatttcaagttaattaaaattaaaatttaaaattcactgaacagacatttctccaaaaaagatttataaatgaccaataaatacacggaaaggtgctcaacatcaagtcattatggaagtgcaaatcaagaccaaatgaaataccacttcatgtgcactaggatggttagaatcaaaaagacaataacaagggttggcagggatgtggagaaattggatctctcgtacgttggtgggaatgtagaatgttgcagccaccttgaaaaacacactggcagttcctcaaaaagttaaatatagagtttccatacagcccaacaattccattcctaggtatgtgcccaagagaattaaaaatgtatatttacacagaaacttatacatgaacattcatagcagcatttcataatagccaaaaggtgaaaacaaccccagtgtccattaatggatgaatggataaacaaaatgtggtagttgcacacaatggaatatcattcaactataaaataaattaagataaagacgcatgtgtatgttcatcacagcactattcataatagcaaaggcatgtaattgacctagatgcctgtcaacagtggactggttaaagaaaatgtggtacatatatactgtgggatactatgcagccataaaaaagaataagattatatcctttgcagtaacatagatggagctggaggccattattctgagtgaagtaacacaggaagagaaaaccaaataccacatgttcttacttataagtaagagataaacattgagcccacacagacacaaagaagggaacagtagacactggggcctacttgagggtggagcattaggatcgaaaaattgtaggatactatgctgattacctgggtgacaaaattatctgtacaccaaacccctgtgatatgcaatttacccatgtaatatgtatcccctgaacctaaaataaaagttggaaagaggaaaaaaaaagatcactttgggaagaattgatagcttaaattattgtgtcatccaatgtatgaacaaggtatatctctattatttgggtattgtttaatttctctcagcagtgttttgtagttttaaaagtacaagtcttgtacatcttttgtcacattcttaaatatttcatatattatgctgtggtaaatctgtttttcatttgaatttctgattgattgttgttagtatatagaaatgtaattgattttttgtatgttactcttatgtcctgcaactttgctagattcacttattctagtagaatgatgtatattgcattggatagtctacatagatgatcatatcatctgtgtataaagacttcctttccccaaaaaaagaaataaagtacagatacatggtgcaacatgcattaacttcaaaaacattatgctgagtaaaagatgccaaacacaaaagaccacatattgtatgatttcatttttaagaaatggcctcagtaggtaaatctgttgatatagacactagattagtatttactagggactgggaggaggagagtgtgggcagtgactactaataggtatggggtttcattctgaggttatgaaaattttaatggaatttaggtagttcttagtgatcaaggcacaactttgtgaatatactaaaaaccaccagattgtatacttaaaaagggtgaattttatggtatgaattatatctcaataaatgttatttttaaaaattcagttccttagttactttagccacatttcagttgctcagtagctacatgtggctagtgactgcatggtagacagtgcagatttagaacgtttccatcatcacagaaagttctgttagacagcactgatctaagagtctcaatctgagaccaaaaaataaaggaagaaaaaccagtctaaaaaacacagggagtggagaacagattatgttctgaagaaatgttactttggggtaattttaccctttgttgccctttgactgttctactaggagtcctcaacatgattttcattttattctcaaaacaaatgcctgtggtaggtactgttatactcatgttttataattgaattatatgagttttaagatatttgtgtagtaagggtagagcaaaatttctaacctaggtacataatctctgttacattgtttacctctgtttatggtatttgattttcttaccaaccatccttcactcccactttgttgctagcccactagagctattttcagtaccctaaatgcacagttctttttgtgccatagcagatgctagccctccttcctccttctgccgtctcccaacactagtatgtgcatgtgcacacatttactggccccacttacctgaaagtgtggtgcacatctctcttcctttgtgaagctatctgataccacagttttaggggctactctctcacctggttaaggttacataatgtcgcaagatataagcaagaatgctgacaggattcttgttgtgacactatgacacattgagcccaattcatagctgctgtgttggtgactctaacagggaagtggtcttctagtccaggcccttggctcccatttatacattatctcctttccattcacagccttctttaatccccacccacactgctacagtacctgactgaactttgcctttctttgcctcttcatatgtttttctgcttaagctttttgaacctgatgagatactgccatgtttttatatttttctgctcataaaacccttaatggtaaaaagatacctgattgaattctgaagtgctttcatggctttgcctgattctgaggtcatattttctaactttatgctaacatcagtttactctctggttttatatggagcatgtactcctgtagcttctgaagaaaggtttaatgggaagcaaattttgagactacatgtagtaggctaaatcatggcccaccaaagatgtacacatcctaattactagaacctgtgagtatgttactttacatggtaaaaggatctttgcagatcttattaaatttaggattttgagatgggggattatcccagaatatttggatggacccagtttaatcacaagggtccttataagaggaaggcaggagggtcaaagtaagtaaaaggagacacgacaatggaatcaaccagagtttggagtgatgcactttgaagatggaggaagagggccacaaaccggggaatgcaggcagcttcaagaacatggaaaagcttctcccctgaagccaacatcttgatttgagatttctgacctctgatcagaactgtaagagaataaatttgtgttgtttaaagccactaagtttgtggtagtttattacaacagtagtaggaaattatgaatacaccatgtataaaaatgtcattatgccctttaacttgattgatagtttatgtagacctaatatatatgtacacatactagtctccatggctccatgctgcagtggacccaggacccaggcccaccatccatggactcaggttccaaacccaccccagcagacttggcctccagactcaccctggcggatccgggctccaggatcatccctggttgtctcagactccaggcctgcccctgcagacccagtcttcaggcctaccttcgtgatcccaggcaccaagcctgcgtccttgaatccaggtgccaggctcattctagcaccaggctagtcccttaagactcaggctcaaggcccagtgcagcaccagattgagctttatggacccaggattcacactggcccctgtgaatacaggctttaggcctgccctgcatgcccagctgacaggcttgacaggcttacctgagtggaccctggcactaggctgttccccatgcacaccaggattgagatccaccctagcaaactcaagccgtaggcctgtcctaatggacccaagtttcaggatagcccacctgaaaactccagcagcaagcccccctgccagacagccctccggaatttctggacaggctgactggtaaaaggcttttcctgccaaagccagtctgtgaagactgcaagtgcctacttcttcttctttttttttttttttctgagacagggtctcactctgttgcccaggctggagtatagtggagtgatcacagctcactgcagccttgacctctcaggctcaagcaataccactgcctcagccaatcctactgcctcagcctcctgagtagctgggaccacaggcaagtgccaacaggcctggctaatatttgtattttttgtagagacaaggtttcttcaagttgcccaagctggtcctcaagcaacccacccgccttggcctctgaagtgctgggattacaggcgtgaaccaccatgcccagccaagtgcctgctttgtaaaatgtgcagacactaatgcaaaactgcaaggatcaccgataatcagggaaacatgacatcaccagaggaacaaaatgaagcaccggtaaccagtcataaagaaatggacatctatgaattgactgataaagaattcaaggccaggtgcagtgtctcgcatctctaatcccaccactttgggaggccaaggtgggtggatcacttgaggtcaggagtttgagaccagcctggccaacatggtgaaacctcatctctactaaaaatacaaaaattagccaggtgtcatggcatgcgcctgtaatcccagctactcgggaggctgaggcaggagaattgcttgaacctgggaggcagaggtcacagtgagccgaggtcatgccactgcactccagcctggctgacagagcaagactccatctcaaaaaaaaaaaaaaaaaaaaaaaagatttcaaaataatcaaataatcatcttaaaagaagttcagtgagttaaaagagaatatagatggacaacaaaatcaggaaaataatacacaaacaatatgagaagttcaacaaggaaacctcaaaaaaaaaaaaaaaaagaaccaaacagaaattctagagctgaagaacacagtgtctgaactgaaaaattccacagaaagcttcaatagtagacttgaagtagaagaaaaaattagtgagctcaaagatggtcatttgaaactacccagttagaggaagaaaaagacaactaaatgaaaaagagtgaagacagcctatgggagttatgaggtaccatcaaacaaagcaataaatgcatatgagatttccagatgaagcagagaaagaaaaaggggaagacagcttaaagaaataatgacagaaaatgtcccaaatctggagacatgaatgaacatccagatccatgaagtccaaagaacctccaactagattaaagagatcttcactgagacactttataatcaaattctcaaaagtcaaagataatttcaaaagcatcaagagaaaagcaaaccatcacctacaaggaaacctctataagactatcagtggatttctcagcagaaactttccaggccaggagagaatgggatgatatattcaaagcgctgaaagaaaaaaaaaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataatactagcagattttaataccccactttcaacaatgcacagaaaatcaataaggaaatagcagatttgtactacactgtaggccaaatggatctaagagtcatctgcagaatatcttatccaacagtagcagaatacgatgttcttttcaagtgtgcatggaccagtctctaggatagatgatatgttaggctacaaaacaagtcttaacaaatttaagaagattgaaatcataccaagtgtttttttctgaccacagtggtatgaaactagaaatcaaaagaaaacggaaaattcctaaatatgtggaaagtagacaacacactcctgaacaaccagtggatcaaagaagaaattgtaaggaaaataaaatcttgaggcaaatgaaaatggaaacacaacataccaaaacttatgggatgccatgaaagcagttcgaagagagaagcttataatgataaatagcaatacatgaagaaaaaagaaagatctcaaatagacaacctaactttacaccttgaggaactagaaaaagaacaaactaagctcgaggccaaaaaaggaaggaaataataaagatcaatgcagaaataaatgaaatagagactagaaaaacaatagaagttatcaacagaactgagttggttttttgaaaagtaaaatcaacaaatctttagctagactgagaaaaagagaagactcaaaattataaataaaagagacattgcaacttaaagagatacaaaggtttataagagactactataaacaattatataccaacaaatttgatagcctagaagaaattgacaaattactaaaaatacagcctatcaagactggatcatgaagaaatagaaaatctgaacagacctataatgagaaaggagattgacttagtaatcaaaaacctcccccaaaagaaactcccagaacctatggcatcagtggcaaattctgtcaaacctgtaaagaggaattaatgccagtccattttaaactcttccaaaaaattgaagagggaatacttccaaactcattttatgaagccagcattaccctgatgctaaagctagacaaggacagtacaagaaaagaaaattacagaaaatacaagaaaaaaattcctgatggatatagatgccaaagtcctcaacaaaatactagcaagccgaattcaactgcatattaaaatcatgcatgcttggtacaacagatatatctgaagagactcttttctctatggttggtttcttcttgatcatcactacctcttagtgtacaggaagctcaaaatattactgtgtgaccttaacaaaataaatttacttctctggtctttaggtttttttcaatgggaaaatgggaaggttggctccattagtttctaaagtccctttgagctctgaaatgagtaattttataatttctaagtgtttaattcatcaactacatgactttaccttttttcttcattacctgtcaaattcacttaaaaactattatcacacttcatttgctttttaataaatttctgacagcatgaatgggagaaaaaaagggactatacagcatgatcaaagaagatttatccctggaatgcaaggatggttcaacatatacaaattgataaatcacattaacagaataaagtacaaaaaccatatgatcatctcaatagatgcagaaaatatgtttgacaaaattcaaaatcttttcatgataaaactctcaagaaattaggtgtagaaagaacataccttaacacaataaaggctgtatatgacaggcccacagctaacatcaacactcaatactgaaaagctgaaagccttttttctaagattaggaagacaaggatatccactctcaccacttatagtcgggataatatgggaagtctgtcctagccagagtacacaagaaaaatgcatccaaatcagaaaggaagaaataaaattttcggtttgcagatgacttaaaattatatatcaaaaactcttaaaactccaccaaaaaaacctgttaaaactaataagcaaattcactaaagtggcagatacagagtcaacctacaaaaattaatagtgggggaggagggagtagggatggttaatggtcaccaaaatatagttagatagaatgaataaaatctagtgtttgatagcacaacagggtgattacagtcaacaataatttattgtacatttgaaaataactagaagagtataattggaatatttgtaacacacagaaatgataagtgcttgaggtaatggatatcccatttaccctgatgtgattattgtgcctctatcaaaatatctcacataccctataaatctctacacctacgtacccataaaaattaaaaattaaaaacaatagcatttgtatgcactagcaatgaactgagaaagaaatcaagaaagtctgatctacaatagaatcaaaaatatataattcatttctaagaggtttttttgttctctcttcttgtatatagcttcaagattttgtttcttatatgctatgtctaatgtcctccaagagaaagagagggaaatggaattataattaacattgtcttttccctatattatctgttttctcttattttcttttttcctgttttttagctttggtacttgtctgtctttcatgttagaggtgtttctcaagcatcttcagctgtttgttgctattaaggaaaagtttattggaaactgtgttcatgactgtggcttgttcagtgatggacctcatgtggtgtgattgagggaaacctggctatttatggggagcctatcagttcttttttcttaagccagtcagcttttctaaataggatttctaaattgaatcttttgtgggagggagtttgggagtaataagctcatgtctagggctggatccttaatcattggctgcaaagacttatttaacccttgttttcagtaaggcatcccatttttgttctcagttatggctggtgttcctgagttcaggggctctgattcaacctctccagagagtaacttaagccctctgctatgtggagaaaaggcagttgccagatgctctggttggagtgagagtatgtgaaaatcttacttctcttttttaaacaatttttcagcatccccccaccacttgctttaaaaaaaaggattattttcttcaaatgtgcccataagctgcaattcctgagcttttaccttctgttcttccagggcactcaggagtgaactggcttacttgcctcaatttagattcccccactgcaggtacttggcacaaagaagaaagatacaatcaagtcagttacctcttttccaaatgcttttcattttaaattttgtgggcctatctcctttgctgtcatcatctccccacgctcttcatcttgttggtttatatcttttctaattcttcagtcttttgatttgtagagggagttagataaatgcttgtatctgatcagttatgtttaaacaaaagcgcctccctcccttgacaccttctctttttcttggacttctgtttcttagactgtttccaccattagaataagagcttgtcaagggcaggaaccagggtatttaatagctccagcatttgtataatgcctggagtatagtaggattattaaataaatgaacatacctttattttcaattatagatttctctgacttgagaaataatttcaaataaaacagtgaagtctctcttacagataagttcggaagctctcctctttcctcgattcttgcttatttttatccacagtgcgtctcgtgaaggaaaagaatggatcattctttcttgatttcctcgttggtaaagtatttggctttaagagctattcaaatgaatgtgcaaagtaagagtaagttgggtgtatttctagcactaagttgttgaggttctagaaaggtagttttgtgccttctagataccatgtctgcctttcctaatgagcctggtatgtatactattctgcctagcataactaggagcaataggatagagaagtgggatataccatttcaaagattcactgatgctgcttagaaacaaaaatctaaatgaaaaccaatgtacataaattagataattcacatataccattagaaattccacttaaagtcagtactgctagaaaccttgtcattaccttgctttaaatgctaagcgctttctgattaattctttttcagtttatttacctgggaggtattcgatctaagcaccagcatccctgcccccacttttatctattaatatttacaggtttttccctctttgaagctccctattgaattctgaatgactttgaacttggaattgctctgggtctgcttttcacctcctttctctacctcccaccccaaccttcactaatttgcttttttttttttttttttttttaatatttgggtggtttcttcttgcattctcttttttctatatgctccatgacagcctggactacatttctgttactcactgctgcatccagtgcttagcacatgctgggccttaagtcactgtttattgaaaagaataaatggattactcgttgaaatttttttaattatgaataacaaaaattagtaatctaactatatattatcaatcttttgctgtcttatcttacaggttttctttctggttttcatactggatagtctctattgacctagcttcaagtttgctgatttttttctactgtcaacttaaacttgctgttgagtccttctagtgaattttttgtcaattatagtacttttcaactcctcagtttctattttttttaagaattctttttctttattgatgttctctatttggtaagtcattatcctcatactttaaaaaacttctttaagtatagtttcctttaattctttgaatatatttataatagctaatttaaagtctttactaagtctaacagctgagccccctcaggaagtttctattggctgctttttttcttctgtatgggccatcttttcctgtttctttgaatgtctcataatttttctgttgttgataactgaacattttagataatatattgtagcaactctggattctgatccactcaggtagtggttattgtttttacttttgtttttccattgcttaatgacttgcctggactaattctacagaggctgtctttgctgaaatgtgtggccactgaagtttgtgctaggattttttgttttgttttaaattcttgtttttatttttaagcctggcttcctagggttttccccttggtcatccaatggttggccacaagttttccttaaacactttgagccaataagccttccatcttttgctgaaggaatctctgtgtgggttggggcatacgttgaaagttcaggcagtttaaaagtctgccttggctttcactttctgcttgtgtagggcctcacagtcagccaggagcagtagataattgggaatctttctggtctctcttgaacatgcatacatgcacagagccctccaaatggatacaaccttccagaacccccaagtatgtcagagctttaagctttctatggctgtctcattccccacatctaccttttacatgttggctagtgtcttgcttacctcaaccagtattgcagacttaagcagctgtgattgtttctaatgattgctattgtttttgacagtgcccctggccatggggctttctcttggagctccatatcaagtcagcttccttcagtggaactgtccacaaagctacaaggccagcgaattgtggtagaagcggacccaaattaaaatgtcacagaccctgctggtcttacctaggatcattagtagctgaggtcctcactccgccattccagaagtcctgccccccacctctgccttaggttttcaatgtgtttttatagctgtttatagttttgtggcttttcatttagtataaatattttctcatgttcttgataactcattataactaatttctactggctctcatcatttgaatgtctcataattgatttggtaatttcccctgttgttggacttcagataatcactggtgtaatttgcctttcccaacaggctctaacctgaatgaggcctgggactgctttgtttactacttcatcctcagtgcctgacacagtaattcttgttaaataaaggtcaccccacaattttttaaatgttataaataacactttgaggtggatcgtactgccaaaactgtattcagatttcagattttttttaagaatggagtttcagaaatggaattgcttggtcaaaggatataggcatttctaaacctcttgacataggttgccagattgatttcttaaaaagtcctatcaaaatagaaccttttggccgggtatggtggctcacacctgtaatctcagcacttcgggaggctgaggcaggtggatcacttgagatcaagagttcgagaccatcctggccaacatggcaaaaccctgtctctactaaaaatacaaaaaatttagctgggtgtggtgacgcgtgcctgtagtcccagctatgcgggaggctgaggcaggagaaccacttgaaccccagaggcagaggttgcagagagccaagaccacgccactgcactccagcctaggtgacagccagactctgtctcgaaaagaaaaaaaagagaacctgttttttcagcagcatccttatctgttgcattgtatatttggcgacatcagatgtgctagttgctcaagttttattgaccttattggccaaaaaaaaaaaaaaaaaaattctcgttgaactattttgtgtctttttttgagacagggtctcagtctgtcacccaggctggagtgcagtggtgcaatcacagctcactgcagcctcaacctcctgggctcaaatgatcctcccatctcagcttctcaagtaactgggactacaggtatgtgccagcagacccagctaattttttgtttgtttgttttagagatggggtctcaccatgttgcccagcctggtcttgaactcctgggctcaagcagtcctcccaccttggcctcccaaagtgctgggattacaggcatgagccaccatgcccagctattttgtgtctcttcgataaccaatgaaagtattagttttcctcatactttttaaaaaaaattctttctataaattggccatttgtttttcccccattttgctcttagttgcctaatgtttttcttgctaatttatgtaaactttatatatcaaagatatttatctattattgtcttttatatatttttaaaatttttcattttgttcctgatgagtttggatgtgcagaaactaaaaatcatacagaagaagcctctttgttcgatatgattggatattacaactggtctgctaaagagggaggagtataaaaaaagtctacagatatctcttcaatattttaacttgaagacaaaatatacattaagtagctaatcctttgatattgtgtgacccttttctttgaataagtctaattgattcgaaacctgctctatatttcttttatatatctcatccaaaatgcatcatcaacgatgtccagttttgatttatttaaaatggggtaatgacttaatgagctgtaatctgagtgcaaaatccttttggatattttatagatccttgctccccccgcccccccacccagtcttttgcagttttgtcacccacatttaattcagtatctcctttatctggtctttgaagccagttcttctcttttgtagtcacattcaattgctgtaacatatatgtaacatataattaagaattataggccggatgcagtgcctaacacttgtaatcccagtactttgggaggccgaggtgggcagatcgcttgaggtcaggagttcgagaccagcttgaccaacatggcaaaattccatctctactaaaaattaaaaaaaaatagctgggtgtggtggcacgcacctgtaataccagctacttgggaggctgaggcatgagagtcacttgaacctgggaggcagaggttgcagtgagccaaggttgcatcactgcactccagcctgagtgacagactgagactgtctcaaaaaaaaaaaaaaagaaattatagtaacacctacacaaccaacataaagaggtacacatttaggaacaaatacaaatagctcttggtatgtagacaacttaatttgtggggttcatgggctcatatgtactacacagtaccctgtcagcattgagcagtcagcatgcagcaggcattcattaggtttctacagagggaatggagaatggatcagtctgtgaaatttgttaagtggggtcaattaagagtgcttctaccatggtcaaaatctaatcagtctttttctttgttgtgattgtttccatgcttagaaagtccttcccttcttgagagttatgtgaaaattcacctacatttttctgtctttcttttgattcatacatttaactctttagttcatctgaaatttattttgttttttagtaagaagtaaggatgtaagcatctaaatagattttccaccttcaaataatgtgctgttttttttttccccagcatagccagtgcattcttcaaaggcaaagatcaaaaatgtaatttctagttttcaacaattagaataggggttgaatgggtctgggtcttgggagtggaaggtcagtatggtccttggggttggggaagggcaggcagagcatagagtggaatttaaaacacacacacacatacacacacacacacacacacacgcatgcacattcacatgataaggagaaaaagataactgagaaattggataataacagagctagtaggaagaggatatagtacaatgaaccctctttagaatgcaggccctttccaaaatgaaaatttgaagggtacttgggctctatttgatgaattatagtgaggtaaagtagtttattaagcatttgaataaacctaaatagttaataagctattgtttattaataaaaggtatgccaacaaggaagtaattatgcaaagttctacagagctgtcaaacttgaaagcatgtttttccccaccgattttgccagtctctactgggaaattatttatgatcattccctcagtcttttgaataagtcaacttctctcagtgcaatcattgctttttcctgggccatagcattaggtcaattagtgaaatattaggcataatactctttaaggctatgaatggccttgaagtactgtatgaaaaatatgagattaatattaagaagctgctatgaagcaaatgttaccagtggaaaattttattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatcaaaaaataaaaaaaaaaagatgttggcatggatttggtgaaaagggaacactcttacactgttggtgggaatgtaaattagtacaaccactatggaaaacagtatggtgattccttaacatctaaatagattttccaccctcagataacgtgcctttttttttttttccaggatagcaactgcattcttcaaagggacagatgaaaaatgtcatttctagttctcaacaattggaatagaggttgaatgggtctgggtcttgggagaggaaggtcagaactaaaagtagatctaccgtttgatccagcagtcccactactaggtatctacccaaaggaaaagaagtcattatacgaaaaagatacttgcacacacgtttatagcagcacaatttgcaattgcaaaaatatggaactagcccaaatgcccatcaatcaatgagtggataaagaaaatgtggggtgtgtttgcgtatatatacacacacacatatatatacatacatatatacatatacatgtatatatacatatatatacacatacatgtatatatacatatatacacatacatatacatatatatgtatatatatacatatattcacatacatatacatatatacgtatatatatacatatattcacatacatatacatatatacacacacatatatacacatatatatacatacatatatatataatggaatactactcagccataaaaaggaatgaaataatggcatttgcagcaaccttgatggaattggagactgctattctaagtgaagtaactcaggaatggaaaaccaaacattgtatgttctcataagtgggagctaaggtatgagaatgcaaaggcataagaatgatatattggactttggggactcaagggaaagtgtgggagggggtgaggaataaaacacattgggtacagtgtacactgcttgggtgatgggtgcatcaaaatctcagaaataaaaaaaaaataaatgaatcaccaaccaccaaccaaccaatatgggagatttgtttcagctggagggccttagtttcttaaagtagttttcttctcttgctctggaaagtactaattccaaggcctcttttctcctcccagttgtaggatattggggattcttactagaaagcgtaggcagagcacatgcagccagtgtccccaagttttttagaccatctggagctacctgtggctgctatgtagcctaaaacttcagaaggccttatgatctattggcagatggctaaactgggatccttgtgtcagggttttcttttatgttatttttaaattccagaatagaagagaaaatgaaatggagaaagaagacattgaaggttgtggtgttttctgtgaagttcaagaagtattgacatttctcagaagagtatgactatagatgatattgttactgtttggggttttttgttggtcatggtggtagtgatggatttttttttttaagagtcacgtttcttcacctagaattagctgaggaaaagtggcatctgtattgatggttttaatagatatgattttattggtggtgccttcagagtagtggcttagagtaattagaaagacatcattgctttgtataggtcttaaaaagattgttaaacttttaattcaatgttggctgagcctgctgtgcctgatacattaaaagaaaaaagtcttatgatttactgaaaagagtaaaatggtcctgatttcagttactcccttctactcatgcacactgtgttgcttactgccctttttaaatccaaggtgattcttcaacctcatacattgttttaacatttcactctatgtctaggacatgtctagaatatttaagtgcctttttcttggaaataatagagatgtatcatacccagttttatttgcttaggtagcagataaagacttcagaaatactcaatatttgagtatttgggttggaatttgacactgtgtgtgtgtgtgtgtgtgtgtgtgtgtgtgtgtgtgtgtgtgtggactcaactagcctaaaagaaagataaatgcctcttagaagctagaggggaaaaacctatgaaaacttagtttgggatgtacctatgatgaagaatttgccctctgatttctcttccatgtggctgattttgaaggttgtatagtattttgtttttatgttttgatacagctgttaattcttgaccattttcctcagaaattggcatttccagattggcaaaatctagtatcattgtaggtagctctttacagataaatttgtacgggagagtatgcaatatattttgaaacttctgtttttgtgtgtacaaatctctaaatcagcccagatggtggccattatggattagtaatagcaagaaagaaagctgttaatatcacagcttctaacatatgtctcctgattgtgggtatatatgcctggtgtcaaagataacgctacagcatacctattacggcttttaaaaagttactaaggcatttctatctgtatcagccaactagaaggatggattagacaacatgatatatgtagtgcttttatctctggcaggtagctaagtctttgaaagaagatatatcttctcatctggccagaatgttttgattttaacttgaaatttcctaacaagagttcttatgtgtttattattgcatgttcttatgtgtttatttttaaaactatcctttagcatttaggcacattaatttatagcacctgtagagcaatcagttgcaatatctgcatatatgccttttattttctgtaattgagatctgtattatatttatataatcagtgtgtaagttactctaaaagttatctagtcaagcttgactttaaagatgtctttgtaacttgttctacattgttactgtttccttcagaaagttaagtttccaagcttctttaagttacattctagacgttccgaggggttccaaagtgttgaaaaggaaattgaagtaagctttggaatatgttaataagcttcaactggaaacatgtatggtagcagctgttttaaaggccgctgatagtgagatgttaattgagtactttttaaaatatattacccaaccttctctaagctctgaagcttcaattacatttatcctaggcactaagacttgaatccaaaggggttacttcactgctcttcttgaggttgggggtcctatgttattcactattgtaacagcaacagattataatgattggtaggcaaccaaatgcttgctgatttaattaaacttgcctagttatttttaccttattgtaaattttggtctatagagctgaagagatttctccccttttctttgaattaagaaaaagccacatatgtgtggtaaactccccttcaccataatgaaactactttttcttcattctttgtaaaatattaacccagtagagtaaaaactgaattcttccatgaatggtggtatttcttctatctggcaaattaaagcaatggagaccattagggtataaccctgaactttttgtgctccctccaccctggtccgttatttctttggtataaaatcagaagaatgaaatcttagtagagttctcgtaccactacacaagacaaggtaaccatgctcttgaaatagatttaattttagatgttgagtgttcctaatgggtggcaaattatttatgctaattgtgaggaataaattacttatagatttattaataatttacacatagtaacttaaggttcaaagtttgttaacacttattttatatatgacattcacatcaactgtatgaggtaactagatttttctttttccatctcataaatgaaaaaaacaggttttttgtgaaaatgcaacttgcccaaagttgtagaattagatttttataaacagatctgagttacttaatatgtgtagaaatctttacttgacaaattttcgacattgtaaggtttgtaattttatctcagaatcctagaattctagagctgagagaaacttaagttgatacaaatggaaaataggttctttattgagtgccaggttaatatcaattgtagctgttgagacttggagttgagacatttttattgacttatttccagtttattggcagagagtgccctaattgattaaccatgcctgaagtagacatggggcaacatatagatgacaaatatgtggcagtcagactcagtaacttgatatagcattttgaaagtacctaatatagctttttacagattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaattaacagcgggaactgcggccactgattgggaagcctaaatacaatgagggtaattggatcccaggatggcaaggaccagtagcacttaattgccaaaggaagggcaggtatggttactgaaatggacagcagagtcaaagcaacaattagaatgaactgactagtacagggtgatttcttttgctccaagcaggcccctggctgttctctggagattctttattgtccattcttctccatggccctatctgaaatgctctttggggagcacatttttcttggggactacacagctttcatagctaacatattactgttgagggtttggagccatgaattattttagagatttaatagctattggctgctgcagggcagttttggggtttccatgacaatatcgtttcgtcaaaaaatgtcgatatttttcttcttgtttttagtaagctccacgggggagaagccacatctagacatagtttcttagcctgaaaattcttctacttactggcctctgtgctctgcccttttctttcagcttttgagttaatagccagctgcctcgaggtaggcaacacccttaatctgatttttgctggctagttttctttcctgtcctgaagggaactcttaaaacagcttggggttgtggtttcatctcctgctaagacagccacttctctgagttactgcttataatcacctcagtttgagagtacaggagctgttgatgtttatagtcctccaaagcttcaaattatgtgactttcagtcgatttaaattgaaggctgcaggcacagaatggctggctcaagttctatttggtctctcctaggactgggctcaaaagctgcaagaggaaaccatcatacatccatatcccgaaaatgtcctacatttccataaactgtagcctcatttggcatatggtattaccaaatgttttgccactacctaacaagagtaaccagctttaagagtcactgtgaattggttagagactgatgggattagttaagactaattttccttaaagtcttttcttttccttgatataggtatattccaagtgttgatgggcagcttggggtttatttactttttagacttataaattgggagaaattaggactaagggaaatgattttttctaaggacatgaacatttataaaagacaaggaaaaagtatgacggaagaaatatgtggatgtaattgccaagaaaggagttcatcagtgatgggtaaatggtcaagaaaaaatggacagtgtgatctctgtgtgatcctgttaatatatattgtgccagccattttcctatttcagccaccaagtgatgcagtttacccagggtctgggttccagtcctcattgagaggaaccatggttaagaagaaagtgaacttacaaccaggagtttatatgttctcccacatttacccttcggatggtatctaatcattttctcctctaaatgaaatgtattacattctcttgtggctgatttctctagtacttatcttatatattcttaaacttacctttatgtaaatgtgctcaatcaattttagtaagacttaaacttcctgagctctaccttttaacagcatcctagactgagagttagtctcaaaagtcaagttctacaaaagaatcctttatgctgtttaacttaatatgttgtagtgttgtgacttctctacctttcagtgtttcttgattaggattcttcaaggtatttcttttgtttttaatcttaaaaaaattaacatgtcaaataagagaataaatagtacctggcctttattagaatcttattttccataatgttttaaatattttcatatcctatgagatatgaagggaagagttatcaaacaataaacttttgaacaccaactatcagccttttactacaccatgaggcttaataatagtaaatagtagttggtttttattgagtgcttattaaataccaggcacagtggtaaacattttatcttatatatattcattttatcctgacaacaatcccaagagataggtggtgttatcttcgctttatggatatatgtaaaccaaggctcagagagttgtaagccacttgcccagggttaccaggctattgagtggtaaagctaggagtctaaggaagttcaactccaaagtccgaactgtgtagctaccttgctataattgtagatggtccctgccatttgggaacttggtttaacagaggaagtaaacacggaaataataaattgaatgatttccctttcttagtttggccatagttgttatgatcatttcataataatcatttctataaatgtaagttggcacatatgaagcacctttggtatgatgtcagaatatcatttttgaagtagtgaactaaaatggcatatcaagtgacccaaaatgtcatgaagctttttggaaacattcactctacgaaatttattgaacaattattatggtccagggtcttctgggcccagagggtacagttgtgaataatatagaagctgtcctttctgtcatggaacttgcaagttagagagggagagacaggttaaataattctacaaacaattgtttaaaattcaatggtggtgagtgctgtgaaggaagccatggaagtgctgcaacagtataaaaagggaactgaacctacttcaagagtaagaatcaagggagtgattcaccttgagtagagctgtctttcaaactccataacatactttaatattttatcagtgagtcttgtaattcttgatcgttattctttctactagtatactgcagtcttgtgctttgtgagcaccaaggggaagagagcttaacttggtctgaggggaaatgaaaacaattcttagatacttaagctaaatcttgaagggacagtagagaggaattagaccaggggaagtatattctaggcagaggaaacagtttgtacaaagtttacacaaaggcattgggggcagatgagaacataatcctttaaagataattatggttagtatagctggatgcggtgtgtgtctagatggtattgagagatgaggctggaaagatagatagaaaatgtgaaatatttatgtaaccaaatctggtttctgtagagttggtctattaacttttccccatatttcagaggatctaagagatatgagattttcttttctcccccatattttaattgttagcattgttaaataaagtgtaaggattggcctaaatagatgtatagtgagatatcttatagttttaaaatgtatgtaatgcagtaattttaagggttgcagtcagatacccaaagcaaggcaattaattagtgaaatacatttggatctcctggctagactgaggcttgagtgttgtagaaatacatattactgcatgtgtataagattgggtctgcctgaagagaaggtttaagtgtggtgttccaggtatattccaatggtgaggcagaatattttgttaatgatcaaaggagaaataagagatcaagtgggaggaaattattaacagtgaaagcaacatgggcagtttgatgtagagcactgagaactatgtaggagacacatggcttgcatctgagctggcctctaccactgaccataggcaagtctctgggtattttggaatctgaatccaaacttcctattgaagtataacatggcatacagaagagtatataaattataagtatgtagcttgatgagcttttacaaactgaacacattcctgtaacagcacccaagtcaagaaactagaatgttaccagaagccctctttgtgctacctgtacttccatttgtttaatctttaaaataggggtaataatgtcttcttcacttttagaagtgctgagaaaatgacaacttgagaagtgccttgatctctctcagtgttgttatacaagtgaaatgagatgctaggaagtaggaccagcttccaaaattgtagaagtacatagagcttacttatagtattattagtaaacctattaaattggggatgcataaggagataactctgaaaaccacaaagcaaaggacaaaacagttgtctaaaatgaatcataaggatgcatgggcatagtatatgtgatgtcttttgttcttataaggtgtcattcttgggattcaggagagcaacttgtgtatttttacctgttcaaaaaatgtgaaactattctcattatttgaggatgctggagaaatggtagcttcctgaaataaaagtaagttctgttttaaaaatagccataagtcttgaattcaccaaatatttctgtttgggtttcaggaggtctgatgctgagtctctttttgttaatctgaatgcttacgaatacttttagaatgggaagtcctccttcatgttcttaatgccattagctaaattgatttttttcaaagtaacaaagtcatcataaatgaaattacatacattagtccccacttatccaaggttttgctttccatggtttgttacgtgtggtcaacagtagttcataaatattacagtagttcaaaaataaagtattttgagaggggggagccacatttttgtaacttattatagtatattgttgtaattattctattttattattagttgttagtctcttactgcacctaatttataaaataaactttgtcataggtatgtatgtatgtatcagaaaaatcatagtatatatgggatttggtgctatccacagtttcaggcatccactgggggtcttggcatgtatcccacgtggataagggtaggggactgctgtactcttgtagtactttttgaaaaagtttcaattttgtttagtgtaataacagattgatgcataccatttcttacacgacactagctgtagtcaccacaataatctgcatttttctatcaggcctatttgctttccaattctccatcatctccctgtacaggtatcttattagatccccttaagatctattctgtcctttacctgtatacagtgaactaagacttttaatttctataaggtaagatcattttattagcatatttttgtctttgatatataaaattatctctgctgagctcaaaagtttagtaaattttttgattgataatttaagaaagtctttaacataggcagtacagttataagggatagacaaatagagcagctttatttataataaacatttggctcttttgcaggatttccagattttaagatacactgaacccagtttatagccttttatccctcacgcccccgacctttccctcccaccagtccccaaagtccattgtatcattcttagaaacattctaagaacttcatgttacagttctgaaaactgttacatttacacttgttgtatttctgaagactttgttacatgtgagttacaggtgaatgaatttgagggaaaaactgacaaaactcagcttgaaaaggaacccacagtgatttctctacaagggtattttttgaatttgtgaataatttattggcagcttgctttgcaaaaaatacacaaaaacctatggaaataaaattttaaaaaaaaagtcaggaaagactgcaaaaaccatgaccttgcacaaaggccattgcaaccgtatacaaaaaaaagaacacttctgttgaggacatctgcccagccttggactggcatcacccttattattgatccttgaagccaaggacaatgacctaaaaacaattatgtaatcttcctcattttatctttgaaaacctttgtcttcctttacttccctaaatacacacatagtttactgtggcacacatattttcattgcaatgccctattcccaaataaataccattttctgtttttttttttttaagaatattttgtgctattatgtgattgatgttggttagtgctattagtgaagaagttggtgctttaaaattgaagcaccagagtctacttatttcgcttaaaacacgtgctaatttttaaaacatatcttcacacctcatgaaaataagaggcattgtgtttaaaatgtatttttttttgtttctttcccattaaaaatttaattgtggtaaaattatataacataaaatttgccattttcaccatttataggtgtacaatttagcggcattcattgcatttacaatgttgtgtagccatcaccactatgtctatacctttgtgctatattaccctacgtagatattatgggaagaaggaaaaattcttcccataatatctacaatggtatagaattgttaaatgatttcttaagatagttttattattttagatctggattaagaaaatcctttggtaaatgttatagttggatctgattggccagaattcaaaccagcaagtaccttattcaatagctgcttttgtaggcacaggtattccagtaccacagggtaatgagtatttcaaacaaaagagggttagagatatgtctaatgtttattgccataccctcaccctctgggctttgatctttctggtggtcttaagttactactatagatttcttccttgctcataatatctatttggcaatgggactgaaatctggtaacttctattgggaacaaaccattcctctccactgtggaaatggctgttgtctcataagtattctccctcctgctcccgactgttaatactaaatctttgggtaaataaagttactcatctgtacaaagagattggagaccagtctaattcccctatttgaaggaagccccagagagttggaactaatagttaagtgatgcatttagaattagaacacacctgttccaatctccaatcagggaagttgattgtcttgtggtggttgaagaaacagagagggacggggtcagcagaaaaacctatgaataaacctccagtgccttatggtttttcctgaagtcagaatttagagcttgacaaaatgaaagtatttatctagttctaacccactctattaaaaatgaggaaactggcgcagagtgactgtaacttaaaaatatataaccagttagttgcaaagctagaactggacacccgtatgtcttgacttttgccctagtgccaaatatatgagagtgtgactctggccctgcctctaatagtttatttgcctacaagatatttagtggaattgtcagtgccacattactgtagaattatttcaaaagaaatatttttgatattctggttttgtatccccttctaaccaattaggaacaagatatttttagtgccagttaatagtgcagtctttcagcagaaaggaatctaaatcaatatgcagtgttaaattcactttaataaatgtgaaaattgtttttaaagtaaccattgattataaagagagatgctttctatacattttggtgggtacatatacagtatttttctcatataagtgaatacttactatatactattttttaaaagcctaaagtcctacagaacataaacatataaggcaactgaaatctgtacaccttctcaatatataaaataagtgaatatttgcttctaatgaaagagataaagattagataacttcaacaggggaccttggcatatgtctgataatagatatgagacagggatagcatattgattaaaaaagtcatggactttggatctggaatttttaggacccggattctcactgaaccagttacttgatctggggctatagccaagttatttaacttctctgaaactcgatttccttatctgtaaaatggggataaatatgctaccttagagagttatgagaattaagtgagttaataccagtacctcttagaaaaatgactggcatatagtaagtactcaatagctgtaataataataataatataccaatacatactaatactaataaagtatctgttactaataattttatcattgctactgttgctcttgttggaagattatggtaaaggtgacatgtgaacagataatccttttatgcttctatggtaagtataggactttttacctgtggatgcttttgactacttggatttaaatacaaatattttaatcataattaaacaactattaatgaaattttttgttaagaaaatatttcccagtccagatggttccactaagccagctccttgatcagttttctgtaccatgcagttaaactattttttccattttcatgtttatgttcctgaaagtatattcattgggattacttttttctgtttaaatactaaaaccaggctttttaaagtatcaaattgtattaatcatggtttccactattttaagtcttcttttgtactggtattgaagtacattttttttttcttcatcattatacactaatgtactaaccaatatagcttttttaaagaagcattgttacacctccctgattatgcttcatttaaaatgcagtcccctacagtcctctccaccaatccccacccccaacctttatattgttcttaacatcactttcttcaataactctggagtgagggagcataaacagtaggttatgggtgaaagtgaaatggccccatagtgctgtttctgatgactagaagagtagcatggctgagtcttgcagtacaccaagatgttctgcatgagaggataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgctaactggactgatcactacaactgtctttattttctgatgattataatgcattttatctactagagttgaggttttagctgagtgatcactttcaaaaagaatgattagtcttgatcaatagtgtattacctatagatgagacttttagcataatgcaatttccttagctggtgttgagatccatttcatctgttcaggaaatgaaagcaggagatatatagtactttggattgtttgtattgcagattagctaaatatttgtgggaaatcagaggtctaaaacatgcttaaaattctagtctgatatctggataaagaaaatgcagtacatatacaccatagaatactatgcagccataaaaaggaacaagatcatgtcatttgcagggtcatgggtggaagccattatcctcagcaaactaatacacgaacagaagaccaaacactgcatgttcttacatataagtgggagctaaacaatgagaacatatgcacatggaggggaacaacacacactcgggcctgtagcaggggagggagagcattaggaaaagtagctaatgcatgctggacttaatacctaggtgatgggttgataggtgcaacaaaccaccatggcacacgtttacctatgtagctaacctgcacgtcctacacatgtaccccagaacttaaaatttttaaaaaaaaatctagtctgttatatggtagtaacagactattagattggtgcaaaagcaattgtggtttttgccattaaaagtaatagcaaaaactggctgggcatggtggctcacgcctgtaatcccagcaattttggaggccaaggtgggcagattgtctgagctcaggagttcgaaaccagcctgggcaacatgctgaaaccccgtctctactaaaatacaaaaaattagctgggcgtggtggtgtgcgcctatagacccagccactcaggaggctgaggcaggaagaattgcttgaacccaggaggcggaggttgcagtgagccgagatcgtgccactgcactccagccttggcaacagagcgagactctgtctccaaaaaaaaaaaaaaaaaaaaaggaacaacaaaaactgcaattacttttgcactaacctaatacaatctcattaagcacagtaactctgcattgtgtattgtagaagcaccagaattttcttacaaatgaaatgataatggctttttgatgtgttccctagaaagaattgtggtccatcatcttttcagtagatatactttttgttatttagtgctttaggtgttatttgctaatattacagccaaaataaaataggaatgtgcagtggaactcatttcttctctgttatagctggctctttgaaagttgtttgaggaaactctaattacctacagccctgcaatgaattgcacaacagatgtactgttttaaagtcttgattcttgcatgcatttttcaccttttacttcagttttagtctttgatttggaacacttaatgttaagcagtataaatgtgtctttctaggtgacataattggattctctctctctctctcttttttttttttttttttttttttgtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgaaattttgcattttaggtaatattcaaatgacatcatttcagtccttttgtttgttattacttctgacaaaagcacttttctgtaagcttttcatttattttactcttcagctatgaagtatttgattatatgaggacacaggaagaaataaggagtagcccatggccccagctaatgtgttagacatcttatacaggattagtgctagattagttccatgaggtgatttgaactgtcaaggtcatcaaaaacaaggtaagtctgagaaactgtcacagccaagaggagctgaaggagaatgatgactaaatgtaatctggtatgctggatgggatcctggagcagaaaaagggcatttaggtaaaaactaaggaaatccaaataaagaatggacttgagttaatgctgatgtatcaatattggtccattaattattacaagtgtaccattctaatggaagatgttagtaataggggaactggattcagggtatatggaagtctctgtactatctttgtaatttttttgataatccaaaactattctgaaaaataaagtttattcttttaaaagaacagcatcataagaggtgatctttctgtttagatgacctcttggtagtaaggtataagataactgtttaataaaagcacaaggagcataggtaggggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatactttcctggacttttgtagtgctattgttttagtttgttctatttctttttaaggttaccttctgtttatggcaagtgatactgtttcctgttaatgaaagtggtataataaaaaaaaattacctaagtaaagagagtcaacttaaaggagatttcctgaagaaagagattcagattatgagaagaaattggtatgagagagattctccattgctggcttgaagatggaaagggttgtggcacaaactgagtggcccctggctgatagccaacaaggaaatggaccttcagtcctacagctgccaacaacttgaatgaggttggaagtggattcttccctacaacctgtagataagagcccagcccaagtaacttcttgatttcagcattgtgagaccctacgcaaacaacctagctgagacacctggactcctgacctacagaaactgttagataataaatgtgtgttttaagccggtaaatttgtagtgatttgttgtgcaacagtaaaaaactaatacagcctataggctttgttcttactgctcttcaaacagagaccatgccctcctccaccaccaccaccagttcccctaacactgtgtctcagttcttttagtggttacccttaaaatagcaacatgtattatatacttaccaagtataatattagtcagtctcattagccttatctcagccaatgcaaggatcttaggacattttaactttattccttcctgatttacatgttaatgtctatcatatattttaattctttctgtacttgaaaactcagcaagacattattattacttacatagtcagtttacttaggttcattcacatatttatgttttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggtacatcatcattctgttgtcttctgatttctattgtccactgtcaaactgtcacttctttggagatactctgtccttttattacctctggttattttcaggtttttgctttgtctttatttttctgtagtgtgtctaggtataaatttcttttgtttatcctgccatgattcagtggaatcttgaatttgtagatagacacatctgatgaaaattctataaaaagatcctatgaaaaattctcagccatttcctcatagattttctctaactcattctctctttcctctcctgctgggaccccagttgacatacattaaatcttctcattattttatctaagtttcttaccctaattctgtgtttttcacctttttgtttttctccatggtgtattctggatcatttattttgacctatatttctcttcattaattttattcagctttcagttcctctgaaacccatccattgagttttaaattttggcttttttttttttttttttttttttgagacagagtcttacttcatcacccaggctggaatgcagtggcgtgatctcggctcactgcaacctctgcctcccgggttcaagcaattcctgtacctcagcctcctgagtaactgggagtacaggcgcgcgccactgcacccagctaatttttatattttcagtagaggcatggattcaccatgttggccaggctggtctcgaactcctgacttcaagttatcaacctaccttggcctcccagatcgctgggattgcaggcgtgagtcactgctcccagcctgtattttttgtttgtttcaatacctcatgtattttgtcttttatttttgctaattctaagatacggtatcttttcttgagagcatctgcctaccaggtttaggggataggacagctcatggccaggactgctttaatccaactttaagatttaaaattccatggaccaccagataaaagagagccaggctccaagtccatgcgaggccaggtttgttttgggttcacctccaccctaggcgtagcctttcagaacaaaacagaataaggtggaggttggtttatcaaatggactgtaggtattcactcactcattcattcctatgaggccctatgagtcctatggggcagttgcttcccaggggtggagaattaccctccaggcaaaagtagttttatgtgattgaactcactactgtgagttccctttttctcctagatcatcaactggcaaaatttaagtaccttataagatatttgatactttcaaaaaatgatggagaggggaaggttttattttgtttttcagtaggaaggctagtgtaggttatctatttcatgatcattggaagcagaactttctctggcttcttccttgtttctttgttttggtagtgaaagggtacccttttggtatggcagacatgatactttttaggggagaagtaatgaagaagtacttgtacaatagcagatgagccccagaagaagtctcctgttgttcgtatgcgccagacacaaccctttatgccttgttatttcctgtactgctgagaaccctctaaagtagctattatctccatttcacagtataaataaagtagccccagagagattgaataactggcctctcattatagttagtaatgagtaatgggcacatccaggatgcagccccaggtcttttgagctatcaagcccttgctctgtttatgttgtggtggctttgattcaaagaggaaaaagttaaagtctatcaggggctaaagtgcattctctcaaggggactttcccataattatggggtgtttgcagctggagtgtctgtacgtccaggttgcctgggcttgccaaaaggaagttgtaagttcattgtaaaatattaatgtgcagggattcttggttaatagaataaattattttttctttaaaaagttcaatggtctctcagtggagctgcctaaaaaaattcatgttaaaacatcttgttcttttacatgatctcaagccatctgtttgcatctatgatagatattcttcatgcttcattccctatttcttccctactggttgatataaagtaaaggattccattaaaggacagggcatagtaattgcatatgtcttgatttttaatgaattgataaacagtcattggccaaaatgtttctaattttatgatctcatcctgtgtctatttactggtttaaatttgtgctcaaaattgtcagtcttcagtccagcattaattaggaaccatgaagttttctttgtcatctgagtcttaattgagtttatatacctctaacttcacaaaaaggtgatcatgtggataatataagtagtttatttccatttaatgatattttctggtggtaagctattatagtgattgagtgtcatatttcatcttgccagatcatacaaactgaaatttttaagcaaactattaaaacatccaaaccaacaaaaagcttgaatgaattctgagctaatcattgtcacagctgattttgtaaacctttaggttgaaaagctttctgaattttaggagctatgtttggttcagttctctgctattacaaaatactattttgtaaaatgcctcaagtttataaggcctattttaaatcattaaagtatttaagaacagatgttattacatggtaaaagttaaaaagtctgctttctgagtcttagttatggtatcactggaaggattttgaattagcaatcaatgtctctagtaaaacaattatttttgaagatgtgtttaaaaaatagttaacatgttatatgattttacagcttttgtttacctttcagtaattggcattgacaaattaacatttttatttgtattagataagtgaaaatctcccccaaggtatcagagagctatagcttcaaattaacttaaatgtaactatgctaatgtaagtgtctggaagatggcacccatgtttgtgcatcctaaaatggatttatctatttgtccatccagtagcatttactgggtcttcattagcacagtgtcaggcacagttctatatgttagagactcaggatggataagagaaaattcctgccttcagagaactagtttagtcaactggtaggtcctttattaagagctgaccttcagttatgcataaccgtgtttgtgtagaatactgtaacccctaactttcctatttgtgtaatatggaaggccaagtgatgaaattgttattaaaaacaccaattcccaaacagtgtgccatgattttaatatgctaaatagactgtggcaatgttagatttcctttttgactcaggaagactgtgagggtgagtgagtgagtgagtgaggatgtatatgtgtgtgcatgaggagacaacagagcagaacccctagtctagtatgctttggttagttggtattcatcaaaccccaaaagattgagaaacatcgttgtttgagaccctaaaattctaaggtagagtgaggaatcatggaagactacattatggacctgatgagtttaatgcctgccatttttaactgagtatgttgatcataaaagaactgtagcttgtactctcattttaaatagactggactccttctgtaatagggattgtcaacaacaacaataaaaagaatggactcctaatgctagccagaataaaataggttgaaaatgcacagatttccatttccagaacaaaaaggcgtagacttacttttcactgccccttccttcctctataaatataactaaatgtcctggaaattattcaactgacagcaataaagggattctgaaagttgggaagaaagcagagtagcttggaacctcaggactagaagtttgaggacaatgagtataagttcactgggttttcttttaatctcccattttctcctagactgggtgctggagagacctacaacccagaatcaccagtgggcaaagaaagcagaacaaaaagcctgctttctctggctagaagaccaggaaagggaaagcccaacaaagacctaagtgggagtgctcatccccactgtttcacagtgggtcccggtgggcactctgatctgtccccattatggccccagttgctgcgggagcagcaaagcccctggccctcccacccactgctctacaactggggccatgacgggtggtttgttctgccaactacggtgaagaccagaccatttcagcccctgtggtctgctctgtagacagcagcagcaacagcaaagcccaggctatactgcctctgctcccaactggccccagcaggtggtctcttctgtagggagcagtaagcagctgcagccgcagcgaagccatgtgtcttcctgccctccacctcatggcttaaggagacccaggccccagtaggtgaccccctccccctcaaggtttcccagcaatagcaagtggccctgggaagtaccttttatccctgcagatggcatcagcagggattgagtgggagtcccaacatcaccagaagaatgaagcacaccaaaatagcattgtgagggctcagaaaactaaactgtcattggaactgaagcccacaaaagtagtctagaacctacacactaaacctaagcagggtgaccaccctgctaaaatagaagatcctgtcatcaagtcttctaacaataagcaaaacatccagggtacaattgaaaaccacttgtcatagcaagcaccacaaaatatctaggatacaatatgaatgaaaaaagacatcaactgatgccaatacccagttgaatcagatatgggaatttgataaggtttttaattcagctgtcatgcaatttatccaacagtcagttgcaaattttcttgaaacaaatgaaaagatagaagatctcaggaaagtagagccaagagcatttcctaatgaactggaatgtcagagaaaaaaaaagggtcaagaatggtgccataatttttggctaagctatcagaaggaaatacggagttgccttcaactgagatagcaagaggagagattagaaagctcagttcactcagatgttttgggggatctgattgccctttctcttgtcttccatgctctcttgtgtgccttattgattagcaggagtcattacggagactgagaggttggtccatccatgggaaactcgttaaaagtgagcattactaacttgcatactcacatgcagggagtttggtttcttacctaacttgaaaaattccccaagtgtttagatgtttgattttactatgtcgcctaaacagttacatccactatactcttattttcaaattttttcccctaaagcaattattttccagatcatctactttatgtctttagacctagaaactgattactacaattatgattcaaaacctattttctgctgccctgcactgagctgagtaattgggtgtaaatggttatttcgtttgcatgctttgcctttgtgttaagtgttttttggttaaaagaccagaggttgcattattgcctgctgaatatgcttatattaacaattgtaaaaaagtaaattacttttgggagtattaatgaataggcacttaaattgcatagttaaatcttttccatcctttactaagcaaacaattggattaccccccataagaatttaattgacaatttccatgccacatttgggtagggaatatttcttacagacaaaagttgtttgaaatcagaaggttcttagccatttcaatttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaagaggagtgttcctgtttagggcagaccctgctaggccttcctgtttgttatctccacaagatattgtaccttaagagcttgcctttagcactttttctttttcctttctgggcttcttacagtctttctatggggatgtttccagcagccccttggggaggggtttggggatatattcatgttttctggggctctgtcctctgtatcctgaagtgctgtcattagcagcaatggcttcaattacctctcattcactcatgctacctagggagtatagaggttaagaatttagatttcaaagttccatatgtttaggctccagtcctagctctaacatccactaactgtttgaccacagacaacctcttagcctcagtttcctaatctataaaatgaggctgatattatattagctatgatgacaaataaattatgataaataacaagaatctatgtaaacttcttagcagcatgcttgctgctgacatgttatattataaatgacagttgttgatgtcttcattatcatgacccgttccttgaactttatactcctatctatatgccctctataaatctctgcctggatattccatggaaaccaatattttccaaacatagccatgtgcttcgtttctttctcagccttctatcagttctttctcttgtaattcctttctcatttggtggtatcattcacccagtaactgttgccagaaatttgtaagttttcttacaactcaaccccaaccaccatctagctaatcattcactgtgttatcttgtgaatttattttcttaagtatctctctgtcgcctttactttatcacctcttgcttgggctaatgcaataacttcctgagtggctcccacccactccacaacgtctctcactctctgtcatagtgatctttggtccccttttccttttccagccacttctcaccctccagtttttcatgctagcagtaccaaatagcttgaagtgcccagcacacacttttttttttttttttttttttttctgagacagagccttgctctgttgcccaggctggagtgcagtggcatgatctctgctcactgcaacctccgccttctgggttcaagcagttcccctgccttagcctcccaagtagccgggattacaggcatgcaccaccatgcctggctaatttttgtatttttagtagagacagggtttcaccatgttggccaggctggtctcgaactcctggcctcaagtaatctgcccgccttggcctctcaaagtgctggagttacaggcatgagccactgcaccctgccagggcccaaaacaccatgccctgtgttttgacttggctgtaggccattgcacaggctattacttacctctggaatcctctcctttccctgcttagcccaacaaactcctattcattgtttcaagccctccaggatgtccgtgtgtcatagaggccttctctcagtaccatgctatccacagatttttaaaactcatagtgttatactatttctatactttataactttacactaacattatatataacgtatgtatacatacataatgtatatatgtatgtgtataatgtatatatacatatgtatacatacatatatagtatatatagtatatatacatataatgtatatatactatatattatatattatactatatatactgtatgtatattatactatatattatatgtatatattgtatgtatatatacatatatacaatatatacattatatatacatatatacatgtaatatatatacattatatatgtgtatatatacatgtaatatatatacattatatatgtgtatatatacacgcacacacatatgtcaacagcagcctactagattggaagttccctgaggacaagaattgctttattaatctttttcttgtttattctttatattctttgtcttattttcattggggaaatgaggtaaataagataaaatgtgcaaatgtcaatagaatttttaaaatcttagtgctttaatatttatttttgatttagctaagattgcctaaagtgtgtaaccaagtcagaattctcacttttgtaaggtttatcttcatatgttttcttgcttgtttctttccatgcatgtctaatctccttcttcacatttcttatgttataaaaatcttttttcttctctattaatagttcttgatatatcctccatcaagtgtgagctaacaaagacctagaatcgatgtccctctacattggctctaaccccagcccttctcacacacgcatgcacacgcacacacgcacacaaacacacacacacaccaatcaaattttccagaacctttgctttgagcagaaattgccttatgtgactggcagtcctctcataaaagtagtaaatgatgagtgtattatagttagactcagaccagaagatggtgtgctacatgaaatctaaagtgaagtctactaaacttcactgaagtatcaaggtgtgacagaggtactaattatgtcaatataagtactgagttagtaaatgctagtcttaactctgaattgttcagctttgacaggtgagctagatttgttccattagcttattggagattcattgctagctgtttcaaataaacctcccccttctattttcaaggaatgatctgaatcatactcctttgtcaagtctttaattgttaacatttaggcaacagttcctgagacttttattttaataattttccactccgtgtgtgttttttgcggtagcaatgagtaggaaaacttttttttctttggtttaatcactgtacctaaagcaactcagcttggtgaatgtatgtaagcatatgtgttggagctggggatgggtaccagaagtgttaaaaagtgtcaggacagcatctctgttcccttactgctatcacattgattaccgcgataatcattgtcacagctgattttgtaaacctttaggttgaaaagctttcacaaagctatcacaaagcacaggaagacaaggaaaggatttattgatgaaattatatgcataagctcttctttagtggcaatgactacactaaatagtgttgaaatagggaacagaccatcgttatctttaatcggtagagtttttatataaatttatatatgtctataattttcaagattttattcttactgctaatgttgtcatttatagttattttattttagctttgtttcctttttgcctacccaccatctatgtccctcaattcttaacgtcagaactgtataaaaagtagtaggaagacacagatttagaaaatgggtagagaaatatctagaagcaccatgatttctcaaaattttatgtacttacataaaattgcgttacttaataaatgtatcaatggcttattcatttctagtttgtcatttttcttatatcattcaccagatattttttgagggcctaatgtgtactgggtactcattaagtttatattttaatatgaatacacacacataaatataacattacatattataagtatatatgaaataatataaatacatgtatgtgtgtatatatgtgaatacacacagtttattctcattattcatggtagttgtgttctataaagttaccatgaatgctgaatgaaccaatactgaaccattgctcctaggggaagtacaaggttgggttccttcaaacctctggtcacaacattttcatcaaccgatcaatacataaccttgttttatgtgtgcttctgtttaaagatactgcatgtaatatatactgttgattcattaacattgaactcacagccaacattgttataactcatgcctgaaggaagcttccctaactcacgtattttccccataaggcacatcacagccttcttgtgcttaggaacactagacagtcccttcagcactatgcttggtgaccatattaaacagcaaaatcaccaagaaaaagcgcaaaatgcaaaaaaatgctctaaatagactttgaaaagatgacttgttgatggcatgagagctgaaacaagaaggcagagcatcatcttgtttgccctcagctggcatcatgcacattgggtgattcaaatttttcaccattacatgcgtgcctgtaaacgactgaaagtgccatgactgttgatttgggggttataagtgaattttaccaagtaggcgaatttacagacatgcactctgcaatgtaatgaggatcagctgtatatcaactttgtgtgtgtgtgttgtgtatatatgtgtgtaaaaatttgttcttggccttcactttccccatctttgtcttttcttttttaaatcattcacggttttcctacgtatcttgtggtacattgcacaattcattataaatgtaatggggcttctaggcctgttgttatggacagaaatttcattgcgtttattaaaggtttcctgagacatgatgtgtttttgtttatagacctctcatagggtgaaaatttaacatgtaactccaaagtttatatgtagcaactcaaagtattattttaaatttattacaattagatataaaattacaactgacaattcatattgactttattatgtttgagatgcagtgtttttttgaagtgccttcaaaagccctttgtgctcctccccaatcacaaccccctccccctcaaaccactatcctgccttttatattaatctttttaaattctctttatagctttaccccctatgtttgtatctctaaggagtatattgtttaatcttttagaactgagtagcaaacacaaacttagctgggtaaagaaaggacaatattactactattgtatgaagacttaggagaagagaagctgaacaagctcttgttcatagtctggcttcagatgttctgagagtggttaggagcccattctgggaagtcggttggcaaggtcatgcacaaataaatcccgagacaaggggctcttcacaggcaggacatttccgctgtagtgcaggatagggggaggtactgagcacccagcaggaatttggtggggggcactggctgccctgcatttcctgctcttcagctccctgatgcctgcctcccattctcaggaataggtcaaagcaggcactgctgtagggtgaaattaagagtcctctgctagtctaggcagcagagaaggacagaaatctcctcagccaattgtcaggaaaagaaaaacagaagaatctggatgcagctcacctacctattctgttttcaggttaaaaaggtggcccgtggcagtggaaaactgatggctctcagtctggattggttgtcctctgtgcctgaggcacagctgtcagcctgagatttcccttccttgcattcctggggattcccttcatctctcttctgtgttggatctcctatttgctgtctccaggcatgctttttattggtctattcttgttttagcaaacacgtcctacaataatttcttcagaaagtgtgcatggcaagtaatttattgaccttttttgtctgaaaatgtccttatggttaatgatggtctggctggatgttgaattcaagattagaaatcattttccttcatgattatgatggtgttgctctattgtcttctagcgttggcattgagagatccaaagctattctgggtgaattgtgtcatccttcctcgctgcacatctttacccccacttctggaaacctgacaatctccttgtccacagtgattttaaatttcacagcagtgtgtgtatggacatgggtcatttattttgctgagtacttggtgggtccttttaatttgagctccttatgatttaaattctgggaagttttcttggattattcccttaatttcttccccttcattttctttgttatttatgctctgcttttcccaaattatcggccaacgcttctattgataaatttctctgtgtgtttttcaagggctcttttgttttctgaaagttctggtttttgtttcacaattgtgatatctttctgaggatattaatggtaatttgaagtcttattgtgtagtgtgtttcctctaagttgctctttttgtttgtttttggttctatcttccaaattagagactcttcagatgtcttaggagccttggttgttgtatacttatgattagaaatagagcaatgattctcaactgggggcaatttgaaccttccgtaccccaggaggatatttggcaatatctggaggactttttggtggttaaagctgcagggggtgctatgctactagtatctagtaagtagaggctagggatgttgctgaacatcctacaatgcataggacatccctgcacaacaaaaaattatctagctcaaaatgttaatagtgctgatattggaaaccctataatagagggcctcaaagctgattaagagagctccgaaggtgcaggtggaacgtgttgactttgggttttgctggaggatgatctagttgagtagtttggagaacctcttcattatctttaggtcttttcttctgagctagtcagatattcaatagaaaagtctttcatctcctgccttaagggtaaagatctggcttccaatattccccctgttagtcaaaaagggactcgggctgtctgcgttcagtgtatatgtgaccacataatacccttgcttttcatataatacccacttcctcaacagccttgtgtttccagttgtgagaccctacagtttggttttttttttttttttttgagacggagtcttgctctgtcacccaggctggagtgcagtggtgcgatcttggctcactgcaagttccgcctcccgggttcataccattctcctgcctcagcctcctgagtagctgggactacaggcgcccgccaccaagcccagctactttttttcagagaccctatgttttatttactctttccagataattaacctgttgggatgagggagcggcagttatccatggtatggagtacaggagaccacctagggctctaactgcttctctaacacatttcattcaaaccttgttactttaactctaccctctcttcacttccagttccagagttatctggaacccattcatgagtttcttggggattctacagtatagatgggtttggttctgaactttccttattatctctttgcagttcagcttttccaggtctgccaagtcaattaccactctccatctgctttcttggattccaaatttaattattactattatctcctctcttgtactcccaatcctttttaaaaacccctttggtatcattgtagtggagtttggatagggaaataaattagatacattgtgctcaatctatcccatgatcctggaaaccaacatgctgtattctagcataatttcatttaattctagtcttattttggtatatttacctttgttatcagaattatttcctagacttaggttttcttcacataaatgaaaactagaggatattagtctgtgtctgcatagggacataattgaattcttttcaaaaccttaggggatattgtagtgatatattcacttctaacatattctggtttaatttacctttttgcttaaaaacatagactgctgtaagcagccatctgcctcaagtagaaccttgttttaccatcccaatcaatattcagaatttgtaaagagttgaataaagaatatatatttcattaaatctgaaatgctgtcaattatctttttccatttttaatacggtcataattagtggaaatatgagaaagatagttgtttatgatgacggcttataactatctctaccagtattttcccccacataaatattcaagaattgactgtaccttagatttaaaattttaagggtgatttcaaacatcaataaaatgtacaggccagactgaaacctatacctcctgaatttttgctgttccctaaactgtcatccaagcataagtaataagtgtaatatagtaggtgtgttacactactttatcactcctccctttttaagatgggaaaccaagccaaattttaaattttttatcagtttctgctgagtttccagttaatgggttaaatcgcaaaaacctcaaaacgtattttagtatctttttagggtgttaaatttggtttaccattgttaaccccctggatgtcattgacggacagacccttaaaatgctttacttgtaacctgtcttcaggtcttcagtagttcatagatataattattttctttgcctcgtactataaaattaaagaattggggatttgatttgatttttattcacagatttttaaaagtttgtgttttgttgtctaagtattctcttttctccctagctctattaattttattgttactaaaagaaaaggggggagaagatatgctttcttcctcacctttgttcaagcaggaaaaagtaaagaattgactcgattgaccatgaacaatcaaccccacatacagatgttgggaagtttccaaaaagatacagtgaattgaagcagactattcaaatgtatcataaatagagtcccaagggtttatgtgtggacaaaaaccaattacatgaagcatttcctgaaattgcttgctattgtcaggataagtaatcagaagtaagacatccaggttgagaatgaaaacgtttgtccctcagtttgtaatattgtcttctcacagaggaaaatctttgaacagttttgagggattatcaaaaggatcctctttctgtagagttttgaaagatatattattaccatttcttttcctcccaggttagcttttttaggttgcttgaaaagagagatttgaagctgtggtatagttgatgtcctcatgatgtcatcttggataaatgtttaagtctaagattaaatttagtagttcgtcctgtagttgaaagaagaaaaactttaaggccagcagtatcacaagtgtagtactgtaaatgaagaacttttctctatctgctaattgagcacatgcatctaggtgtactgtttgtacctgtaataagcgaatgaaggtggtttttttgtttgtttgccttctccccaggagggggaaaatacacgcatgtatacatgtacacatgtatttaatgaccaccatattaaccttcaaataaaccaatcacattgctattgcattctgtattttatagtcaattcacacacacacaaatctatatttggattatcttaactgagttcagatatttcttttataactggtaaccacagggaaccgtgtgtgtgtgtgtgtgtgtgtgtgtgtgtgtgtgtgtgtgtgtgtgtgcgcgcgcccgcgcgcgcgcgcatgttccctggaccagggtatgggcatctttaaatcatctcagctgattcaactgtgaggtctgggtcagcaaatagctagaccagtggctgtgctcatagaaattacttcctttcctctagtaatttcaaacaattctaatttgaagtttgaggaaaattaaggatttctctgtgatttcaggtgaaactggagagggttggagaccaaaccacgcaggcctttctctttgtaaagtgtttgttcaagtcttttgcccagattttattggagtgtgttttttttcttattgtatttacaagttacttatatattttggttcttgacttggactgtatattgcaaatactttctctctctctggtgttttaaacagggatatcatatcagattttcattttttaaatatcattacaagaatgaatgggagaaacaagtttttcagtggttctagtagaagatggtaggatgtgggacatggagagaagaggacaggttcaagagatatttgagataaactcagtaggatttgttagtgatgattaggtaaatggtgggtaagatgagagggaagtgtcaagaatggcttgggtttctggttcataagaataccaccattactatggacttcacttattttgtttaagatgttgataatctatatagaattgtacagtcattatttgccttgagcataagactactatttagaatttttaaaaaattactgcaaattgcaaatttattggtcatttttatggttttggtaatcttttaaaattatctcatgaattatagaaaaatatgttggaagttatattacttaaattttattttgaaaactgtgttcaatttggagtctaaagtagaatggcaaacattatctatattatatagataatgaaacagtaagacattaatgggaaataggaacttaagagaatcaatgaattaaaattgactttttgttttataggggtcccttcagtgttgtacgacgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattgttataaataattaaaataaatattaatagcttctttttcaacccaaaattatcaataccagagttttgacttatctcattgttgtaccaaattctaaatctccccaggctaaagacattctttcgggaaacaattacttaccttctcattggctgaggttgtttattgacagatttcttcagccagatctcttgagctacagactcagaatgccaagctgaacctgtctcttgtcacttggtcagggagtcaaattccaaatttacaaaaggggaaagtacttagtatatagttcatatacctggtattaagtcctgtcttcatttaatataatatatgggagtctgttgctgaagttatagctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccctagccttatgggacctatgttttaatagtctccaaccattgtttataacatggtttttattaggaaaacaatgtgtaataaattcgaagtaaatcatttacaaattaattttttttgagatggggtctctctcttgcccaggccagagtgcagtggtgcaatcatggctcattgcagcctcgacctccttgggctcaggttatcctcccacctcagccgcctgaatagctgggactacaggcatgcgccaccacacacagctaattttttgtattttttgtagagatgaggttttgccatattgttcaggctgatctcaaactcctgagctcaagtgatctacccacctcggcctcccaaagtgttgggattacaggcatgagcctccactcccagcccacaaatttacttttgaaatgaaatgtgttgatttgttgcagaccacctgtacgttttaatattttaaattctcattgctctaatgaagatgagatattataattggtgaggctaaagatgagacatttcataacagatgagatatttttgaatatctgttctctacttttgccatcaaaatcataatttttattttatagggcttcttaacttgcaggttgccgactattcaataatcccttgaaatagtaagcagaattatgtttatttttttagagagtccatagctcttattagattcctaaaaaggcatattattcctaaatgatttagaatttctcctttcacatgtatgaaaaaatgaaattcatgcttatgaacatgagatgaataagaagtttctactaaatcaaaactggatgaatttatattaggatatgacttctgattgggggattttttatacttacatatacagcttccattaatgaatttcctagattattatcttgaacttttaattaatatactttttgtctcttactctactgagccactaatttagagtttttgtcttaaaaatagatatcaaaattaattcagacaaattataataaggaaactaaaggaaagtaagatgtatagaattggaaactaaattatcaaagttctgagttcttgataggactcaattctttatggtttattataaaagtccaaaattaactgtttttatttgggagtattataaattgtgttctagaaagagtatattttgggctccagtttgcttagtcttcaagaatgtctcattctaaagtcccagatagtaggtgatatcagtgaaattgaagaagtaaggaccttgacagttctcacttttcatttaaaaaaaagagaaaactgacagaaatgtcagaatcaactttttcagggctctggaaattgaccaaaggcttacagctatccaggaataatttattcaagaaaactgactgattcttagtaacaacagtgaacttcatagcattgtataataatttgtcccattcacatccccctttcttccagttctgtagtaaccttgaaaacaaacagttcacaatcacgatgaaaaccagcaacttgacagccatcaaaggaggctgaatggggatggagctcctctaaggccgcattcccataatattgtcatttttttacttgtctggtagttccctggaagacttgtcttagtacatttgtgtttctataaaggaatacctgagagtgggtaatttatgaagaaaagaggtttatttggctcatggttctacaggctgtacaagaagcatgacaccagcatctgcttctggtgagggcttcaggaaacttccagtcctggtggaaggggaaggggaaccagtgtgtacagagatcacctggcaagagaggaagcaagagagagatgggaggtactaggttgtttttaacaaccagttctcatgataactaacagagtgagaactcacttgttactgccaggatggcaccaaggcattcatgagggatccacccccctgactcagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggggataccatcaagcataccaacatatgcataatgagaatttcaaaaggaatggagagaaaggagtagaaagaatatttgaagaaataatagtccaaaacttcttaaatttgatgaaaacataaatctacacaaccaataagttcagcaaactccaagtaggataaatgcaaaaacaaaccataatcaagttgtcaaaagctacagacaaggggagtatcttgaaaatagcaagggagaactgaatcatcacatacaagggatctataaaaatattaacagcagatttctttcaaaaaccaaggatactgaaaggcaacaggataacattcaaagtgctgaaagaaaaataatatctaccaagaattctttatccagcaaaaccatacttcaaacatgtaggataaatgaagatattgtcagataaagaaaaacggatagaatttgtcactagcttccttgtcctacaaggaatactaaacgtagttatttatgctaaaaggaaaacttatttttttaatttttaatgtttatgggtacatagtaggtatatatatttataggtcacatgaaatattttgatacaggcatgcaatcacatcaggataaatgaggtattcatcacttcaaacatttaacctttgtgttacaaacaatccagttatattctttcagttattttaaaatgtacaattaaattattaaattatttttgactgtagtcatcctgttgtgctagcaaatactaggtcttattcattctttctattttttgtacccattaaccatccctactttccccaacccctactagccccccgcccccccaactaccctttccagcctctggtaaccactcttctacctgtatcctcctgacttcaattattttaatatttagctcctacaaataagttaaaacatgcaatgtttgtcttcttgtgcctggctcatctcatttaacataatgacctccagtcctatccatgttgttgcaaatgacaggatctcattcttccttatgactgaatagtaccccattgtgtatatgtaccacattttctttatctattcatctgttgatggacacttaggttgattccaagtcttggctattgtgaatagtgctgcagtaaacatgggagtgcagatacctcttcaatattctgatttcctttcttttgggtatatacctaggagtgggattgctggattgtatgatggctctatttttagttttttgaggaacctccaaactgttctccatagtagttgtactaatttacattctcaccaacagcgtacgagggttaccttttctctacatccttgccagcatttgtcactgcctaacttttagataaaagccattctaagcatagtaaaaggaagtgtagtaaaaggaatgacaagaaatcaaagtagaacaccataaaatatctatttaacacaaaaggaggcagtattggaggaatacaggaaaaaaaagacagatagaaaaccagtagtaaaattagaaacataaattgtaccttgtcagtaataatattaaatataaatgaattaaacactccaattacaaggcagagattggcaacatggatgaaaaacaggtgagatggtatctcatgtcgttttttgctgtctggaagagacatacttcagatttaaaaaatacatataagttgaaagtaaatgagtagaaaatgatatactatgcaaatagtaaccaaaagagctctgaagtggctattactaatatcagatgaaatagactttaataattaaatcagaaatttaatagtcaaacaaattgttactaaagaaggacattttataacaatagcagcattaatccatcaagaagatttagcaattataaacacatatgcacctaagaacaaagctccaaaatacatgaaacagaaaaaggcagaattggagggagaaatagagaattcagcaataataattggagacttcaatacctgacttaataatggattcaacaactaaacagaagatcattaaagaaagagaaggtagatttgggcaacactagaaaccaactagacctaacagacatctgtagaacactccactcaacaacaggagactatacattcttttcaagtacacatagaacattatctaggatagactgtgcattagcccatcaaatatgtctccatcaattttaaaatatctgaaatcatacaaagtatcttctctggccacaatggaatggaatcagaaatcaataacggaagcaaatttgggaaattcacaaagatgtggaaattaacatagtagccagtgggtcaaagaagaaattacaagaatactttaaaaatactctgagatgaatgaaaacaaaaatataacttaccaatatttatgagatgcagcaaaagcagtgattagggggaagtttattattgtaaatgcctatattgaaaagtaagaaagagctcaaatcaataatttaacctttcactttaagaaactggaaaagaaaactaaacttgacaggcagaaataaggaagtaataaggattataggagacatagagactagaaaaacaatggaagaagtcaataaaaccaaaagttgtttctttgaaaaggtaaaaataaaattgagtaggctttaaactgaccaataaaaagagacaactcaaagtaataaaatccataataaaggaagggacattactactgaccttataaaaatgaaaaggattataagagaatatgctgaaaaattgtatgccacttaattagatagcctagattaaatgagctaattcctagaaagaggcaaactaccaaaactgactcaagaagaaatagaagatctaagtaaacctgtaataagaaatagactgatatgtactcaaaattttcccataaagaaaagcccaggcccagatagcttaatggtgaattctactacatgtttatagaattcatataattccttcacacatatttctgaaaaataagagagggaacacttctcaactttttgtataaggcctgcaataccctgataccaaaaccagacaaagatattgtaagaaaggaccaatatcccttatgaatgtaaacacacacattctcaagaaaatactatcaaactgagtttagcaatttaaaaaatgttctgtagttcttcagaaagttaaatctaaggttatatgacccagccattttactcctagacatatgcctaagagaaatgaaacatatatccagataaaatcttgtatatgaatgttcatagcagcattattcataatagctggaagatagaacccaaatgtctaccaactgatgaatttataaactaaatatggtatatccatacaatggaatgattttttcaaccataaaaaggaatgacatactgatataagctacaacatgaatgaatcttgaatatattgtgctaagtgaaagaagcaagtcacacgagattacatatgttctattcatgtgaaatttccagaataggcaaatctatcagaaggaagtaaattagtggttgcccagggtatggagaaagatgagatggggagtgtctggtaatgggtatgggatttcttttcgaagtgattaaatgttcaaaatttgaacacagtaatggttgcatgactgtgaatatactaaaatccattaaattgtatactttgtggacaaattgtatgataagttaattgtacctgaataaggattttttaagtaccacgagtaagtagaattataacagaaattcaagcttgtttaaacatttaaaaatcaacgtcatacaccttattaatagaaaaatgaacaacagtccacatgatcatctcagcagacaaaaagcatttaacaaaattcaaccccctttcatgataaaaacactcaacaacctacaaatagaagggaatttctttaaccttttaaaagacatctaggaaaaaccaaagtctaactttatatttaatgttgtaagataatgctttcctccgaagatcaggaataagataagagtatctgttctcaacatgtttattcaacattgtactggaaattttagccaaggcagttatgcaagaaatagaaataaaagcatccagattgaaaaggaagacttaaaatgccctctattggcatataacattatcatgtatatatgaaaatccaaagaaattcacaaaaagacttagatgtaataagtgagcttagcaaggttgcaggatacaagataaatatacaaaaaccaattgtatttgtatacacaagcagtgaaaaatctaaaaatgaagttaagaaagcaattccatttaccacagcatcaaaaagaataaaatacttaggaagatatttaaccaaggaagtgcaaggctaataaatggaaaactatattgttgagaaaaattaaggaagtcctaagtaaatggtaagatctctcgtgtttgcctactagaagacttaatattaaagtgaaaatatttcccaaattgatctatagattcagtgctatctctatcaaaatccctactggcgctttttgcaaaaattgacaaactaatctaaaaatttacatggaaaagcaaggtaccccgagtagccttaacaatcctgaaaaacaatggacaaagttggagtactcacatttttcaacttcagaattttttttttttttttcctggagacagagtttcactcttgtcacccaggctggagtgcaatctcggctcactgcaaccttcgcctcctgggttcaagtgattcttgtgcctcagcctcccaagtatctgggattacaggtgtgtgccaccacacctggctattttttttgtattattagtagagatggggtttcaccatgttggccaggctggtcttaaactcctgacctcagatgatctgcccacctcgcctcccagggtgctgagattatagccatgagccactgcgcctggcccagaattttctataaagctacattaatacacatagtgtaaccctggcataaggatagacatatagattgatgaaattgaattaacaatccagtagtaaatccatatatttacagtcaaataattttcaactgtggtgccaagacagttcaatggagaaagaatagtttcttcaaaacagtggtattgggacaactggaggctgacatgcaaaagtttgaaggtggacctctaccctacaccatatacaaaaattaactcaaagtagatcaaagatctaaatgtatgagttaacaccatgcaattttaaaagaaaacataggcataaatctttgtgaccttggattaagtagtggtttcttcattattacacctaaagcacaagcaaccaaagaaaaaaatagataatgggattcatcataatttaaaatttttatgcttcagtagacactatcaagaaagtaaaaagaggctaggcgtggtggctcatgcccataagctcagtactttggaaggccaaggcatgcagatcacttgaggtcgagttcaagaccagcctggccaacatggcaaaaccctgtctctactaaaaatacaaaaattagccaggggtggtggtgcatgcctgtaatccaagcttcccagctactcaggaggctgagacatgagaatttcctgaactcaagaggcagaggttgcagtgagccaagatcatgccactgcagtccagcctgggtgacagagcgagactgtcccccccacccaaaaaaaaaaaaaaaacaaaaaggaaaaagataatacacagcattgggggaactatttgcaaatcatatatttgataatctagtatctcagatatacaaagaactcttgaaaatcaacaataaacaaaaacagataacctgattaaaatgataatggatttgaatagacatttcttcaaataatatttacaaatggtcaataaacacatgaaaagatattcagtgtcattggcttttaggaaaatggaaatccaaaccataatgagataccacttcacacctactaaaatggctgtagtaaaaaaacaaaacaaaaaacaacagcatgtgttggcaaggatttggagaatttggaaccatcataaattgctattgggaatacaaaatgatgtaaccgctgttgaaaagcttggcagttcctcaaaagttgaacttagagcaccctatgacctagcaattctcatcctaggtatatacccaaaagcattgaaaacatatgtacacacgaaaactggtacatgaatagtcattgcagcattatttgtagcaggcaaatgtggaaacaaaccaaatggtcatcaactgatgaatgggtaaacaaaacgaatattacatacaatagaagatttattgttcaaccttaaaaaggaattaaaggtatgcaaaactggttcaacatttgaaaatcaattaatgtaatccatcacgtcaacaagctaaagaagaaaaattatttgatcatattagtagatggagaaaaggcagttgacaaaatctaacaccctcaacttgataaagaagtctacaaaaaaaaccctacagctaacatcttacttaatggtgagaaactgatgtttttcccctaaaattgggaatgaggccaggatgttcctgttccctactcctgttcaacatcctaccagaaacccttgctaatgcaataagacatgataaggaaatgaaagctatacagattggggggaaagaagtaaacctgtctttgttctgagatgacatgattgtctatgtagaaagtcccaaagaatcaacaacaacaacaaactcctggaacaaataagggattatagcaggttgcaggttacaaggttaacatataaaagtctatcgctttcttacatgccagcaatgtgcaagtggaatttgaaatttaaaatataacacattatattaacaccaaaaaattgaactgcttatgtataagcataacaaaatatatacaagatacatacaaaggaaatttctaaactttgatgaaagaaatcaaaaaagatctaaataaatagatactccacgtttgtggataagaagactcaatgttgttaagaatcagttcttaccaacttgatctgtagattcagtgcaatcccaagcataatttcaggaagttactttgtggatattgacaaattgatctaaagtttatatggaaaggcaaaagattcagaatagacaccatattattgaagaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaaaaaaaagactcctagaactagtgagtgcgtttgtcaaggatatgagataaacatacgaaaaatcagttatttctctatactcgcaaagaacacctggaaaccacagttaaaaacatagtaccatttgcagttgcttaaaataaaatgaaatgcttaggtataaatcccacaaaacatatacaaaccttgtatggtgaaaactacagaactctgatgaaagaagttaaagatctaaataaatgaagagatgtactctgttcagggattggaagactcaacatagtaaatatataatttctccccaaatctatctctagatttgacccaatttcaattaaaatcctaggaagattttttatggatatagaaggcttatcctaaaatatttctggaaaggaaaaagaataagaatagctaaaacaattttgaaaaactatgataaagtgggaggaatcattctacccactatatagatttatatagctataggaattaatatagagtagtactggcagagagatagacacgtagcttgatggaacagattagattacccataagtacccccacacaagtacagccaaatagtttttgagaaagattcaaactcaattcaatgaagaaagagtaatttttttctacaaatggtggtggagcaattggacatccataggccaaaaatgaacctcaatttaaacctcatgccctataaaaaattaactcaaaatagatcatagatttaaatataaaacataaagctacatagcttttttttttgagacagagtctcgctctgtcgcccaggctggagttcagtggcgcgatcttggctcactggaacctcccatcccgggttcaagtgattcttgtgcctcagcctcctgagtagctagctgggactacaggcacacaccaccatgcccggctaattatttgcatttttagtagagacggggtttcaccatgttggccaggctggtctcaaactcctgacctcaggtgatccacctgccttggcctcccaaagtgctgggattactggcatgagccaccatgcccagccaagatacatacttttgaaagaaaatgtaccctaatatcattaggacatggagggagatgaagaattcttagacatgacactaaatgcacaattcgtagatgaaaaaagaaaaacaaaaaacctcaacagtaaaaaataaaacaaatagtccaattggatagtggttaaaagacatgaacatttttcccaaaaagggttatacaggttctaaacaattacatgaaaatatgttcaacatcattatccattagggaaatgcaaattaaagccacaataagatatcgctccacacttaatagaacagctacaataaaaaggtgaggccaggggcagtggttcaaacctgtaattccaccactttcacaggctgaagcgggaggattgcttgagcccaggagttcaagaccagtctgtgcaacatagggagaccctgtctcttaaaaaaaataagtaacaatatgacaataccatattctggcaaggatgcagagaactggatctttcatatatctggtgtgaatataaagtggtacagtcactccagaaaagagttaggcagcttctttaaaatactaaaacatacatttgccatacaacccagcaagtgtactcctgggaaatgtacatcctaaggaaatgaaaacttatgttcacagtaagacctgtaatcaagtttttatagcagctatactcgtcatagctaaaatttggaaagtaccaaaatatcctacaatgggttaatggttaaacgaattgtgatacatctataccatggaatcctactgagcaataaaaatgaaaaatctactgatgcatgcaactacttggatagatctcaagaaattctacttcgttaaaaaaatctcttaattgtcgtgtactgtatgatttcctttatataagtttcaaagtgataaaattatagaactggagaacagattagtgattgtcaggtgtgggacactgcaaagtttaggtgaggattgtgagatgggtgagtgggtgtgactagaaagggttagcacttggggtttttgtgggggattattatgtagcagttctgtatctctgttttggtggtgactacttgaatttacacatggcgataaaattgaatagctgtgcacatagacacatgagtgcatgtaaaactattgaaatcgaaataaagtctgttggttgtatcaatagtcagtttcctggttttgatattgtactactgttatatgctactatgggggaaaatgggttaaaggtacacaaaatctctgtactacttttgcaactttctgttaatgtacaattattttaaaattttaaaaaattgtaaggtttcccttatgaactgtatgctcttccatgaaagagataattagcccacaaatatttaggagtataggtaaaagcattttaactacaggttttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaatgagagtcaattttaaatacgtctgtttcttaatgattaattttgctgtattatgacaagcatttctggataactatttacaatgagatacaaatattacaaatgtaaagtttatacttgtcttgctaatcagatcctgctattctgtgaaaaactgctgatgaatctctaaacctaagacaatttatagtgattatgcttgagatcaactgcatgggaaaagaaaacttacttctttcatcttgttttttgccttttaaaaaatagtgtagattacctacttctgaaagtatgtggctatttgttaactaaaatgactcatacttgttcaatataattctaggtgtaaacatggcttgatattacatgtaacatgttggccataatccccaatatcaacgttttatttgtaaatgtctcttaacctgaatttctcatcttatatgacttcagtatgtagatgaggaggctcatgtttatataatagagctctcaaagttcattggctcatatattcaatttttcttagtatcatcttaatgttacattcgggaaatatagcaatatgaaaaaaatgtgagatgagtttctctactcattttttattctgaaataaagcagcttttaaaaaatgtttttccaggccaggtacagtggccaggcatggtggctcatgcctgtaatcccagcactttgggaggccaaggtgagtggatcacctgaggtcaggtgttcaagaccagcctggccaacatggtgaaaccctgtctttactaaaaatatttatttttaatgtttttcctctactataagtggaatttgtgtttcacaagttaaaaatgatttttatcattgttttctctttttctatacaaatagctacctattttctttcaaatctgcattttgctagcttttacattatgtgacgtagagaattccttaggaagctgtgggaatagaaaatagataaagacaggaatttggtgggttgacataacccttgatatatgggctacagtagctggaaaattcagtctgtacactaggtacaagatgaattttggagtatacttgctaattaaaatttgagtctgaagaattagatgggggtgttcttagatgtattgaataagttactgttatcccatctatatgaataacctttggaaataacctaagaagtgtcttttgttaagtttgctctgtaagaaatttgtattacacaattaaataatacatgtcagatagaaaatataataaattctaacttagcagacagtttattcaaaagaattatcgcaagggggagaaactattgcaatagggagtggggtctattttaatagaacactctcaccataagatctatgagtatctcaagggttaggcaaaaaatatttttcttttatgggaggaataaacaagactagaaagaacttggtgggaggaagtgggaaggcctgggggaaggagagaagcgtaaccagtttgattaacaggcaacttcaaattgggtacaagagctcctaattgttcacaaaaacttctatacaatatcaatcacgaatagttttaagggaaccacttttcaaattcttacttctatatatactcttcgtaaagttgatatgcttaagaaaatgtctgtaatggacatagaagttctcctttcttatatcccctttcacaaatttttcttctctcattttactattgtccttcctcctacccatccagaatcttaattgtggtgcgttacaagatctgttgtaatatgtatcaaaatctccagggcgccaaacaaaaggacagtttgaaaattggcatcagtgttgagaaagtgaatgactctgaaagaccaataacatactttttcaagttagatctattcttgctttgctttcaacaaaattgatggatgaccttatcaatttgtaagttgatggattattaagagtaatttttgtggctcactcctgtaatcccaacacttggggaggcagaggtgggcagatcacctgagcctaagagttcaagaccaccctgggcacaacatggcaaaaccccatctctacaaaaaatacaaaaaattagctgggcatggtggcatgtgcctgtagtcccaactacctgggaggctgaggtgggaggatcgcctgagcccaggaagtcgaggctgcagtgagctgtgattgtgccactgcactccagcctgggcgacagagtaagatcctgcctcaaaaaaaagcataatttttattaagtcattataattcatggtgtataactcaaaaagagattgctttaacagaactccatctattcccgtatacttggtttttttcaaataggtttattgagatataattcacacaccataaaacactcctttaagttgtataattcagtggattttagtatattcagagttgtgcaactgtcattgctacctattttcagaacattttcatctcccccaaaagaaaccctataccttttcatagacacccactattttcccccctcccagcctctggcaattaccagtctactttctatttctatggatttgccttttttggacattttgtataaatggaaccatagaatatgtgttgcatctggcttctttcgccttacatattttcaaggttcatccatgtagtagcaggtatcagtactttattccttcttatgactgaatagtattccattgtgtagatatatatcgattcattagttgatgtacatttgggttgtatcagttttttagctgttatatataatcttgatatgaatattcatgtgtagttaagcctcgttattcaaggattctttatttaaaaattcacctacttgataatatttataacccccaaactcatactcttggcgtcacgcacagacaggtgcaaagtgacaacaagtttgaatcattcaacatgcacattcccagctaaggtcggacaacgcaacactcttctatcttgttgtttgggctctcataccataaatgagttcccttttctatgtctacttaattccatattttttcacatttttgtgttttttgctggtgattttgcttcttaaagtggccccaaagcatagtgttgagtgctgtctagtattcctaagtgtgagaaggctgtgatgtgccttacagagaaaataaatgtattagacaagtgtcattcaggcatgagttatagggctgttggccatgggttcagtgttaataaatcaacaatatatatgaaataacatgtctttaaactgaaatacacatgtgataaggttatatattgatctgtggacaaatatggtgcaaccagagattcacagtaacctgtattttccctaaggaacagtgtttctgtgtttcctcagtcagtgtttgtgttgactttatagaatataagtactgcaaataatgaagatcgactgtatatggtttcatgtaaacatacgttttcagttctcttgggtgtatacccaggaatagaattgctaggtcatatgataacattgcttgttttgtgaacaaggtttctcagcgttcacatctataaaagtgaaaataggaatagaatttgtgttgagccctgtcttattctaccacatgcaagaaaatgagatccttgttggactggtgtggaactggccccatgacacacaggaatgtcaccttttgtgacacttccatagacataacttccaaggacccctgaagagacatgcccaagtggaagaaatcaccacattcaggaaagtccaaagctgttcaattgtaattttcctagagtagattgttttctttgttattataccagctttccaccatctgtctcactttcctctttcccagttcctagatggccgctttatgggattgaatctagagagtttaagccttacatagaaagttgatgagcctacaagtgggttaaagcttagtgtttttttttttaggtttcgtgttttttaaaaaagcattttcatatgaactgttgcttttttatttatttatttatttatttattttgagacggagtcttactctgtcacccaagctggagtgcagtggcacgatctcagctcgctgcaacctatgtctcctgggttcaagcgattctcctgcctcagcctcccaagtagctgggattacaggcgtgcaccacaatgcccagctaatttttttgtatttttagtagagacagggtttcaccatcttggccaagctggtcttgaactcctgacctcaggtgatcagcccgcctcggcctcccaaagtgctgggattacaggcatgagccaccacgcccagctgaactgttgctttataatatctcaattgtttacttcttcaatagcatgaataatttactatataattaaaagattttagtgatagtacatcaaaaagagtagtatctgcaaacagaagcagttttgtgcttgtttgtagtaaagactctatctataactgagtcagtaagcatattctcctttttaattactgccatgtactaatcaaacactatttaaaatgccaggcatgttgctaggtgctgttcatatctgttgtcttatcttcagagaaaccctgcaaaaaaatactttatctacattttgcaactgaagattaaagaagttaaataacttttggattgatgcacaggaagtggtagagccaggtgaatccaagttggtctgtcttttggactgcaaaagctgtatttttcccacatctgaagctgttagccctcaccctttatatcctagtgcccagctactttatgtgtcctgcacccctaaacccaaaagcggtatgtgtgtgaagtgaaggtagagagttttgtttttctggatttgttttttcacagctttactctgaccacctagaaccatgcctggcacaatataggtaatacttattgagtgaatgaaggaatgccacgtaagttttgtgaatttactgaggagtctcgggatggtgcaataagagaacagtgtgacagttgataaacaaaggaaggtttctgctttttggcaaagattacatctgtaaaaggtaaataggctgagtaacactttcatggtcaggactacaaagctgggctataaaaacacattattctaatccatgtttatctatcacttcttttgtttttttttttttttttttggcagagtctcgctctgtcgcccaggctggagtgcagtggcgcgatctcggctcactgcaagctccgcctcctgggttcacgccatactcctgcctcagcctcctgagtagctgggactacaggcacccgccaccacgcccggctaattttttgtatttttagtagagacggggtttcaccgagttagccaggatggtctcgatctactgacttcatgatccgcccaccttggcctcccaaagtgctgggattacaggcgtgagccaccgcacccggccatctatcacttcttacctggctggcacgctagtttatccaaactactttattgtacacgcttgttgtacagcttgctattaatataatgaggtcatataattagttatggtagtagatggtgacccttctcaaactatgaggaagatgtttaggtatcctcaaagtaaattctgcagtgatcccagagacagattaggaagtctcagagatggacaaaagacttgaaaggtatttcagaggctgggcacagtggctcatatctttaattccaacactttgggaggccgaggcaggaggatcatttgcgtccaggagttcaagaccagcctgggcaacatagtgagacccgatctctacaaaaaataaaaaaattagccaggcatggtgatgtgtgcctgtagtcctagctgcttgggagggtaaggtgggaggattgcttgagcctgggaggctgaggctgcagtgagccgtgattgcaccactgcactcagcctgggcaacagagtgagaccctgtctcaaaacaaaacaaaaaaaaagatatttcagaaaaaaaatgtatccacatgagcagtaaacaaggcacaactccattagtcatcagagaaatgcaaattaaaaccagataccactgcattcctaacaggatggctaaaaaatgaaaatgacagttgtaaagtggcagtgagaatgaagagccaccagaactcttactgctaatagggatgcaaattagtttaaccactttgataaactgtttgggaatatctaccaaagctgacatatatatatatatatatatatatatatatatatatatatatatatatatatatatatatcttgtgacctagcatttgcatccctgggtatatacccaacagcaatgtcttaacatatgttcacccccacccccccaaaaaaaaaaaaaacaaaaacatgtacaagaattcttttagcagaattcttcataatagccctaaattagaaacaacccaaatgtccaacagtggcggaatgacataaataaataccactgtattcatacagtggagcacaacaaagcaatgagaatggatggaactttgttacacaaaaaacacagatgaatctcacaagcataatgataagtgaaagaagccgggcttaaaaaactaccaactctatgattccatttatataaagtacaaaaacagtgtaactaatatatgaagtttgaggtcaaagtagtggttaccggtgggggaaggtagtgaatgggaggggacatgatgggagctacggaggtgctggtcatgttctgtttcttgatctggatgctggttgagttcactgaaaattcatcaagctgtacatttatgatatttgtaggaaggataggtatacattgtccgaagggaaagagtggagcagttttattttgtcagctcatgtggtctggcataaagatctgtctgggctatttaaatatttatattttgcataatggggatctgacttgttcacaaaagtattcattcagtcttggggagaaaagggtgatgacatacctgttctgtgccaaatgctaagtactgggatatgtaaaaatagaaagaaaacatagatatctttaaatctaataatccagacataagattctcttcctcagtagtaaatgctaaagagacagagtgactccatgtacaggtgaatctgctttgttatccttattggttactttaaaaataatgacagaaggcattggtgcaaaatgtatctaaagttacaacgtaagtgccatttctaaagcgtttgggagaaaattccactagtctatttgaactggccttgtgttgtctgtggtgtttggctttctcttgggtagcttaaatttcctccccatcagtatagtagattttatctattttgtttactcttcagaaataactgccaggggatttttaagactactgattgaggaatgattgccaaattacccatttttaagtgtaaagtcagtaagcaatgccaggtttctgaggagcttcaccaatttgtctctataatgtgtagtatttttttaacagttttaatatatgaatgaaaatactaccaagtttctcctggatccccacttttgttcattcagtgattttttttactgagctttggaaatgaaccttttgtctttttagtatgatcctctcccctcatgtcgtttgaaaatacccatctcttgcacgagactaagaacaatgctgtcctgttgagttcttataaaatccaaagaaaatttaagtactaagtggatgatagttaaagggtttacagcttttcttacagatccatcaaagtgggaaaatcatgagaagagttggagtcagacatgccagacattccaaatctgtcctgtacaatgtgaccttaagtagttccataaacctcagctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaagtaaatgcattacattgtatttttaaaacattttttgccttaataaactgctagcatttcagttaagaggagttaataacagtttcaccaatgcacattgaaaacgatgggttccattaaatagtcaataattattaaaattaagccaagaataatgaaagggatacaattacactaaagtgatatttatgtcttataaagatttctcttaaatgaaaattgacaattattagactagccatacacaaaatctggtattttaaaactaatcttggctgggcgtggtggctcacacctgtaatcccagcactttgggaagtcgaggtgggcagatcacttgaggtcaggagttcgagaccagcccggccaaccaacatggtgaagccctgtctttaccaacaaatacaaaacttagccaggcatggtggcatggacctgtagtcccagctactcaggaggctaaggtgtgagaattgcttgaacccaggaggcagaattgcagtgagccaagatggcaccactgcactccagcctgggcagcagagtgagaccctgtctcaaaaacaaaacaaaacaaaacaaaaaactaaaccaagggccaaagcagtatggtgacagggaaatattttatattttcccttagagacttcagagtgctgactcaccccttccacctaccatgtgaggacgcagtgataacacaccattgattaatgtctaagaatatattgaggaaaatactctatcaggctaacagggaaactggcacagttttgtttccactatattttattggttagagaagtcacagagccacctggttggaaggagaaaggatgtagatcccacctctggatgggagagatgacaaaaaaatttctggccatctttaatctgccacatcaattaattttaaacttaaactttgttgccttaatgtttgagtgagattgtagtagttgatgctactccattccgaggcagtactaaaatcctaccagaggatccaatgtcctcattaagtcccaattcaggatacatatgacagcagtgaataatttgtcactgtgaataggagactaaaataaggacataccatgttgcacaattacagactatttgaaatccagtctggcactgtttgttaaaacagaattttaatatttttgtaatcaaaagatagggaaattatttcaggcaggctgtttttataatttcgttttggcattcttctcttaagaatgaataataatataaggaaacaggtagtgattgccttttgaactataaagtgcttttcatttttagtaagaggttttatgtctataaaattatctgaaaagacaggtcatctgctaaccagtggtagagtatccactgcaaggctcaggactcctgaaacacatcataaaattgtcatgtaaggaaattcttggagctgagtgcagagctagtttgatttcatcataataggcagatattgatggattaactttgagtatttcatgaaataaaacatactttgctgtttttggtttataatacattttaaaacgtttgagtctgaaacaaaaattgtgaagctgatatttgtctttcctttcattctatatgtgaccagtttaatttttgtgattcggggcaatcaaagtatttgctgggtatctagagtgaatattttatcactttagataatctaatctaaaagcccagtaataacagttttggttatttttttcacaggtggggtagtatatcaaacagggtccagttaggagacagaaaccaaacagtaatttaatgtgtttcttttgactttttaaaaatttttgttggtacagagtaggagtatatatttatggggtacgtgagatgttttgatataggcatgcaatgtgtattaatcacatcctgtaaaatggggtatctgttccctcaagcatttatcctttatgttacaaaaaacccaaaaatactcttgcagttatttttaagtgtaccattaaattattatctgctgtagtcaccctgttgtaatatcgaatactaggtctttttcaatagtaatttaatttgaacatgcaaagtttagtataaggaattattgccaaggggttggggtaattggctagtaaaagttagagaactgtgaaaaatacaggcataaggaacagctgctattccaacggctgagatagaatgctcaaggaagaggtttggccttcctcctggcagcactaagatctgaaccttgttgaagaaaatatggccatgactcaccggatcacagtgaggttcactgagacaccatgctagtgggactcattggaaatctgccctctggagtccaggggaagccatccttagggacagaactctgaacatgcagcaagctcactgaggggctgctggaggaagccagtaacaaggagagtaccttgccagcagcgctctgctgtaaaggcacctgaagggggttccaagagaagctgcacatggaaagatgcatgctgctggccactgtgcactgcagataaactgcacacactgcaggagcctgatgagaaaaacactggaactgggacaacagaaccctttctcctccagtgcccctccagtgcccttagtggacaaagcttaatgttgtgccagttggaaaaatattcacagtcaatctccagtagtgcagagcaggcaatgaagtgtggatttggagctgacagacaatagattgataagtggcatgaggagtggagagattgtgtatatgacagtgagtatagttttgatgacatgtatcaagcaacctcattcattatacttggcaatgattttatttcattttgcttttttttccccctcctttaaggagattcattcaatacaacttagtggtatagggcttaaggaaggaaatgcccacgtttttgcttcatatgactagttggatagtggtgctacttattttattcaaatggatactatcaaagggtcagggagaataaatgagtttttgacatcttgcatctcagtaacttttgaaatataaatgttgatcagttaaatattttagtctaaaatttaggaccacaatctgaacaaaagagaaaagatttgaaaatcttcatcgttttggtaatagacgaaacttcggaaatacctgtgattgcttaaagaaagtatattaagaggccacaatgaaaaaaaatgatcatgaggaaccatttttggtcatgaaaaatggtcatgaggaatgatcctgacgaacacctaaatttaaagaaaggatggaaagagacagaggaaaccaggagggggaaagagaagtacaagaattattatcagagaatgctgtcatagacgctgagatcaaaaagattttctgtgttgtcaaatgctataaagaagccaaatgagggaacaactgtaatgtctatggaatttggcaacatggaaaccagtgtgaactttggccagagcaatttcggtattgcactggggacaaaaacaagattgtagtaggcagaggaaggaatggggagtgaggaagcagggaaaataaatataggataattttcaaatggctagactgagaagaggagagagaaacagtcatagatgcaggggcatgtggaggcaggggtagcgattaaaatgggaaggattccagtatctttttttttttttccttttttgccagaagagagagctaagaggaaagaaaagggtgcactgatggactgagatcttcgataggcagcaggtggagggtgggcccctcttccatcaagaccaaaagaaagtcaaggtactgatagagctaggcctgcaggcaggagaaggaaccagaggatgtccctcagctgatggcctgattttcagcaggtgggaggcagagccacctgctgagagtaggcatggtggtagagagtagagagataagagagttagtaatagcaggttaagagagataagagacattgctaggctgcctcaaggcccctccccccacccccgctgaggctaaatgcaaggaatttgtagcagcgcttatcaacatgcagatatgatttctctcagcaacactaagtagcctacaattgaggaaaggaaaattgtatgggtagattgtgctagagtgagaagtattacacacagcagacatgatggacaaaggaatcaagagagatgaaagtaatagtaatagcaagagaaaagaccatggagctggatggggaggaagattttagaggtgcatcaaacatattctagttggtcagtctcctcaccagtcacaatagttttcacgacatcaccgtaagagggacaatagtatggtaagtaagaaaaggaagttaatttcaggagacttgggttcaaataatgatcctgccatttatttattttgaccttgtgaaagttacctaacttctaagcaagcctgcatttttctttctttcttttttctttttttttttttttttttttttttgagacggagtctcactctgtcgcccaggctggagtgcagtggcgccatctccactcactgcaacctccgcctcccaggttcaagcgattctcctgcctcagcctcccaagtagctgggactacaggtgcacaccaccacgcccagctaatcttttgtgttttagtagagacggggtttcaccatgttgcccagtctggtcttgaactcttgagctcaggcagtccgcccgcctcggcctcccaaagtgctaggattatagatgtgagccaccacgcctggccacctgaatttttacacatagtaaatgctcaacaaatatttaatatgaagtgatatttcaagaaataagaaggtgcaatacaacacattagagatgccattctggcacaaagaaacaagtcagtgcctgctctaattttaatttaatgttacaatagccagttttgattagaatattttgcttcaccacatggtgctcaaggtactgtggctgcataacaaattaccccaaaacttagtgtcataaagcaactatttaatatactcacagcttctggggctctgcagtttagacagggcaaatctggggtgtgagtcagaagactcgagggctagggcaggaatcttctaaaggctcactaactcacatctggccattgatgctggctgttgactgagagactttacctgggaactttggcttacacttcatgtgacttctctctgtgaaaaggcttcctcatagcatggcagctgagttccaagggcaaatattgagagagacatccttttgctcagaataatggtattgagattcatccccatgtctgttgtattagtactttttaaattggttagtaatgttccatttcatgcatatagcaaagtttttaaatccattttcttgttcttagaaatatatgttgtttccactttggggctgagtaaagccgctttgaatgtttgaatgtaaatcttttgagttggacatattgtcacttctctcacataaatgcaagagtgcagttgctaggtcattaagaaactgccaaactattttccatagtggttgcactattttatgttattaccagtaatgtatgagagttacagcttttccacatccttgccaatacttggtattgccatcctttttaattttagccattctggtgggtatgtcatgatatttcttgtggttttcatttgcatttaccttatgactaaaaatgttgcacttattggccattcatatatctttgttgaagtatatcttcagatcttacaccgatgtctatttttcattgaggtgtgtgtcttttgtattaagttgtaggagttctttgtatattctggatacacttccttggtcaaatatacatattgcaaatatgttttcccagtttgtaactttcccttttatattcttaatggaatctttaaaagagtagaagtttttcattttgatgaagtccagtttacagtttttttccttcatggttcctgatttttgtgacctaagaaaatttcacctacgtcaaatttgtgaaaattttctttatattttcttgtataattgtagttttggctacgtttatgatgcactttagcataagagttgtatatcgtatgaagtgtaagggttgagattcatgggtagccattcgctccagcactatttgttgaaataaccctattgagttattttagcacctttatcaaaaataatgtgttggtctattttctgcactttctattctgatctgtatgtctatccttatatcagattcacactgtctagattattctatattaagtcttaaaatccagtagccaaaatcctacaattaggattttgtgtttaggctattctagctacttaaattttcataaacaatttagagtaaatttgtgaatttctgcaatgaagcatgagattttgattggtgttacttttaatctatatattaatttggggagaatggaaatcttaaccatattgagtcctccaatccatgaacactactccatttatgtagatttttttacattctcccagaaaatatctttgtagttttaagagtagatattttattcatatttcattacatttattgttagggcctcatgtttttgatgctatggtgaatagtattatgttaaaatttttaatttaatgattattgatagtatatagaaatacagttgattcttgtatattgatctcatatttggcaaccttgctaaatttacttattctagtggcttaaaaaaatccttaagattttctatttgaacaattgtgttattttatttctgtccattctgtatcccttttatttctttttcttacctttatgccctagctaggacattcaattcagtgatcttatattgatctcatatttggcaaccttgctaatttcacttattctagtggctttaaaaaaaatccttaagattttctatttgaacaattgtgttattttatttctttccattctgtatgacttttgtttcttcttaccttgatgccctagctaggacatacaattcaataatcttagggagcaaaccagtctcttaccattaggtattgtctgcaggtttttcttaaatgccctttattagattcaagaatttgttttatcgtcctaatttgttgaatttttattatggataagtgttgaatttcttagaatgctttttttctgagttgagtttttgtatagttctcctttattctgttacttacattgattgaattttgaatgctaaagtaaccttgcattcctgggataaaccctacttggtcatggtttattaaattttttatatacccatgtggtaaaaatactaatattttacaagatttttgcatcagtggttatgatggttattgctttctagttttctttttaaagtttctactggcttaggtatcagtagagtcaggtttactggtctcatataattagctcattattttctcaaaatgtttgtattggattgctattactttttcttagtgtattgtggaattcaccagtgtcactatctcctgggcttgggattttctttgtggggttattttaaattatacatgtaatttctgtaataaatttagggctattcagattttctattttttcttgtgatagtacttgtaatttgagtatttcaaggaatttgtcagtttcattttatttgttggatatattggtatatctttattatatttcttataattttcttgtctgacatatctgtactgatgtctcccctttcattgctgatattgataacttttgtcttctctcattttccttgatcattaaaatctttccaatggaatctttcaaagagcagaagttcttaatattgacaaactccagtttatcatttttagctagaggtttattattttcattgatcatacattgaacaagcttttggtatcattaactttattgtttgttcattttctgggtaatttctatcactgttttaataaagtccaatttgtcgacgtattgttttatgaattgtacttttggtgctccttctaagaaatctttgcctaatccaaggttggaaagcttttctccttttttttaatagaaatttaatagttttaggttttacatttaggtctttggtccattttgagttaatttttagatattttctgaagtctggatacaagttgtctttttttttggtcttgtcttttttttccatatatatagttgttccagcatcatttgttgaaaagattatcttttctccattgaatttccccttgcaattttgttaaaatttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtcttacaaaactcagaacacattgagctctctagtccaaaaattcagaatgctccaaaacctgaaactttttgagtgcctatatgacatcacaactggaatattccatagctaatacctaaatccaaaacacttctggtcccaaggactttggataagagatattcaacctgtagttctaatagcttttttgtagactctctctgattttctccatggatgattatatgtcagttatgtcatcttgaatacaatcagcattaattacatcttcctttccaatctggattcctcttgtttggttttctggccttattgcactgactggctagatgtctcctccagtataatgttgaatagaagtcatgacagcaaatgttttcttattccttagagaaaaaacattagattgtttaccattaagtattaatattagctgtaggtttttgtggatgacctttttgaggttgaagaagtttctttctattccaagtttgctgagaattttcagtaggaatggatgttggattttgtcaaatgctttttctgcatttattgagatgacctttttagtttattgacatcatgaattatattgattaattttgtagtgatcaaccaacctgtattctaaaaactgcatattggcctctagttttcttttgttataatagtctttaactggttttgatatcaaggtaatgctgagctcatagagtgaattagaaagtgttccttttcaattttgggggaaaggtttgtgtagatgtggtattatttcttcatgtttggtagagttcatcttggcctgaagttttctttgaaggacgatttttaactaaaaattctattttttatagttataggaatattcagtttatttcgtcttaagtgaggtttggttgtttctttcatgaaatttgtctgttttacctaagtgggtaaatttattggcatggagttgtttgtaacattcattattcttagtatatctgtaaaacctttagtgatgttacctttctttatccttaacattattagttcatgtgttttctctctttttttttttctgagcagcctggctagaggtttatcaattcattgatctatttcaagaacccattttttgtttcatttatgttttctgttgatttactttttcctattctatttatttcaactttggtctttatgttttcctttcatgggcttattttgctttaattttctcatcttctagtttattaagttggagactaagatcaagttagttaatagtattgttcaacttttctatatcctcattcattttctgcctacttgttttatcaattataattttggatttgtctgttcatatacttttatcacttttgtcttttatgtattttgaagttctgttattagatacttatacatttaggattattatgtcctcttgatgagttgactgtgttattatcatgaactgatcttttttctttgttcttcctttatgcagtgtatccttttttctgaattaaaaaattttgtttttttagctgggcacagtggctcatgcctttaatcccagcagtttgggaggacgaggtgggtggatcacttgagctcaagactagcctgggcaacatggcaaaaccctgtctctacaaaaatacaaaaataagccaggcatggtggtgtgtacctgtaatcccagctacctgggaagttgaggtgggaggatcatttgagtgtgggaggcggaggttgcagtgagccgagattacaccactgcactccatactgggcaacagtgccagatcctgtctcaaaaaaaaactttgtttttatcactggttttatgcaatttgttgataatctgccttagtgcctttttttatttgtattttaatttgcttgagattctttgagcttcttatatctatgggcttatagtttacataacatttgaaaattttttgggctttatttctttagggtatttttcttctccatttgtctcttctctcctttgaagggctccagttacatgtatgttagacccctttatattgtcccacatgtcattaagcttctgtattttaattttatacttttcatgcattgtctaatctgtttagttcatccagtgactttttcatttgagataatatatttttttaattctagaagctccattttgttcctatttatttttttgtatttcttttctcattatgtccatgctttcttttaaatctttgagcatattcataagctattttgaaattcctgccttgtaatgcctacatagctatcatttataggtctatttgtattgactagtttttcttttggttatattttacaatttgctgctttcttcattagactatatctagaatagccattattttagtgccaaatttagctccactacttaggtgtgaattatccttagcatttcagtgaggtctctctactgtgtctggttagaactgcagtatctccctgctctttttgaccagcctcatggagtttcaagttatgcaaggacaaattattattaaagtattgttgggactttttttatacctcagtcccttcttttcagtaccctctcctgaacattccatctccctcatcctccccaaaccataatctctgttttctctactcagtgacactgcatgcactgctttgcttcccctccctgtgctgcatactggaaattgcttccaggaagaagccaggctctcatttggtactcattccattcatttccctttccataggaatcacaatcttttactgcctattgtctcagtgcctgataatatttgtttcatacatcttattcaattttctagttcagtgggtaaagaaagtcctattccaattaaatttgcatgattagaagctctttttttcccttcaaaatctttatttgcatttctttttttttattattatactttaagttctagggtacatgtgcacaacgtgcaggtttgtaacatatgtatacatgtgccatgttggtgtgctgcacccattaactcgtcatttacattaggtatatctcctaatgctatccctcccccctccctccacccaacgacaggccccggtgtgtgatgttccccaccctgtgtccaagtgttttcattgttgaattcccacctatgagagaacatgcagtgtttggttttttgtccttgcgatagtttgctgagaatgatggtttccagcttcatccatgtccctacaaaggacatgaactcatcattttttatggctgcatagtattccatggtgtatatgtgtcacattttcttaatccagtctatcatggatggacatttgggttggttccaagtctttgctattgtgaatagtgccgcaataaacatacttgtgcatgtgtctttatagcagcatgatgtttaatcctttaggtatatacccagtaatgggatggttgggtcaaatggtatttctagttctagatccttgaggaatcgccacactgacttccacaatggttgaactagtttacactcccaccaacagtgtaaaagtgttcctatttctccacatcctctccagcacctgttgtttgctgacattttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatccttcacccactttttgatggggttgtttgtttttttcttgtaaatttgtttgagttatttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcatttgttgccatggcttttggtgttttggacatgaagtccttgcccatgcctatgtcctgaatggtattgcctaggttttcttctagggtttttatggttttaggtctaatatttaagtctttaatccaccttgaattaatttttatataaggtgtaaggaagggatccagtttcagctttctacatatggctagccagttttcccagcaccatttattaaatagggaatactttccctatttcttgtttttgtcaggtttgtcaaagatcagatggttgtagatgtgtggtattatttctgagggctctgttctgttccattggtctatatctctgttttggtgccagtaccttgctgttttggttactgtagccttgtattatagcttgaagtcaggtagtgtgatgcctccagctttgttctttttgcttaggtttgacttggcaatacgggctcttttttggttccatatgaactttaaagtagttttttccaatttcgtgaagaaagtcattggtagcttgatggggatgccattgaatctataaattaccttgggcagtatggccattttcacgatattgattcttcctatccatgagcatggaatgttcttccatttgtttgtgtcctcttttatttccttgagcagtggtttgtagttctccttgaagaggtccttcacatcctttgtaagttggattcctaggtattttattctctttgaagtaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctaaacatacaatcatgtcatctgcaaacagggacaatttgacttcctcttttcctaattggttaccctttatttctttctcctgcctgattaccctggccagaacttccaacactatgttgaataggtgtggtgagagagggcatccctgtcttgtgccagttttcacagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgatggattacatttattgatttggatatgttgaaccagccttgcatcccagggatgaagcccacttgatcatggtggataagctttttgatgtgctgctggattcggtttgccagcattttattgaggatttttgcatcgatgttcatcagggatattggtctagaattcccttttttttgttgtgcctctgccagcctttggtatcaggatgatgctggcctcataaaatgagttaggaaggatttcctctttttctattgattggaatagtttcagaagaaatggtaccagttcctccttgtacctctggtagaattcggctgtgaatctgtcgggtcctggactttttttggttggtaggctattaattattgcctcaatttcagagcctgttattggtctattcagggattcaacttcttcctggtttagtcttgggagggtgtatgtgtccaggaatttatccatttcttctagattctctagtttatttgcatagaggtgtttatagtattctctgatggtagtttgtatttctgtgggattggtggtgatatcccctttatcattttttattgcgtctatttgattcttctctcttttcttctttattagtcttgctagcagtgtatcaattttgttgatcttttcaaaaaaccagctcctggattcattgattttttgaagggttttttatgtctctatttcctttagttctgctctgatcttagttattttttgccttctgctagcttttgaatgtgtttgctcttacttctctagttcttttaattgtgatattagggtgtcaattttagatctctcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtcattcaggagcaggttgttcagtttccgtgtagttgagcggttttgagtgagtttcttaatcctgaattctagtttgattgcactgtggtctgagagacagtttgttataatttctgttcttttacatttgctgagaagtggtttacttccccttccaactatgtggtcagttttggaataaatgcaatgtggtgctgagaagaatgtatattctgttgatttggggtggagagttctgtagatgtctactaggtccgcttggtgcagagctgagttcaattcctggatatccttgttaactttctgtctcgtttatctgtctaatgttgacagtggggtgttaaagtctcccattattattgtgtgggagtctaagtctctttgtaggtctctaaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgtgtctcctgaatacagcacactgatgggtcttgactctttatccaatttgccagtctgtgtcttttaattggagcgtttagcccatttacatttaaggttaatattgttatgaatgaatgatcctgtcattatgatgttagctggttattttgcttgttagttgctgcaatttcttcctagcatcgatggtctttacaatttggcatgtttttgcagtggctggtatcagtttttcctttctatatttagtgcttccttcaggagctcttgtagggcaggcctggtggtgacaaaatctctcagcatttgcttgtctgcaaaggattttatttctctttcacttatgaagcttagtttggctggatatgaaattccgggttgaaaattcttttctttaagaatgttgaatattggcccccactctcttctggcttgtagagtttctgctgagagatctgctgctagtctgatgggcttccctttgtgggtaacctgacctttctctctggctgcccttagcattttttccttcaactttggtgaatctgacagttatgtatcttggagttgctcttcgcgaggagtatctttgtggtggtctctgtatttcctgaatttgaatgttggcctgccttgctaggttggggaagttctcctggataatatcctgcagagtgttttccaacttggttccactctccccatcactttcaggtacaccaatcagacgtagatttggtcttttcacatagtcccatatttcttgaaggctttgttcgtttctttttactcttttttctctaaacttctcttctcgcttcatttcattcatttgatcttcagtcactgataccctttcttccagttgatcaaatcggctactgaagcttgtgcatttgtcacgtagttctcgtgccatgattttcagctccatcaggtcatttaaggacttttctacattagttattctagttagccattcgtctcatcttttttcaaggtttttagcttctttgcgatgggttcaaacttcctcctttagctcagagaagtttaatcatccgaagccttcttctctcaactcgtcaaagtcattctctgtccagctttgttccgttgctggcaaggagctgcgttcctttggagggggagaggcactctgatttttagaattttcagcttttctgctctgttttttccctatctttgtggttttatctacctttggtctttgatcatggtgacgtacagatggggttttggtgtggatgtcctttctgtttgttagttttccttctaacagtcaggaccctcagctgcaggtctgttggagtttgctggaggtccactccagatcctgtttgcctgagtatcagctgcggaggctgcagaacagcgaatattgctgaacagcaaatgttgctgcctgatcgttcctctggaagcttcgtctcagaggggtacccagccatgtgagatgtcagtctgcccttgccggggggtgcctcccagttaggctacttgggggtcagggacccacttgaggaggcagtctgtccgttctcagatctaaaactccatgctgggagaaccactactgtcttccaggctgtcagtcagggacatttaagtctgcagaggtttctgctgcctttcgtttgtctataccctgcccccagaggtggagtctacagaggcaggaaggcctccttgagctgcggtgggctccacccagtttgagcttcctggccgctttgtttacctacttaagcctcagcaatggcgggcacccctcccccagccttgctgccgccttgcagttcgatctcagactgctgtgctagcaaggagtgaggctccgtgggtgtgggaccctctgagccaggcacaggatataatctcctggtgtgctgtttgctaagaccattggaaaagcacagtatcagggtggagcgcagtatcagggtgagagtgacgcgattttccagatgccatctgtcacagcttcccttggctaggaaagggaattccctgaacccttgcacttcccgggtgaggcgatgtctcgccctgctttggctcacactcggtgggctgcacccactgtcctgcacccactgtccgacaagccccagtgagatgaacccggtacctcagttggaaatgcagaaatcacccgtcttctgcgtcgctcacgctgggagctgtggactggagctgttcctattcagccatcttggaactgcccccctagaagctcttatcgtgagttttaatgtgattttaaagaatcttaattctaatgatattactttcaaatagagacagactattacagagttttatctaacaaagctaacatttatttagcatttcagtgatgtgagacgccttgctaagaggtgtctcagttcccattataatcctattataaaggtgccatgttatgcctattttacagaaaggaggactgcagcttgaaaacagttaagtgacttgttcaagctcacatatcagtcgagtaaatggcaaaacctagattcaaactcaatcttgtcaaactgccaaggccttgcttatcatcaccatgtgctatggtttggatgtccctgccaaaactcatgttgaaatttaattgccgttgtaacagtattgggtgctggatcctttaagaggtgattggcctggcacgatggctcacacctgtaatcctggcactttgggaagccgaggcagatggatcacctgaggtcaggagttcgagaccagcctggacaacatggtgaaacccatctctaccaaaaatacaaaaattaactgggcatggtggcagacacctgtaatcccagctacttgggaggctgaggcaggagaatcgcttgaacctgggagatggaggttgcagtgagctgagatcatgccactgcactccagcctgggtgataagagtgaaactccgtctcaaataaataaataaatacatacatacataaagaagtgattaggtcatgaggaatcctccgtcatgaatggatttatgttgttatcgcgagagtgggctagttattgctggagtgggctcctgataaaagaatgagcttgggcccattttctctctatgtcttgtgcttggttgcccttctgcaatgggacgaaccttaccagatgctcatgccatgctcttgaactcctcagcctccacaacagtgagccagataaacctgttgtttataaatttcccagtctgtgggtttctgttataacagcagaaaacagactatgataccatagtatgctgctttgaagtgggtgagcagctgggacaattaaggaatcagcttcagtactaagtgtctgggatgcaatgctttgggggccattttcaggttttgtacagcagtctttcttgggtcacattttcactgctctttacttcaaatggtcaagtcagacatcttttaagcaacatttatgggtaggttctgatggcatcttccttatatctgcatatgattggaaatctaagagcatttgggaaccttgtcactgaccatctttttttattgtaactctacattaaagtggggtgttttttgttgttgttgttgttgttgtttgagaatgataaggtaccatgggagcagaattacattactggaaaagtggtggctaggtttataaaagcaaaacagtcaatgatgttctcagtctcaaattatttcaaaataaaaagatttttaagaaaaatttacctaaaataattagtctcttttcagtttagccaccagcttcctatattcttagattgttttattttgatttttgggggttttttattgtgatttaattttttataatcatgtaaaacatttacgtggttccaaaggcaaactataaaagaaaatattttcaaagaagtatgttttctatccctgttcccaccctccttcataagtaatcattttcattagctttcagtttatactcattgtctttgctttaaaattgtaaatattgtagctgtgtgtgtttttacatacacatacatacacacacatttccctcttccttggataaaaggtggcatattctacacactattctacatcttcttgttttattaagtcgtagatactctggagttcactcaatagcatggtattaagattgtccttttttctttttaaagctccaggatattccactggatttaaatttttcaaaatctcatttgataaacatttattgtctactgtgtgtgtcatctgtcacgggtagtgcatagcattgtagggcaaacagaaatgaacaacatatagtcttcaccctcaagaaacttacagaattttaaaatacttttacaaatgtgtacctctcacagtagctgatccagtaacaattatttttatttttacccatctcctttttagagaacagagtaaaaatttttttgccatctattgtttctgttatatttaatgtcatttcagtagtatttataagcagtctaggaacacgtcccaacatttaaaatacttagatatatgattgtaaagtgtgaggcagagaagtacatcatatgaatgtatgctatttctaaatacttgctattaattttagtcactctaaagtcagaatataccagacagtccaaattactgtaattataccatccttttaaaaacttggcacctctttattcccaatattactccaaccattatcattataacaggttcctgttctgtacctcactcacatctgtactcttctccaatatttcttatttctttaatgtctgtacctcataagatgctgaacttttctttgaagacttaggcattggggctgtgggggtactagcctagacttattgaaagcagctcacctatggtactttgtcacgggagtgggtatatctgtgctaggtattgtccttcctatctctttgttggctcttaggggcactccgtctctcagggtcctgagtctgactttgcatctttgaatatggtgtctctccttaaagtcatcttggttacaccttgggtttaccttttctttgcctgtcctccagtagtggccctgaagcctatccatgttatcatttggctactcctggctcttccatcctggagctgttaacctagttgctcttgaactctgcatataaggcccccttccctttctctttcccctttccccagttgctctctaggttttctaatttctttcctgacactatgtatggctttagtcaagcgtaacccttgtccctaaatccacaaatataaagctaagacatgttacttgtctagttttcttagagaaggaaacttctcaggtctttgtatgcttcctcatacaattgtaggttgcagtaaggttaaatggctgaaaagcggtgaaggaacatgttcaagaagtttcatatgatttcactacatgaatgtagatgtggtaatctagcacctactgtactacttaaagcatttcctacagtgaaggcttctgagaaaataaatactattcctgaagtagtctcacaaaaaaaccttttttaattcagaaaattgattccaggttcactaagtcagcattttctctcatcaggcattgcaactaatgacattaatgagagccatgccatattttttaaaacaaaggataaaaagggcaaaactgagaattttaaaagggagttgtttccagtagtctgtttgaacattgtaattaaccaagaaataaaacaagaaaaggccattttaattgtgttttttagtactccattaacagtgcatcaagctccttatgaattgagacagtataaaatgagtgcttacgttaaagtaggaaagccatcagtctgcggtacagagcattgtatttattagagtatcccagacctgaatgagtattaccaccattaggtaatgcttaagtgtctattttaacaaaaggcatttttttttgttattatagagaacaaacactaaattgactaaataaatgaagtttaaacaagaaataaaacagctagaatttgcttgcttttgttggtggtgatatgctcttgtagccccagcaaattacatcagcattgttaccctcgacagggagctttataatttgtagcatgtaaaataacccttcccaaaaaagaagagagccaggacctgtgttgaactacttacaaagcaagcatgtccctggtgtcaccttagtagttttagtgagaaagatgggatttctaaggacagtagttcacagttgtgctctctctgttttctgtctttcatgctttaaggtttttttgctctcttattttaatgtgtgtgtctctatgtatgggcatgtaaataaatatgcagatggtggcacctatgtaagaaaatgtttgaacacagccccaatttcagagctcaatatggcatggggaattcttgggagaatgtgacctattgagggttggttggttgtttgtttttaagatggaatctccctctgtcacccaggctggagtgcagtggtgtgatcttggctcactgcagcctccgcctcccgggttcaagcagttatcatgcctcagcttcccgagcagctgggaccacaggcgcccgccaccacacctggctaatttttgtatctttagtagagacagggtttcaccatgttggccaggctggtctcgtactcctgacctcaaatgatccacccacctcagcctcccaaagtgctaggattgtgggcatgagtcaccgcgcctggccaattatcataaatatatgctttttagtggaccatatagaaagttctattctggttctttatatggttgggttttacttttatctaagtaatgtaagcacatggttttaaaagtcaaatcatgctacttctaacaacaaaaaagcagtgtctctcctaatttgttccaactccaccactttaagcatttttgctgtttcttctgtaaccagcaacatatattactatttcttgatttcatagtttcagatatcatcagttattgcctttttgctatgaaagatgtagctgttttatgttgctaccctcccaccccacttcctggtccctacttactttcccttccccatttttataatattcatatttcagttattcatataatatgattgtatttcttgtgtaatttattgttatatctggggtgaatcattgactcatttctttgattgcttagttttttgttgttgttgtttttgagacagtctcgctctgtcacccaggctggagtgcaatggcgtgatcttggctcactgcagcctccacctcctgggttcaagcaattctcctgcctcggcttcccaagtagctgggattgcaagagcgtgccaccacacctggctaattttttttaatatttttagtagagatggcgtttcactatgttggccacgctggtctcaaactcctgacctcatgatgtgcccacctcggcctcccaaggtgctgggattacaagcgtgagccaccgtgcccagcccgattgcttgttattttatgtattattgctaatttatccctaggctgtcccactaaactgtgtaactttcctcggtacattcaaccccattggataatttatcacattcattgtttttcttggtgacagagggccccctgcctgtgagcctttcatctgtttcattgtaagttggttgctgtcctggcctgctgggctcgtcatgagaattccttttgcctttcatctgtgctagagtctttgttccctaggtttcttgtttttttgcttttttggtttttttggcttccttcttcattttgataaagtatgccctctagtaactttctgagaagaggtgcttttttgagatacctgaaaatgtctttatattactctacaatttgatagtttggctgggtgtagaattctaggtgacaattttgaaaatatatagcatatgggtgaaagtttatatgatgcaacgagactacttaggttcatatcacacttaaccagctgtgtgtgacatgggcacatcacataacccttctgtgcttaagttttctcatctaaaaatcaggcataatatcttacctgcccttacagttattgagaggattgattgaataatgtatgtaaagcacttagggcagtgcctggccgtttttctcccaaagctttaatgatattctctttaccccagtgccctaaaattttacaatgatgtgctttactgtgggcctttttaaaagtcgttatactgattgcttagaaatatttttaaatctggaaactcattgttctttagtttagaaattctttaaaatatttcttagataacatccttttctccagtttctttgttcttcttttcaggagttgctgtgattcaaataacataagggcttataaggtagggcttcatctctaaccttttctttcctgttcctctttctttatctttttgctctactttgagagatttcttcaacttgatcttctaacccttctgtttgagtctcgtggtttagctctcattttttattttcaaggacttttttctgaatgtttttcttttaaactattatatagtttcatactcttgtcttcataggtttcatattcttatctatctcaaagtagtatatttttgaaattttctttgccttatacagggaacagtttcctcagaaaaatattaagagggaagtgttaaataggtgcctgggaacactctgtatatgggtaaattcattatcagtgatcagacaaagactaggccattttttgagcgccttatggatatccgttatctgtagatcttttgttcttaagcaggtcagtttgacagaagaatcttctgatcttctgccttgggctaagggtatgtgtattagggggagaaagggtacgtaggggcatttaagtctgactgcagtggttctgagagataaaggctgagggtctttattttaacatgtttaatacatggaactttccagttaatcctcttgtttgagtacagcacttcagtttgacgtgagctaggggtctggtgtccaaagtctccaaaaagtggggtaaggataatttgcttggccaaagatatccaaggtcatactgcatacctataaaggttcagccagtcctcctgttatctgctccaccatgcaaccctgccctcaaagatacctggtgcttcctattgctaaacctttcttagggacattttgacaggcatatcagcgtgcttcttactggctcgccttattgaaagcttgtgttcaggttctacagaaagcttgtgttcaggttctacaaaaagatgtcaagaagggatttgatgtgcaagaaatttattgagagtgaaaatgaatggtagggagctggaggaggctgggacagccatcacaggtcatgcaggtctgaccccgttggaggaaaaagggaagaaaaagaggaggattgggtggggaaattatttgaccaaggtgcagtttcaaggatgttttggcaaggcgtattgggagtccttgagccaaagttgaccatcagagacccatatctcacaggaattagcctgcttaagtattcctgctgctcttagtcaccagctgagagtatttataatagctgctttgaagtcttttctgctaattccaacatctgggctccctcaaaggcagtttctattttctgcttttttttcccctcctttgtaaaggtcacacttttctgcattttgcatgtctcctaacactttgttatagcaactgtggatactgacaccttcctccactccagggttattcttttttagttacttgctggactagttcagtgcaacctctgatgtccctcttcaggacaggtgtggtccttatccatgcatttctctgctacctctattggtgttaaacttaaccaatcgatagctgattgctcccttctttttgacaatgccttgtggtataaattgctccatagtctgatccaattaaaattgggtcccttcatggatgaaattggaaatcatcattctcagtaaactatcgcaaggacaaaaaaccaaacaccgcatgttctcactcataggtgggaattgaacagtgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaagaaaagaaaagaaaaaataaaaataaataaaaataaaataacattgagtcccttgtcagggacaagtttttctagtctttgagacttgctatacccttccctgagcagaatctctgcactatagagtaggagctggggaaaatggggaactcactcctcattggctgttccacccagatcctccctctgaagcagggtttttgtgttgccgggaaggaggaggtatgaactgtgcctccttttgcctctgctgctactcagtgtggatcttccacagctcaaaaccagggagtatgatatctgtcagtgttcaccaggtgctgaaagtactcagaatagttctttcaccctaggaagttgaaggagatgggagctgccactcagctgccaaacacatctctgtagctctcttgacaacacagagctgtgtgggcaggggggactacactgtttaccagcttcctcacctgattcctctgtttttagctggagttcaggggagagaaatggctgctgccatcagcttctgccgcttgctctatataggccttccacagcatggagccgtggaaaatgggatctgccaatgtttactagctgccaaatccaccccgagtagctcttccatctcaaggggcggatctgcccttagctgctgaactccttaaaacagttctttggcaaaacagagctgtggggggacaggtgcagtccctgtgtggtccctatctcgaatgctacagcctcttattgttcttatcgaatttctgtagattctattgaataaatgcttctctatttgttgtaagccctttgatcagtctccagggactttgaatgattgtgatttttgaccagctaaatatatgtctctccaggggagagatatccctgagctcctttatacagccattccagaagtcccacctagtcattgtgggggttttctgggttttttctgagacagagtcttgctctgtctcccaggctggagtgcagtggtgtgatctcagctcactgcaaccggctcactgcctcccgggttcaagcgagtcccctgcctcagcctcctgagtagctgggattacaggcgcacgccaccacacccagctaatttttatacttttagtagagacagggttttaccatgttggccagggtggttttgaactcctggcctcaagtgatctgcccacctcagcctcccaaagtgctgggattacaggcgtgagccactgcacctggctgtcattgtgtttttaatgattctgtcttaatagaaaactagttttacacaaatataatcaagtgacttaaattgaaaggactaagattgaaaactgaattgaaattgaaaattgaattgaaattgaaacctaagatttttttgaaaggtatgattttattacggaaatttgcttgattgagctttattttaatcaagactttgtatttccatttttagaattaattcagagaaatagctaacctataaagttcatcttcagaattgagtcattgtagacctaagaagcaatatagcagagttattaagagcataggttctggggccagactacctaggttccagtctttgctttgcagcttattggttctacctgggttccaatctttgctttgcagcttgttagttctttttatttttatttttgagacagtcttgctctgtcacctaggctggagtgcagtggcatgatctcagctcactgcaccctctgcctcccaggttcaagcaattcttctgcctcagcctcccaagtagctgggattacaggcatgtgctaccacacccagctgatttttatattattagtggagacggggtttcaccatgttgtccaggctagtctcagattcctgacctcaggtgatccacctgccttggcctcccaaagtgctgggattacaggcgtgagccaccgcccctggccgcagcttattagttctgtgaatgagttacttaactgctctctgtctattcatatataacatgagcatcatctgccccttagaattattgcgaggttaaatgggtcaacacatctaaaatagagcctgactcatagtaagtactcagtaaatgttagctgatggttattgttgttagacacattaaaggcaaataatcatctcatctttgtattttattattgagaccaataatattgtctaaagccagagaccttggtgaaacgctgggtgcccagctagctataatatgatctttagttccctctagtggaagaaaattagataggctctttgcataaacatgctgcttttggaattgtgatcatttaacctaataaaattacccctgaataattaaccaaagacaatatccacatacataaatggatttaagaaattgttaaaacttacaatcttaaatattctttccaagtgaaacttttttggggacgtgtaatttataatattaaataatatagtatataaaccatccagtgacataaaaagttaggcatatattacttttgtttaaaacaagtgcattcagtagtagtagtaccttgaagttttccattttaacattcatacccagttatctgcaagtagatggcatttcttggtcattctctgagaagtctttaatcattgtgatatgccacctggagtagatttccttgaagttttggcatttttagtatcctcttccacacagcctatggggtaacagaaagattgctagattgggaatctgagacctgggttcatcttccagttctgctatgaaatatctgtgtgacttcgggcatgtcttactagggcctcattttccttctgagtaaaatttgaggatagagaggagcatgtgatgatgactgtcttgctgtcacttctgtttctaacattctctgattcagtgatacatacactttgatgtgagacaggagatgtataatagatgttgagtctaagttgggtaaatgggtcctgtatgcttgatgttgccttctagcaggattggcaggaatggaaatcaccagcagtggaatgatttggtaaatgccaagatcttgaggcatctatggaggcggttgctagattgcagcagggtatgcctccctcagcttgggagattgttaaagagaactttgaggcaacgtctaagtgggatcttgatgaacaagtaggggtttaccaggcagagaaggaagcacgtggagtatcatacagagggaacaacatttgtcaggggacagagagcagggggccggtgcacaagctgcgggtggttcaggattggggtcagggaggctgaaggaagaagctactggaaaggaatgtataaatgtgtgacttcaaaaaaaaaaaacaagagctaaattgtttgactaagaagccggagagctagcttctatttccagttatactgttaaataggtctgtgaaccctagttaagttgttggacttaaaagattttttggaaggctttcaaagccatgcttagggattataatgtcttgctgtatggaatggagctcagtgaaggttttggaataatataatatctgttttagagtaaaactatgatgacactttaatgagtctaaagagaagaaactagaggcaaagaaacccatttaaagatctttgctgtgatccagtcaagaattgttgagggctgaaactagggtaaccgcagtaagggaaagatagttttgacaggtgttgcagaaatagaatggacaggttttggcagctgcatataggaagtagaggagaagtggtagatggtgtgaagatgactccaagggctgtctggaagattaataattttggtaatcagtaggccacacacatacagctacatgggttctgttttacttttcttaactagtgtccttattattaaacattttgagtgtgtctagtttttttcccaaataaccctatggtcatcttgaggttttttacgaaatatgtgatttcccaaaaaactgtagatgaaaaactgcaaagttaaagtaggcatagaactacactatatatagcagtgtggtttactaatagatgttcacattgctgccttcttggtgtcaaactcggtttgattgacatttgttaaacatagaatgatttccaccaaaaatgatgaaaggaaaagaaaacaaaacttattgtgcatgtgcactctcacatactttattaatcatccaggcctaactacaaccctgtataggagttgttatcttactctttctattttacaaatgaggaaacagatgttctaaggttatgcagctactaagtgatgaagacaggaaagacaggtcttttgactacaagtctattgccctatctattatatcataactgcctgccagcagaatgtgttagtgcttaaaaggatagatgccagatctgtggaagtagggtgaccagtcatcttggtttgcctgggaatgagggtgggttctcagaacccaggactttcaacctggaaagatcctcggtgccacaactgagaaagttccaggcaaaccaggacaggttggtaccctgtccagaaaagtcacttatatgaaataaaccattatctagaatgacttaaataaggtatttactgtatttctttcccataatattgtgtcatcaatgctaaatgacaaatgattcctaagtgaagaggagttaaggccccgccttccttccatctgtttgttttcactggctctgagcatcctgccttgctgcagttacactcaactgtgtgtgaatcagatactagatgcctttgcttctaagtcagttttattttattttttatttttatttatttatttgtttatttttagacaggatctcactctgtctcccaggctggagtgcagtggcatgatcttggctgactgcaacctccacctctcgggctcaggtgatcctcccaccccagcctcctgagtagctgggactacaggcacacgtcaccgcacccagctaatttttgtattttttgtaggaacagggtttcaccatgttgcccaatctggtcccaaactcctgggctgaagcgatccacctgcctcagcctcccaaagtgctagtagaattacaggcacgagctaccgtgcctcgtctctaagtcagtttttaaggaaacttatgctttgcccattccaaatttgatgaaatggcaaaagagctattcagggaaaaatcaaggagggctgtcagtatctgtgatttcaaagtatttatcaaaacaattaactcatttttcttggtcctttttcaaataagtatcacatattggtagttatttctttacgataaatttgttttatactatttttatgagactttgttgacaaaaggattctgtagctggatggggaaacccatattattaaaagaaaaaaaaacctcagataatcatttcactatgccgtacagaatttttacctcattcattttttacatattgaaacagaccacaaattgctttctgggaaaagttttggccctgctgtcagtatttcctgggctggccccatcctggaagaagatttgggggagaaatgggtggtaaggaaatctatcctgtcaacgtgtccttgttgagctcctcagctatcagttaataaatatagaaagtaaattatagataacacaattatgaaagtataaagcacaggtatgtgaagaacattttttttctttgacatattagttgaattcccattttatttcagtaacttctcgtttgctttttaaattttattgaagaacgtgtatgcacaataaaatgtacccatctaattgtacacttcagtgagttttgacaaatgtatgcattctgtcatcccacaaagttccttcgggctctaacatgtatgatttttaagactttaatattgaaaagtaattgagttataaactgatatttctctaattttcttgtataaagtaaggaataccatgttgaaataggtgtctggtttttctaatagtcaaatgccctgatcttcccccctttggtttacatttcccaaaatgaaaagcaacagagcaattgcaccttttagacaaacttagagcattgtatttctatttttgtcatatacaaatttgttacacttatcagaactgaaaactctttgggaaatatattaacaaaaccccattaatttgtaaatgcttaatgcagctaagattgatttctaattaatacacatttgcctatttaagaaaattttcacatcagtcaaacactgaattaatggtatgctgcttcctttctttattcacctgatgatgatatttggggccataggaattttttttcaatgggcaagaattcaaagaaattagaaggtgcttggatttctgtttgtgtgtgtgaaaaaagacaacaaaatgtatagagctagtagtgaaacatgtaaaaaagaatcaaagaaattatgagtttgcagttgacccagatttctatggtggcctgtctaggcctctactcttcactagctgaggtcaactttcctgaaggtcaatgaggaagatagcctcattaaagccaacctgacctgtgttgttgccaaaggcagctgggatctttattcttcaacttgattatgagataaaggtagaacccagcagcagaaattgactttgctactataatccttccaaggttctgcttggattcctttcttaaagtatcatttggtcattcatttcagtacactaaggaaaaatatgttgagtcaataatgactttcatttacttattttgttattaatatttattgaaatgaacacattagtacttgtcctagttctttctatgactagattagaatattctttattttgattttgagtccaggtcagctcttagcgaattttgtttaactgttgaatttctaacacaacctagacattgtttggaaatgaatgagaatacttgtatatttgttaggaaaagcgcagtatctagtttctgactatcactagttacaatgcagctgaaataagccggttctgtaacagtcttgatagcctgtcattcaagtcagtattaccatattagcactattgtgtgattggatcttaggatatataaaaactatgcagacccaggaggcactgtggtgtgatgtaaagagcaaagggctttggttattagtcctgcttcctccacttactagctgtgtgatttatatcattgagccctggacctcagtttctacctctgtaaaatggggagatatatgtgcatatatatgtatgtgtatatgtacatgtatgtcatgcagggttattacagtaacaaatgaggacttatagaggggcactttaaagtctcagagtttgcattagattaacaatagtgaagaaattccagatttagttattaaatgatggatttgggttattaaaagaagctataggatttccttctgtgaaagtattttttaaaaacacatctgtttgaatttagattctttttggaatgactgacattataaatatctgtaagaattacagaactcacaatcaggagaggataagaattaaagcaagtcaacttatctagagtggcaccattccaatttggtagacactagccacatgcagttattgagcacttaaaatgtggccagaccaaattgagatttgctataagtgtaaaaatacatgctagatctcagagataatagtacaaaaaaagtaacttattttattaattttagtatgattatatgttgaaataatactttgtatacattgaattggataaaatatgttatcaaaatgaattttacctgtttctttttacttttttaatgtggctactggaaaatttaaaattatatgcatggcttacattatacttaaattggatggtgttgatcaaaatctttattgagctaggtgcagtggctcacacctgtaatcctaacactttggaagtccaaggcaggaagattgattgaggccaggaattcgagatcaacccgggcaacatagcgagactctgtctctataaactatttaaaaattagctgggcatggtggcacgtgcctgtagcccagctgctcaggaggctgaggtgggagcatcccttgagcccaggagttcaaggttacagtgagctatgatcacaccactgcactccagcctgagcaacagaatgagaccctagctcaaaaaaaaaaaaaaaaaaatccttattgaatgctctcgagcaaacgaaatcttaaatttagatcttttaagttcagatacagatagaatgaaaagttctcctagttcttcaagaaaaatagtagtaaaataatactttacaggaaaatcatttttaaaacagaccacttgaaccagcttccctaactttcccttacttgaccagtctgataggcagaccctggtgggatacttgctttactattgttggagagcccaaactttttaggaaaataatagtcattctaatgccatatggcaggttgatttcatttaagtttctaatttgggttagaaaattaaatattgctacctgtattactagttccccttttaaagggaaataaattgataaaataaatataggcatatagttaaatgtaaggacactaaacacagaaatagattagtttaaaatatttttaaaatttcctgagaaattacaaaaaagaaagtacaacttagccataaaaaggaacaaaataatgccattcacagcaagctggatggagttggagaccattattctttttttttttttttaatctgagatggagtctccctttgttgccctggctggaatgcagtggcgtgatctcggctcactgcaacctccgcctcccaggttcaagcaattctcctgtctcagcctcccgagtagctgggactacaggtgcacgtcactacacccggctaatttttgtatttttagtagagacggggtttcaccatattggtcaggctggtcttgaactcctaacctcaggtgatccacctgcctcagcctcccaaagtgctgggattacaggtgtgagccactgcacccagctggagaccattattctaagtgaagtaactcaggaatggaaaaccaaacattgtatattctcactagtatgtcagagctgagctatggggacgcaaaggcataagaatgacacgatggactttgggggaagggtgggaggggaggtgagggataaagactacacattgggtacagtgtacactgcttgggtgacgggtgcaccagaatctcagaaatcaccactaaagaacttttccatgtaactaaacaccacccgttccacaaaagctattgaaattaaaataaaaaatgtactcattaaaaaaaaagaaagtacaaaggagagtgaagagaggtaccagttactagtctgtaaacaaaacaatacttcaaaatagagatggtaaccctgggtcatgtcattcccaggtacattttgtgctaacatctgtaagcagtcagataatcaccactttaaatcatattttcatcacctgctttcaaattccttcctactttgcctctagagttgatttgtaggcaaatagtgtttttagtttgctatatcagcgtggacttaatagcacttaatacatatatctttaattcacattcatatttagaaacaaacattttgagtttaatattcgtggaatctatagttggaatggatatatttgtgtttttaattgtgctatttgagctatttaatttatacttgaattcaggaaaacatgaccacaatttttctagatcattgcccttatcatttgaaatatatttttatgttgctagtttcatactagcaaatcaagtcaaatcagtgttctgactttagttctgaaatgtcagatccggtgacatttaaattgctttgaaggctggccccccagcaattctgcctttattttgagagtgggtaggtgataagagactagaccaaggacttgttcagccatttaccaaatcaaaatgtgaggctcaaatggagccaaatgtgtggcagaaatggagcatccatttctgcttacaaactttcagtataaccaatgtatcacatagcaaatggtgaatgtggagataaaaatacaatttagactgggcacagtggctcatgcctataatcccagcactttgagaggccgaggagggtggatcacttgaggtcaggagttcaagaccagcctggccaacacggtaaaaccccatctccaggtgctaaagttgaacgagctgatggatatgaaccaccagtccaagaatctgtttaaagttcagacttaaaatagtggcaaataaaaagtcctcatttgtgatggtttgcttctgaaagaaaaaaaaaagtctctactaaaaatgcaaaaaattagccaggcatagtggtgcacacctgtaatcccagctattcaggaggctgacgcaggagaatctcttgaacctgggaggtggaggctacagtgagccatgatcacgccactgcactccaacctgggcaacagagcaagactctgtctcaaaaaaggaaaaatacaatttagttacatgaaagaggcaaaatagaaaataagctgaaaataaagagaaaatatcagttttaattgtggcaaacaccaaatctgtttacttcatgactcctgtgtcacaggatagagttaaaatcaggcttttgattagaatagagaggaatggaaagagaaaaacttaagtcgaaaacagaagatatgaaagggtgagttctaataaaaatgggaagctagagataaacataaaaatgagtaataaaaattttaagcttttcctagaattagaaggcagaacactcctggagaggaaaaatctgtgcaggcatgtgattgatgttgtctggctcagcctggccctccagcacacttgttaaaagctttcctcatggttatgacttcccagcacaaaccccacagctgcttcacatcctcccctcctgcggggccttcctaactacttttggagatggaggcatctttcctgtgcctctgatctcttcctttgcagtaaacactgagcccccagccctgccatgctgggctccaaacatccagcttctcattagaatcttaacactgccctctccaactgatttggtagactctgcaggtaccacatcacttgtcactgccccatttcattgactctaagaaagtcatttgtagaagttagcagtcagcttgcagatggtaggacaaaggcaggaccagcaccatattttctgactccagatcctgtaggcttttcctcactgccacttacaaacacacagagtgcttcctttaaaaaaacaaacaagtaaaaccttctcttgaccccgctatttctttcctactgccagattcttctaatatgatcgtgttcaaacccagcatggcattattggaaggactgctgactttggaattgggcaggccagggttcaaaacctaccctcatgatagctgtgtgatcttgaacacgtttctaagcctcagtttctccatctgtaaaatacctacctcacagtgtggttgggacatcaagtgacagtgactatattaagtacttagcccaatgagaggtgtgataattttaactgattattacataattgtctctggcatactgacctcaaccctgactcctccccaaaagttgatcttgctcaggattctcattaccttttctggctgaatcttgtggtcttttctcagctttcagccttctccagctatttacaacttaatttcctctactctcttgattttcttaatattattgattcttcctttccttgtggcttctcttttgtcaaattttctgacttctttttctcattctacccttatgtaagtcaatcttctaaggttccatctacgatcattgctctgttgacaagactaagttgaattaataaatcagaaaggagataatattatctattttactttctgcagtacatccttagccttggttcttccttacctgtctcccttcgactttctaatataaaaatgtcacattggattttaagtcatcagcaaacgggtaaagccccagtgctattagcactggatggctttcattattctattccatgtagacatggcaagcgatttccatgcccaaactgttttgtatgatgatgatgatgatattaacaactttgttttccaaatagtattatagagtttacacagtagtcctacatacattatttggatttgttcttcaaagtaacattgtgaggtaggtagagtttggaattatccaacactttttttttttttttttttttgagacagagtttcactctttgttgcccaggctggagtgcaatgacgcgatcccggctcactgcaacttctgcctcccgagttcaagtgattctcctgcctcagcctcccgagtagcagggattacaggtgcccgccaccatgcccggctaattttttacatttttagtagagatgtgatttcgccatgttggccaggcttgtctcaaactcctgacctgaagtgatccacctgtctcggcctcccaaagtgctgagattacaggtgcgagccaccacgcctggccccagcacattttataaatgatattttaaaaattctgactttgactctaggaatagtgccttttctgtttaaaccatactattttttgttccctattccgtataacttccctgataggtctataaatgctagattttaggctaaagaatagacaacatatttttattttatttagggaaaactaagaaaaagaggtaaaaatcaaaacagtaaattgagttattagtttattagcagatcaaggaagagttacaaatttggaggctaagattttattagaagagttggggaaagtatttgtggtttgtttttttttttttttttgcttttggggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctcagtgctttgagagtctgaagcagggaggattgattgaggccaggagttcgagaccagcctgggaaacataccaaaacctatctctatttttttctaaaaaaaaaaaaaaaaggttgtaatcagtgactttgattaggaaaaaaaacagaagatatacttgctaaatattcaaaagataccaaggtcagaggttatattcattacctattgcttcataacaaaatgccccaaaatgtaatggcttaaaacaacatacatttattatcttagtctctgtgcatcaggaatgtgtgttccaacttagcagggtcctctggctctgggtctctcacaaggtgataataaagctgttggccagagctgaagtcattttgaggctccactacaatgtggatctgcttccaagctcactcacatgattgttggcagtcttaccttcctcacaggctactggactgagagccacaattccttaagagctgttggcccaagcctcccttggttccttgtccgttgggcctctccatagagcagcttccagcatggcagctggcttcatcagagcaagcaagaggacaagtgagagtatgagcaagacagaagtcacagtctcgtaacctaatctccaaaattacacaccatcacttctgcagttagaaatgagtcactagatccagcctatacacaagggggatgggattataccagggcctgaatatcaggaggtgaggatcactgggaggcatttcacaagttgccccctacaaagggctagctaacatattggctgtctacatcaaaattcaaaaatatttttacaagtttgtagcaaaggagctgaaacaaagaaggtgaaatttaagaccagttaatgttaactccttcattcaaatatgagtaagtgcaagatcagtgtgaatttagttgtgattatgtgaaaaaagatgtaaacattttagttgttgtttgcaacagcttaaaaagcgctgaatggaaggttatgctacattaattaggagtatatagtattcagaacaaagtcatactcctcccgttcaccctggaccattcatagtaagcaggacactggaatgtctgcagaataggataaccagaatggaaaggagcctgaaaattgtgtcatagagacacagccttcaaaatcttttctggcaaacctgctaaaagaattttgaggccaggcgtggtggctcatgccaataatcccagcaccttgggaggccaaggcaggcggattgcttgagctcaggagttcaagaccagcgtgggcaacatggcgaaaccctgtctctacaaaaaatacaaaaactaggtgggcatggtggcacacgcctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactctgtcacccaggctggagtgcagtggcgcaatctcggctcactgcaacctccgccccctgggttcaagcaattctcctgcctcagcctcccgaatagctgggactacaggcacgtgccaccatgcccggctaatttttgtattatttagtagagataggtttcaccaagttggccaggctggtctcgaactcctgaccttgtgatctgcccgcctcggcctcccaaagtgctgggattacaggcatgagccaccacgcccagccttaaatatattttctacacaactgtagaattgcctgtttatctcattcactgtatggaaaatgtctgctatgtgacctacatggcaatgctagtccttattgtcaaatcactcagccaaatcagactcattttctgtcagggaaaaaaaaaatctgacttcatttttcaaacaaaattaaagtgttaaatggacatccctgtgacactcatcttagtattgattttgaattcttaaacagcttaccatgaatatattgcctggataaagtaaggtggaacctccctttttttctcaaactctctttgttttgctttcaaaggtctctccctccctcaggggctgtgcatttcccagccatctctttgaagttaggctttttgggttggaggagtagtttgccttttggatgggtaactggagatgtggagatgggtgattgtagttgtggagatgtaaaagaaaaaccgcagaccacagacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgttgaaaagactgggaggctttggttatccacgaatgtattcgtttcattattctgctggaagagtccccaaagcagaagcccatagatagaacataatcaatgtccacagttatttgaaagattgtcatatataagactatatgcttattcagtgtggcatcagaggctgtaactagaatcaacaagtggcagacgtcacctctaactaaagaagacctttttgatgattaaacttactccatgaatgaagcagcctgtctcacagactatgtagtttctcactagaagcactcaagttgaagctggatccttccaaggggcctgaagataaggttttaattttggactagagatggcctctaacatcccttctaattttaagatattgtaattcttttgttttttttttttttttgagacagagtcttgctctgttgtccaggctggcgtgcagcggcgcgatcttggctcactgcaacctccgtctcccaggttcaagcgattctcctccctcagcctcccaggcacaggtcaccacgcctggctaatttttgtatttttagtagagacagggtttcaccatgttggccaggctggtctcgaactcctgacctcaggtgatctgcttgcctcggcctcccaaagtgctgggattacaggcatgagccactgtgcccggccaagatattataattcttttaaaattacttatctggtttaattttattctttattcaagaaatatatttctgtctgtatgtttattttctgagaaaactaagaacaagttgggtttgttttttgttgttgttgtttttgtttttaacagtctcactctgtcgcccaggctggagtgcagtggcgccatcttggctcacttcagcctccacctcctgggttcaagcgattctttgcctcagcttcccatgtagctgggactacaggcgcatgccaccacgcctggctaatttttgtattttttgaagagacggtgtttcatcatgttggccaggctggtctcacacccctggcctcaagtgatcaaccctcctcagcctcccaaagttctggaattacaggtgtgagccaccacgcccagcctcctaaaaagcaagttttacatactatataaagtaatgatcacagaaagcaaattttaaaaattcacctaaatttcaccatgtatgctaattgtatcaaaggggacttagtgacagtgtagtagagaaaaaaggatctttggtttcataaaacctgggttaacatcccagctctgtcacttttactaattatgtgaggttggccaagttttataagttccctgagcctcagtttgcttaccttcagaatcttcctaagattatgagaactagatgagaaactgtatgtgacttccctttgtaagtggtgaagtgctttttaactataaagtattatttccagtggctttaacaggatagttttagtccctcattgttgaagtagtctgtgtgggattttatgtaactaattttgtatgttgtgatggaaataattcatggttggctgtatatcgagatgagacctggttaaattggatattttccagtgacctgatcccagtgttaacccaaatcactagaacatggccttatgttttcttttgttttgttttcttttttaacagtgtaattgtggaaaatttcaaatgaaaagagagaatagtataataaaccccagcatactggtcaccaagcttcaatagttatcaaaacattttgccattcctattctgttcctcctgatgtctttttctcccctggagatttctaaagcactataatttcacctataaatactcttgtttgtatttctaacagataaggattttttaaatgatcatattattattatacctaacaaaatcaacaataattccttaatatcatgtcatgatcagttgatactcagttttccctgattgaacatgaattttaactgacagatttctgaatttagaattgttttattagctctagggacctgaaagtagattataaattcagttaaaataacttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagtttgagaccagcctggccaacatggcaaaaccccgtctctactaaaaatacaaaaattagccgggtgtggtggcacacacctgtaatcccagctactcgggaggctgaggcaggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatatggaaaagattagattagtaaatttcaaattttaggttagaaaatccggtataaaacttgttaaacaagcaggtacccaggtcccacctctagacattcacttttgcagatgtgagttctgaccgggcaggtcaagagatgattgacctttaaaatgggggtaatacaacataaaggctatatcatcattgtcccaacacacacagtagttttgtagacatctgcatatatttgcacatccattactttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccagactcccagaaagaaagcaggtgttcagcctaaatcacattgttagcacaaacagtttagacacagtgagtcagtcttttcagtcaggaatgtagaggaccgtcctgaaatccaagttcccagataaacctctcaagggccaaccttagtaggcctttcaagccttttatgagatagtagtttaggcctgctatattaactcttctgcacaaactaaaatagagataaatagaagaagggttttaaaagagttgatataaactcctggatctgcaaacaaaatataattgactgtaaagataatgacagggtttggagtttggggtttttttttttttctttttaactgtaaatacagtatcatttttatatctgttaaaaaacatttaggtggtcagatttttgtataaaacaaatcctggattgggatgttacagtatagaacagattttaaactttgaatgctatatgagaaaataaactattcagatgctactgtcttagaaatacatttgaaattgtcactccgataacttttcgtctatgacaactaatcttcaagccactaaaataattttgaataaatttgtgtacatataaaatctgaagaaaattcagttaattttctgttatttaaaagaagtatagtttgttcatttaaaaataaaagttattggccaggcacggtggctcacacctgtaatcccagcactttgggaggccaaggcgggcggatcacttgaggtcagaagtttgagactaacctggccaacatggtgaaaccctatcactactaaaaatacaaaaattagccaggcgtggtggcgggcgcctgtaatcctagctactcgggaggctgaggcaggagaatcacttgaacctgggaggcagaggttgcagtgagccgagatcacaccactgcactccagcctgggcaacaagagcgagactcagtcttgaaaaaaaaaaaaattcttagtgtacaacctttgccatatacataacttgtaaaaatttagaaattacagaaaattttgacaaaaaataatgtcttaattttgttataaaaattgtaacagaaataaatgtcattcacaaacattttggaccatttccttctattggaagcattttgctataccattaaatattttttggatacaatattttaatgacttcattaagacatctaaatgtgtgcatgtgccatgtttaataaattccctatagttcaacattaacattgtttttccctattagaaataatttataattaatatcttgtacataattacttgttcacgccccttgattgctttgtttcctcagaatacatttctgaaagtagaataactgggtaaaagagtatatgaatacatacaaatacatacatcatacttagatttaacctttttctcagtacaatgcctcacattttgaaaaatacattcacataaatatacaacttaaagaattattgtagaagtgaacaaccatgtaactataacccaagtcaagaaattttaaaactgccagtacctcaacagcccctgaattcccctttctcatgataatccccttcttctctcagaaataactaatctggacttcacttctgtgctttttatatccctagcatcaaaataggaattctcagaattctcaaataataaagttcactgtcgtctgctaaaatctattttttttttttttttttgagacgatgtctcgctctgtcgcccaggctggagtgcaatgctgtatcagctcactgcaacctccgccccctggattcaagcaattctcgtgcctcagcctcccgagtagctgggactacaggcatgcaccaccacgcccggctgatttttgtatttttagtagagacagggtttcaccatgttggctaggctggtctcaaactcctgacctcaagtgatccgcctgcctctgcctcctaaagtgctgggattacgggcatgagccaccacgcctggcctaaaatctttatttgaatggaatcctacagtatatactctatttttggtctctgagattcatctggttgctttgtgcagctgttcctttattttattgctatgtagtattgcagtgaacaaactcgcactatttattcattttaatgctaatgagtatttgggtgattcccagatttcactattttgtagagcagatccttccacgttgttcttcagccatgttttaagggatgtacttgtctgcatttctcatatacattttagaatgaggttgtcaatttccaccaaaacaaaaaaactattgagatttttgtcttgaattactatatcaaatcttgatagcaatttgagaataattgacatgtttacagtgttgaatcatccaattcgtgaacatagtgtctatcttcccatttatttagctctttgatttcttgcaataaagttttatatgttcctctgtagaggttgtgtacatctgtattagatttatgtattgtcagatttattcttaggtattttgtttttagggtaagtcagtttctctcattctcccttctctttccctttccttgtactaactttgtgttcctattcatcaggcttcattaattccaacaattaatctgtagaatcatttggattttctccatacataatcatatcatctgtgtataaggaggatttgatttgccctttccaacttttttacatcttttcttgcctttattacaatggataaaacattcagggcagtggtgatggcagttatctctgcttatttctgatcttagagtttgctaagcatgaatggatcatgaattttatcaaatgtcttttttctgcatatgcagtcatgcatcctataatgatatttcagtcaacaacagactgcatatacatgggtgctctcataagagtataatggagctgaaaaattcctatcgactagtggtatcatagctgtcataacataatagctcaacacatcactcacgtttgtggtgatgctgctataaacaagcctgtgctagcagtcatataaaagtataacacatacaattatatacagcacacaatacttgataatgataataaataactctgttactggtttatgtatatactatacttttttgttgttttgtttttattttaattttatttattattattataccttaagttttagggtacatgtgcacaatgtgcaggttagttacatatgtatacgtgtgccatgctggtgcgctgcacccactaacttgtcatctagcattaggtgtatctcccagtgctatccctcccccctccccccaccccacaacagtccccagagtgtgatgttccccttcctgtgtccatgtgttctcattgctcaattcccacctgtgagtgagaacatgcggtgtttggttttttatccttgcgatagtttactgagaatgatgatttccagtttcatccatatccctacaaaggacatgaactcatcattttttatggctgcatagtattccatggtgtatatgtgccacattttcttaatccagtctatcattgttggacatttgggttggttccgagtctttgctattgggaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcctaccaacagtgtaaaagtgttcctatttctccacatcctctccagcacctgttgtttcctgactttttaatgattgccattctaactggtgtgggatggtatctcattgtggttttgatttgcatttctcggatggccagtgatggtgagcagtttttaatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttagacatgaagtccttgcccatgccttgtcctgaatggtaatgcctaggttttcttctagggtttttatggttttaagtctaatgtttaagtctttaacccatcttgaattaatttttgtgtaaggtgtaaggaagggatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagttgggtagcgtgatgcctccagctttgttcttttggcttaggattgacttggcaatgcgggctcttttttggttccatatgaactttaaagtagttttttctaattctgtgaagaaagtcattggtagcttgatggggatggcattgaatctataaattaccttgggcagtatggccattttcacgatattggattcttcctacccatgagcatggaatgttcttccatttgtccttcacgtcccttgtaagttggattcctaagtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttctcctgcctaattgccctggcctacagtatgttttaagctaagtgttattacaggagtcaaaaaggttttaaaattttttaagtttattatataaaaaattatagtaagctaagatttattattgaagaaagaaaaatacttttatataaatttagtgtagcctaagtgtacagtgtctagaaagtctacaatagtagaaagtaatgtcctaggtcttctcattcactcatcacttactgactcacccagagcaagttccatgaatgcaagttcccttcatggtaagtgccctataccagtgtaccattttttatcttttatgctatattttgattgtaccctttctatgtttagatacccaaatatgtattacagttgcctgcagcattcagtagtcacatgctatgtaggtttgtagcctaggtgtgtagtaggatatcccatctaggtttgtgtaagtacactctatgatggttgtacaggaacgaaatcccctaactatgcatttatcagactatatccccatcgttagcaacacatgactatattgaaataattatataataccatccttcaatctattgctgtagtgaattgcattgattcttgggttaaccaaacctggtcatgatttatgatcttcataatcctttttacatattgttgggtttggtttaggctttctgtgtctctcttttttaatttatttttacttttttttttttttttttgagacagggtctcattctgtcatccaggccatagggcagtggcaccatcacagctcactgcagcctcgacctcctgggttcagttattcctcctacctcagcccctttctgagtagctggaaccacaggcgtgccaccatgcctggctaattttgtagagatgaggttttgccatgttgcccaggctggtctcagactcctgggctcaggtgatctgtccgcccagcctcccagagtgttgggattataggtatgaaccactgtggcttcctggttttcatacctagattacacttgcctcataaaatgaattggggaatgttctctcggtttttttgttgttactattgttctattgattgattgattgactgagatggagctttgctcctgtcgcccaggctggagcgcagtggcgcaatatcagctcactgcaacttccgcctcctgggttcaagcaattctcctgcctcagcctcccacatagctggaactacaggtgtgcaccaccacgcctggctaattttttgtatttttagtagagacagggtttcaccatgttaaccaggctggtctcaaactcgttacctcaggtgatccgcccgcctcggcctcctaaagtgctgggactacaggtgtgagccaccacacctggcctctattgttctctttatgtgatttgtagaactcacctctaaatccatccaggccagagttttcaatcttagttcaattccttaaatatttataggaatattcagggtttttattcattactgtgtcacttttagtaaactgtattttgctaagaatgagtgcattttatctaaattttaaacagttttggcataaagttcataataccactgcaggttctgtagtcatgtcttctttttcattcttgatactggtaatttgtgccttctctttttctttctcagccttgccagacatttaccagttttattattcttttcagtgacaacttgtagctttgtaattcttttttttttttttttttttttttttgagacagagtctcactctgttgcccaggctggagtggcgtgatctcggctcactgcaacctccacctcccaggttcaagtgattctcccaccttagcctcccaggtagctgggattacaggtgcctgccaccatgccaggctaatttttgcatttttagtagagacggggtttcaccatgttggccagactggtctcaaactcctgacttcaagtgatccgcctgcctcggcctctcaaagtgctgggattacaggcatgagctaccgcgcctggcctgtaatttctttttattgtgtgttgttttctattttagtaatttctacttgctgttatttccatccttttattttgggtttaattttctgggagctttttcccttttagtttcaacctttttgtatccttgggttttatttgtacctcttgttaaaggcatatagttgtgttttattccagtctctcaatctttgtcttttacttggatcatttagtccatttacatttaattatattttagtatattttgagttttatctatggtcttatgtgttctctatttgcaccacctattccatgtttttttctctcttgatttatttgaatcaaatgaatatttttatcattctattttccctctgttaattttgaagtttaagcactcttttctgttatcttagtgtatatcccagaaattacagtatgcttcgtaacacatcaaattctgatattgataccattattgtcctcctgaacagtgcaagtactgtagaacatgttaattttatataattccttccttgacttttaggctatgtttttcatgtatttaaattatattcgtgtgtataaaaacataaatcccatgtatttatatcatctcctatttcttatattatttgtatcgatttggatttacccacacacttatcctttgtttgttctttattctttcagcatctctaaggttttatctgggttcattttccttgtgtcagtctgctggatgcaaactttccatttttcttagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagatagatagatagatagatagatgatagatagatagattgtattatttttggcttttattctcttgcaaaaaaaaaaaacaagctcagcttttatgttctagggcatagtaagcttcattgtttgataatctgtgctggataatctcagtatatgaagtccctgtgggtttgcttttattgtctgttatttttgctggttattggtcgagatctcttatcccttcatgtaccttattcatttttgtcttgtgctagaaattatgttgaaaattattggcctaagatgatgctttctttctccaaagaggaattttgttgttgttgttgttgttgttgagacagggtcttactctgttgcccagactgaaatgctgtggctcaatcacagctcactgcagcttctacctcctgggctcaagtgatcttcctgcctcagcctcctgagtagctgggatgacaggcacacaccaccacagccacttaattttttttatttttagtacagacatagtctcactgtgtttcccaggctggtcttgaactcctgggctcaaggaatcatcctgcctcctcagagtgctgagattacaggcatgagccactgtgcctggcccaaagaggatttttatttgctgcttctactgcgaaccttcaggcacctagctgtttaagactttcttactcaagatttaaggcttagattttcagtgccacctagatgtaaagccgggttgcaagtctgtgaaggggctgattgcttccagttcacccctagctctttagggcatcagctcagtgctggagagtagagtttatcagattctcttgaattctcactcattttcccttttgagcccaggaattagagaccagcctgggaaatatagtgagacctcatctctaaaaaagtttaaaaattagccaagcatgggggtatgcacctatagtcccagctactcaggagactgaggcgggaggatcacttgggcacaggagatggaggctacaatgagccaagatcatactactgtactccagcctaggcgacagagtgagactctgtctcaaaaaaaaaaaaaaagaaaaagaaaaagaaaagaaaaaagtactttttttttttacttatttagttgtcttcaatgggagacatcatctagtctaccattacaagaagcagaactctagcaatgtatttaaaactcttttaacgtagttttcatattactctccataaagatttaccaatttatattcacacatggtaaataaatgtatctatgtttacattttgataggtcaaaaggatgttttggtttaatttgcatttattttgtcattagtgtggtcaaatattttaaaagtaaatttacccatttcttttgcatctagtcactttcattagttgtttagttttccttagttgttttagttgtaagaattcttttttgtttgtttgtttttgttttttgtttttaatagagatgggctctcccttgcttgcctaggctggttctgaactcctgggctcaagcagtcctcccaccttggcctcccaaagtgcagggattacaggcatgagccaccacacctggcgaagaattctttatttgctaaagatatttacctttttcatgtatttgtaaatattttccccaaatctgcctgttttattttgcttgttgatttttttttaacatgcagaacattaaaattctgtcagaaaattacagataagcaatagggaaggctagaatgaactcttagctactagattagagttgaagacagcagtataatctcatattgaatttattatatgtacacacacgcacacatacacatatacatgtacagatatatacagaaatcataaattatatgtgcatacatgagttagtacacatacattcctagctctgtccacttagagagcctaaagcatacccacacctagatttttgtttctgaatgtcctcctctaatttaagcagccagggatcctcggaaaaatgattataaattctagggctggaaaagagaaaatataagataaacatgaagcatcttagagtgcctgaaggtaaggaagtattcaaaaagatgggggcatatcagagagacataggaaccaacctgaaagcatgtccagtggccaaaactggaacaatttgagcaaaaaataacacagtatagattacaatccaaagtataaaataaatacttatgagtgcatagtgatataaagaaataattagataaacaattgagagagaaaaaaagaagaattccaagtgttaggtatagataatttccctccacccttgagtgtaggttggacttagtaactcactttcaaagaacaaagtatggagagggaaatagtaattttacagtagagagaactaacagattatcttcaccaagtgatcacattagcattaccagtgatcattcctgcgtatatcatccgctccttgatatgatgtgatgagaagggcatttcacctctgatattcttcccaagaaacccataaccctgacctaggcaagagggagacatcagacaaacccaaattgaggaacattctataaaatacttggccagcatgctttaaaactatcaaggtcatgaaaaacaagtaaagactaagaaactgtcaccaaccagaggagactaaggaatcttgacgactaaatgcaacgtggaatcctaaatggcaagggaaaaagtatatagttgacaaactgatgaagtccaggtaaagtctggagtttagttaatagtaatgtaccagagttactcttagcttttacaagtgtactatagttacctaagatgataacactagaagaagttcatttagtggtatacaggaactctctgtacaatcattcctcagtatatatgcaggggattggttcctggaacctcacgtgtactaaaatccacgcatctcaagctctgcagtcagccctgtggaacccatatataggaagttagccttccatataggcaggtttcgcatttagcaaatactgtattttttatctgcatttggttgaaaacattctgcatataagtggacccatacagttcagaactgtgttgttaaaggatcaactgtactatctttgcaacttttacgtcaatctaaaattattctaaaataaaaagttttctttactctaaacaaacaaaaaagaaaccatgagtttacaccatttccagtttaaagtagcaattacagatttttatttacaagacagttattaaattataaggaattattataagtaattttggtattatagttatataacaaaaaagagttcttaccttttggagataagtactgaaatatttatgcataatgctcttgtttttgtttttttgaaacagggtctcactctgttgccccagctggaatgcagtagcccaatctcggctcactgcaacctccacctcccaggttcaagccatcctcctgcctcagccccccaggtagctgggactacaggtgcgcgtcaccatgcccggctaatttctgtattttttatagagacagcgtttcaccattttggccaggctggtctcaaactcctgagctcaagtgatccacctgcctctgcctcccaaagtgctaggattacaggcgtgagccagtgcgcctagccatttatgcataatgttttattgatgtccgggatttgcctcaaaatcaagcagtgggtaggcagtgggtactatgttggaatacaggtgaaacaagattggccaatgtgttgttaattgttagagcagtgtaatgaatgtatgaaactctgtattttctacttttgaaattttccataatataaagtttttttaagtgagaaagaaattacatagtttttaactttttaagttttatatttgtatatcttatctctgaaaatctgggttccttgccacattaatatacttatttgcttcatcctactagtttaaatatgcaataaaaataagactattgaatgcagattaggatttctttgcacttcttttcatccgaagggtatatcccacaggaatgcacaatcaaaaccctgggttttaaagaaattttaaataactcttctcattgtggttttgccacaagcttgatatagatagatttaagtttgtttgtttgtttcagtttgtttttttatttacatagtttttattacaattttagattcacatacagctataagaaatatagatccttgtagactttgcccaattcttcccaaaattaacattctgcaaaactactgtgtcacagccaggatattgacattgatacaatccactgatcttattcagatatctgcatcagtttgtttttaatttttaaaattgtcttttttttctccttgctttaattttggttttagattatgaaaaacatgtatatgattacacaaagtcaaacctgtgaatagggttcattcagaaaggtctagtttgcatccctgtccccattcactttcttgccctaaagaaaacaatttttaaaaattagttattttatttttccattatttttatttgaaaatatgagaagatatgtatatgattttgtgccaccccccttcttacacacttccatatattctcatctaaaccttgatttttaaaaaattttaatatgaaaacactggggatcactccatggcagtaagtagacatcttcttcattcctgtttatgcctgctgaatactccattatggcaaagaattgtttattaaaccattcccctaatgatggactttgggattattttcagccttcttttactacatgaataaccttgtgcatacgttatttcatactgttgctaatgtcaaattccttcctcaaatgttgtgtcattttgcatcgccaccagcactgtctgagggttgtaggcttcaattttaaattgtgatttaaaggactaatctctgtcatataaattagtatatgtcttacttcattaaaaaactgtactcatatgtataaggctagacaaagagagtcatagataaattctgatttattttatggccctcatttatatctgtggacttgaccagaatgcttttaactagagtgggtttcttatcattgtaaggtcactaggtctaagaaaatttgtaatactcagaaatagagagaaggtcatttgtccctctgccatttgtttactttagatagtaggcagagtcattgaatcttattaggaaatataaaaaacatacttgctctttttgccagactcgaaaaagtactaaagctattcatatttcttatacacaccattgagagctcaagaggttcacaggaaataaaggcaagattttgatgggacttttaagacaaggcaaggatttggggtttatcttgaagatgtggatgccatcctaaggcatgtgatcagatcaccatttttaaaggttgtttttttttggctacagtatggctatagtataggaaggaacacatttggatatggggagaattgggaggccattgccattgttcagtatggatattgatggctaggatagatcagtgtcagcagagagcaacagaagtgaattaggaattagaaaggatagggtttgatgattagataaaggaagtaaaggaggaagaggagtcaaagctgacttgccgtctctggcttgggcacctgatatatgatggtgccactgactaacttgggcaaccctggaagcagatgatgcagtatactttggacatgctgagtttgaagtctctgtaagatatctgaatgaaaggactaaataggaagttagatatgtggattaggagcacagagagagatcttgggtagatacagagatttgggaatggttgctacttagatgatttagaagagtatatagagggagaagaaaaaaggacttgaggactgaggttcttccaaattttggaggttgtagaaaaggaggaatagctagcaaatgagatagagaaggaatagctgaagagatagaaaatcacgacagcaaggagttgcagaagccagaaaaaaaaaagtgtatcaggaacaatattataggaaaatgaagggtttgggtaattcttagttccatcctttactagattcctgtattcttcaactattgtcgagtgttcatgctctgcacagctcccattcggcctcatttctgagatgtgctgccttttggtatctattggtatctctttgctgccatttggtattcctatctgatatctcatttccttagtgagggacatagtgagtgaaagaacattagaggacaaatggaaaggcctatactgttgtcctagctctgtcaccaactttatttagtaattttgtttctttatgcctattatctgtgagatatagctagaatttcaggacagagatggctacacatggaaacaattacaatgagaagtaaggagagagaggaagagaaagagccgtcatagaggaggtgatactgagaattgaaggatgaccaggagtttgccaagtggtaatggcaaggatgaaactagaaagaagtagtaaatatattataaagatacagaaatatcataaagctttctttttgagacagggtcccactctgtctcccaggctggagtgcagtagcacaatcatggctcactgcagcctcgaccacctgggcccaagctgtcctcacacctcagcctccaagtagctgggactacaggtgcacgctaccacacgcggataatttttgtatttttttgtagagacagggtttcaccatgttgcctgggttggtctcaatttcctgggctcaagcgatccacccacctccgcctcccaaagtgctgggattacagacatgagtcactgcacctggcaaaataataaaatttaaagaaagaaaatagaatgaagccaggcctcataggaactaggaaaaaagatctcaggaatccaagttactgttctcttcattccttagggttttgtgtctactttgctctggaagaaccagctttctccagttactcaagcgcttgcacatgaccccaaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctatagataaccttcttttgaatcagggatctgtttcatccagtggcaaacagaagcccactgctgtttccatgattgggctggggctttagatgggagagtttaatagaatatagatggcaaatcgactatatgagtgggaaaagagagaggcattacaggcaggcaaagagcatgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccagttgagaatatccaacacacataaacaggaattctagaagtagaacatagagggaatgatgaagaaaagagaccttattcaaaaagataatagcccagaactttcccaaattgaagaaacattgtaacctcagatagatgtaaggtttggagaagaaaattgctaattttcttggattatttgagtttatggtggttgtaggatacccacctgtaggtgtctactccaaactgcctgagtctggcccccaggagaagaacctaggctagcaataagagtttaggaggcattaccattagcacagggtccatttcacttcttggcacctcagtttctaccctagcaacttttgagaatgaaatgaagtgtaaaagtactctgataatcacaacactacatagttttaccattgtcttcattgtcattgtcataaattctattgagtatagagcctcagtattagaggagaagagctaaggaacctggagccagatttcctatattcaaatcctggctctgctactttgtaaccatgtgaccttggacaagttatataacatttgtcttaagcctcaatttcctcatctgtgaaatagtacctgtctcctagtgtttttatgaggattaaataagttactacttgtaaagcactttaaatggcacttggcatgtagataaatgcccagtaaatctttgctattagctattaaagtacctgcatttcacaggaaccttcagtatcttatttcagaggagtgactaatgtaaaaatcatagtctatgaggataataaatttaggtatctgtgtcttcctgtaatactcaaaggatcagtttagttaactgctggcttttgtctatgtaaagagttttgtggttgtttgcaaattgctcatgatgttatttgaacattcaaggacttctatttttttcttggtaatgtctgaaacttggaaataattcatgggcatatgggatattctcctgaggacacaataatggttccatttttcttgctaagttggaacaatttaatcttgagcaaatacctatgcttgtgcttctgtttttgtttatatctgtatacatctatagttttacaaataccaatattgacattttcattttagccagaaacttgcctaaaagtaagattacacgagctagtttgatttcagagtgcaaatggcagtaaaatgaaagcagaaaataaaaaattaaccatatgattattttgtaatccccagtgtgtttgttcaaggtgagatcattttccagattcatccttcacctgtaccaccttcctgatctgcaaggccatatcagggctggcatggttatttacagttatttagatgttctgtgaggcagataaacagaagacaggacacaagtagaactgtcaaaaaaaaaccccaaaatccatgaattccacaagcgactagaaggaacttgttgtggttttcatatctacatcgtttgaaagggcactccctctcctagagatcaggagctgtactgttagtgatggcaggggctgcactgatacacctgcctctgaatgaagagaaggttttgaggagcaagaaggagaacttatttctagagagaagaatggaaataagggctagagagacttagaaacaatcgcagatacacatccataccagagttacaagaacttacacaggatagcaagcaaactgatgcaatggttatgactgatttggtttggggtggcagaggatccatcccagcttctacctgcaaaagtaagtaggactaggtcaaaggtctaagaaacttaaaaaaaagtgtgtttaaactagctgaactaatacatccagtagataaagaattgcacataaggtatttgtataataattttttttgaattaatgaagttaaaaaatttggggagagagggctgggtagaagagagagaaactcgagaacttgggcctttaaaccctgcaagcataactggggccatttaactaaccaacgtcctagttgaacagagctcattttgagtacagaaacaatagtagcttggaaacttagttctacctaaccccatgaaaccctgtctgtctcctggtcagttgggaaagaacttgtgaggatttcagtaattaaaaaaataatccccttgaagaattagaatgtcactgttctctcgataacccccgtaagtccaagttaaggcaatagcagcctcctccttcaaaaaggtgaacaggaagcatggagttatacagcgggctgagaatcaagagactgaggttctagtcctatctgctattaattagttactaacctaaagcaagtctcttaaacttccagttctaagattctgtgatgtaactcatcgtgatttatatctggaggtccctccccctcactttagtgttagagattagggaggtgggtgtttagctgtgaggattagtgagtacactgaggactaacagtgaagttcctacatggtagaagctagaacagaataggggctattgctcttatctgccttgctttttttctggaaattattagaaagccatacagatatgtatgttaacgtaaacaacaaatccagaggtcgtcttagaattatttgctatcccttgtagctggagcttccttatccactaggaggcaccattgtcaaacaacattgattaggggtcaagagctcttgatcatttaagcaattggagaggaaaaatgtctagaaagaagaaaaaagaggtaaatataggaccctggaaattgtgaaaaatcaatctttgttatctagatggacattagaacagttctcagtttctaaaattcgataaacagtatttcagactacatatcaattttagaagtggcaaaatctttcaaggcagtctttttttcgaagaaacaaataagatatgaaaaaagaccttagaaattactgagccaaatcccatctttattgaggagtcatgatcaacccagaaaggttaagtgtcatgaccaagatctgccaggcttgagcctaaaaccgatgtgtagggggggcatttctcattgattttggccatcccaacacctgaactctcttcaagtatttggagaatccctcattttaagagccttgataggggaaaaaatcccatattctactataaaagctaaaaatggcagatatttgcactactaaacatttagacccacagaactaccacaggacacacttggcatcagattcacttagaaggatacaggacagggggaaagaaaaaacagctttttagtcaggcagcaccaggcattcctctgcagtacgagtcctttcagtagtatatacaataaagttcagtaaatataacagggaaaagaaagatttttaaatagtgttgagaaaacaagttaacagttcagaaatcaatttagattcacccttccccacacacatgcacatacaacaaaaatactacaaacaaaatagagttgatagaagctaatcaaatcataggaaagctagcaaaagataaaattatttaacagatctttagagagcttttaaaacttcaaagaactgggatccacaaagaaaaaaggtatcaatagatttaacaaaaattgaaaaaactagaaaattaatttgcttcaatcttgacataaaaggtttacattctatcgaacataaagagttcaccccaacgaaagggaagatattaagcttcatacacaaacaggcaaggacaggaatagacagcttccaccaaaagaactacaattggtaaagaggcatttgaggatatgctcagtcattttaatgtctttgacagtatatcagaattgctttattaaacagtgaatattccctttctccattgaaaaggtgaaggtttctatctacttgcatatcttaattaacaatcctgaataagcaccattcatattgaaaaaatatgattatatcctatttacagtatcagtgcaagaggaggccttagctccatttatagcacctcagacattcccaaccccaaacccacctactatgttgacacatttcctggtgctccaggccttattgttctttgtcggaacaaatgccttgaaatgctgctgtcctcttaactaccatgtagtcaccaccactcccccatgctctcacccttgcttcttgaggacctgtctcagaggctgactactccatgaagactttctttttttttcctttttttttttttttttgagatgaagtctcgctcttgtcacccaggctggagtgcaatggcatgatcttggctcattgcaacctctgcctcccaggttcaagcaattctactgcctcagcctcccgaatagctgggattacagatgcctgccaccacacctggctaacttttgtatttttagtagagacggggtttcaccacgttggccaggctggtctcgaactcctgacctcaggctatccgcccgcctgggcctcccaaagtgctgggattacaggtgtgagccactgcgcccagcccatgaagactttcttaatctctccttctgtaatgtaggctcttagaagatgggatcttcatgtaactggtccttctatcctctacaaatagtagatgtttaatgattgaatactgaatgaaacataatccccccacaaatacggagtagtttagatggggaaagggtgaaaaagattatgcgtacatgactcctttctttcagaaatgaattcgccaccaacaaatatttgtatatattcatcaatatgtgggatagtatgctgaagacaaaatacctgtttatgctctctatttgtctatagacaattgtacagaccagaaggcacctacccatgaaataaataatagtaactgccaggtgcagtggctcacgcctgtaatcccaacacttcgggaggttgaggtgggaggatcacttgagaccagcctgggcaatataacaagattccatctctacaaaaaaatttaaaacttagccagacatggtagcactacttgtgaggctgaggcaggagaatcacttgagcctgggacttcaaggttacagtgagctatgattgtaccactgcacttcagcctgggtgacagagcaagactgccattcattgacttataaataaatacatacgtacacacaaacaaacaacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaattagaaaaaaaacagaattaaagatttttttaaaaaagactgatttgtgtatgcaaggattacagcatttatcaacaaacttactaaatatagacaattcatttaaattatatcaataatatagtattcatatgtatcatctggaaagatggggacataggctctgtattttaaaaatccccctatatggttctggaacatggggcccccataataggcatgaaaatggatttcacatatggagcctttctttacattatgattttacctacttagttgtaatctcttgtcttccattaagtaactgaaagcctggagcagaagtgaggaagtttccctctttgtaacctgagcattttgtggaggataatgcatggactgtaagtcagcttgcctgagttagaatccaggctctaccccttacaagctgtgtgatctcttggtcaagttacttaacttttgctgtttctcagttttctcgtaagtaaaataggggaggtagtcataatacctatgtcgtagacttctcgtgtaaacattgaatgagttaatgcatataagggacttagaaaatacctttcacgtagtaagcactcaataaatgctagctttaattatttattacagcaaaataaggttacttctgtctttgaactgtatataaaataaaccaagcagtttaggtttggctacatctgcttcactcagtattttgtcttcaggattcagccatattcctttgtgtagctgtaattaatttcctttcattgctatatagtattctatacccattttatctattctactattgatggacattgggttgttcacagtttgtgaccattgtgaacaatgctgctataaacattcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtggacatggaggtgggggctaaattttgaaatcaagtacagcaaaaactccaagaggtgttattcttccagaatatcttgagtcttcttggccttctgcaattccatatacattttagattctgctttagagtttccacaaaacctgttgggattttcattcaaattctgttgaatctatgcttcaacttggaagacatcggctgtttacaatattgagtcttcttgtcagtgaacaggataattttctctccatttatttcatttgtttaatttctcttaaaaaaatcatacttttctccacagagatcttatatacctttcttttagatttatttctacattcttaaagaaacactcttttaaaatttcatataacttacaatgattttgctgaactctgcttagttctaattttaacttagattattttggatattctatatataccatctgtaattagtgactgtttcttccttttctattctcatacattttatttctttatcttgccttactgccctggctaggacctccagaataatattgagtttaaattgttagagtggactttcttggcttgttcctgatctaagagttttttaagttttttaatcacaaatacatagttttaagtgttttgacatttattgacctgaccacataatctttcatctttaatctatcagtgtacacaattatattaattccaaatgttaaaagttttgcattcctcgggtaaactcaatttggacctggtgtaattcttatatattgcctgtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaaaaaaaaaaaaaaaaaacttgtcagaaatggcatctaggcctagagttttctgtctcagaagattaaattactgattcagtttcttgaatcagtaaaggattattcaagttttctaattctttttgttaattttggtgagttttatttttctgagaatttgtcggtttcatatacatttttaaatttgtgacataaagtttcagtatcatcttttatttctgcagcatatgaaatgatatctccttcattgttaatactgggtgctatatgtgtcttttctcttttctttttgttatcagtcttgccagagattcatcatttcacagggaacaacttttagctttgttaatttcttgaatatgtttgtcttccatttcattaatttctgcttctatttcctttcatctaatttctttgaatttaatttgatgatctttatgtaacttatacaggtagatgtttagttcttaaatgtttagcccttctctttttttgagtcagggtctcactgtgttgtccaggctggagtgtagtggtgcagtcatggctcactgcagccttgaccttccaggctcaagcaatttggccgtctcagcctcctgagtagctgagacaacaggcccctccatgcccagctaatatttttattattattatttgaagagatgggggtctcactatattgcccaggctggtctcgaactcctgggctcaagtgatcctcccacctcagcctcccagagtgctgggattacaggtgtgaggcactgcacttggccagcctttcttttctaatatgtacatttatagcagtaaatttccctctaagtactgctttacctacattttacaagttttgatgtgtttactgttattattattcagtttaaaatattttctaatgatttattctgagatacatgtaataaaagtatattgtctagtttccaaatgttaggaattttctagatttattaattgctttaaaatttatttatttacttttttagagatgaggtcttgctccatagcccaggttggagtgcagtggtgccattatagctcactgcagcctcaaactcctggattcaatcaagccttccacctctgcctctggagtatctgggactacaggcatgtgctgccatgcccagctaatttttaaatttttagtagagaaggagtctcactgtgttgcccaggctgatatcgaactcctggcctcaaatgatcctctcaccttggcctcccaaagtgctgggattataggcatgagccattgcacctggcctttattaatcatttcagagaatctatttgttgctttgctttttctctattttgtctctttacttcattaatttctgcttattatttccttctaccttcattgggtttaatttgctgttttttaaaacatgtctcatgatgagatgtcactgacttggtaacttttcatattttctaatattttaagtcagcattcacaatatttctattaaatttctaattaaagttttaaaacaagtttatggatacaaactactttgtaagtaccatttcatctgcattctgctttttttttttaacagaactgatttcctatgacaaaagtatagtgcctattcatttttttaaaagtaaaggtaaaaagaagaaaacaaaaaatttcaaatagaattctacccagtctttaacaccccattttaatagcaaaggcttcacactgcatctacttatacataaatatgcatatatatgtttatacatgttaatgtattatgaacatctatgtcaataaatatatgtctataacatcatttaatggcaatataatattctactctagttaccacaatttatgtaaccattctgttgggaatttaggttgcttctaatttctccctattataaatagctgtgataaacccttgtcattaaaacttgaccagtattcctaattatttcccttggaaggaaataattgagccgaaggacatatacatgtttaaggtttttgtcacacattataaaattgcccttcagaaagttgtattggtgtattgttctatcaatagtagattacctactttaagcaaggtttctccagtgccaagttgtgtatgtaacatggatcaccagcttcttaacctgtaagattggacctatgcccctcctcctttcagccatttttctatatttgtgggtctattaatggcaaaaccctgatcttgaaatgtaacgtaccaatcctgtacaagttttgatagtactcttttcattatcattgttaggaatatgttctgctgggcatggtggctcatgcctgtaatcccagcattttgggaggccgaggcagaggggatcacttgaggccaggaactcaagaccagtctggccaacacagaaaaaccctatctctactaaaaatacagaaattagctggacgtgaggtgtgcgcctgtaatcccagctactcgggaggctgacgcagaagaataacttgaccctgggaggtggatgctgcagtgagccaagatcatgccattgcactccagcctgggcaacagagcaagaccctgtcttggaaaaaaaaaaaaagttctaattttcattatgatgatttcttatttgattaattggctatttagcatgatttctcaatttccaagcatttagggttttctagttattttgttaatttatttctaacataactactttgtggttaggaaacatactctgagtactcgtttcttgcagaagtttttagactgagcttttatctccatagtaagcattgaggtttttggggtgttttttttttgtgtttttttttttggtgggtggggatggggtcttgctctgttgcccaggctggagtgcactgacagagtcatggctcactgcaacctcaatctcctgggctcaagcgatcctcccacctcagcctcttgagtagctgggaccacaggtgtgtaccaccacacccagctaatttttttttattttttgtagagacagcatctcactcttttgcccaggctggtcttgaacttttgtgctcaagcaatctgcctgcctcagcctcccaaagtgctgggattacaggcctgagccaccaccatgcccaaccagcattgaggtttttctgtgctaccaacatgacataccagaatttattctgtaccccatttttcatagtgcagctctatggtcccagccaggagcaaagggtgtttcatcagagccttaacctcttagatcaccctggtgcaaaagcaactggaccctgtcattctccatctgaccaccccaccccctcctacctctctagagttcctaaaagtacccctcctttccaaaacccacattcttcccctagggcagaagcagctcttgttcacctctttgagttgtaatcctttctctgttctcaggactagtttttcactcactatactgttaattctcacaagctttaacaaaaactttttgtttgactgggcacaatggctcatacctgtaatcccagcactttaagatgagaggcccaagcaaaaggatcgtttgagcccgggaattccagaccagcctgggcaacatagccagatcctgtccctacaaaaattaaaaataaaaaaattagccaggtgtggtggtgcatgcctgtagtcacagctacttcagaggctgaggcgggaggatcacctgagcccaggcattccaggctgcagtgagccatgattgtgcccctgcagtccagctctaggtgacaaaacgagaccctgtctccatttaaaaaataaataaataattttaaacatttcatacagtttttgtagttggcgtttttgtcatcctcagaaaaaatgctggttggaaaaatccagatttgctctgtacaacagtgttcttcaaggatatttgcagataagtaccaatctgtcaccagtctgccatgagatacatacagaaattgacagtaaacatttagaaactgttacagcaatttgacattgctgtgaaatcatagcacgtgattttgtgccttcaactccagataatcctgttgccaaagcagcatattttggagtggcatattctgatctccctcaatgtgcagccagtaataccttgtgcctcaagacctgtgatctgttttgtttatttgatgagtttggttttggataatttcttaattatataaataatgcatgtttattataaattttaaaaattcagatggatgaaaaggagagacagctaagctcattcataatcccattacttttcacaattcagactaaactgcccttaatttctctctgcatacagtatagaagtccacctcccccatactcttccataggagggtttcttctccctctcctttcattccctcagaatggagccaactaggaaaattcacaatgtgttctttgggggttcttgacagccccagaagcaccccaagatgggaagccaaagagaagagcaataaaagatgccttgtcagtttgtagaatcattatattatcaaataaagtttatcaaagaattgagtcatcaactttgttcaaaaggttcaaggttaggatatcaggatggtatgtattatgaatatgtgtattttaaatttcgttgaataaaatttgcataaataacagtatttttagtttttatttctatatctcatgaaatttaaaattagtagattgcttcttttactttaatatcaattaatattataaataatcaaatagctttaataatagaaaaatattttcacagtgatgcctctctttcagagtaacccttcaaagaatgtgcctgtatatttactaagttgcacaggtggttttgtttgatatctgtggttatgaagcattgaattaaaaaaaaacatataatggctgaaagatcccatttacaatagcaactaaaatataacatgtacagggaaaaagcctaataataaatactttaaaccaatataaagaaaatcgtaaaactataacttagagacatgaaaggaagtggagagacatatcatgttcattgatgagaatattagaaaatgttaatttctagaagttaacctatacatttaccatctgaatcaaaatacaaagattttttatagtttgacaaaatgattttaaaagtcaactgggaagaaaaaaatcataagaaaatgttggtgaaggccagttgtggtggcttgtgcctgtaatcccagcactttgggaggccgaggtgagcagatcacttgaggtcaggagttcgagaccagcctggccaagacggtgaaatcctgtctctacaaaaaaatacaaaaattagctgggcatggtggcaagcacgtgtagtcccagctacttgagaggctgaggcaggagactcacttgaacctgggaagcagaggttgcagtgagctgagatggcgccactgcactccagcctgggtgacagagcaagactctgtctaaaaaaaaaaaaaaaaaaaaaaaaaaaattggtgaagaataatgagatttttttttgccaaatattaaaagctgctactacagtattttattttgtctgtccatgtttttgtttttgttttgagatggagtctcgctctgtcaactggagtgcagtggtgcaatctcagctcactgcaacctctgcttcccgggttcaggtgattctcctgcctcagccttcagagtagctaggactacaggcgcaggccaccatgcctggctaatttttttgtatttttttagtagagacagggtttcaccatgttggccaggctggtcgcgaactcctggcctcaagctatccgcccgcctcggcctcccaaagcgctgagattacaggtgtgagccactgtgtccggccctacagtattttaaatggtaacttgatgcaagaataggcaagtcagtggaagaaagtagaaacctaaaaatacccccatgtgtgtatgcacatgtgtagagattgtcatttcaagtaccagtatttcagatatgaccagacaaaatggattgatccttgctgataattatagcacagggcagtaaataatttccaagtatttctcacggactggttccctccttagtctttatacttctcaccactttgctgcctcctccccaggctccgtcttttccctcatcccttctgggtccctccagaaagtcctctagctctcagaacatctcccaaattctttttggaaacaccagagtccattgaggcattttatttgtaagtatatattacatccctagaaaaagaattccaggattttccctcctatatgttttcatcttgcttcttcatggtccataatgccagctgaggtcgttagtacagtgaatccaaactggtgggataggaacaggttattctgccattttactagatctttgggttgcacatcaaatctgggatctggggctgatcactccacacttgtttaacctacctcaggttcacaacaattttcccagctctatgatcatcagtgatttcaaattcaccaatgtaaccatgcttcatcatcacagttagaaactggacagtaactttggagcacaacctaataagaacctggtgtttgcctctttttggtattgttgatgctctggatagcatcagccaggacattcatgcacaccattatggcagcatggagagatggcagaaagagcctaaattcttattgcttcattatgcaatcagtttagctctctccttttcctaacccctctctcatctaagttgaatcgtgcttaccctcatatatcacaattacaaaggaaaacgcctaagcaaaactgattccttcgctatgagatgttttttagtcctcatagatcaactaaccagcttaaactacagccagtttttaaaatagcgtttcttttctccccacaggacaaagaaatgaaaaatatttactctctgtagtaatcaaggaaatgcaaattaaagcaatcatgaatgacttttttcctcttatctaattggcaaagatggaaaaaaaataatcattatcctagtagagcaagggacacattcacacatggtagtgggagtataaattgttaaactgtttctggtcttgtgtatgtatcaaaagtgttattgtaggccgggcgcagtggctcatgcctgtaatcccagcactttgggaggccaaggcgggcggatcacgaggtcaggagatcgagactatcctggctaacacggtgaaaccccgtctctactaaaacaaatacaaaaaattagccgggcgtggtggcgggcgcctgtagtgccagctacttgggaggctggggcaggagaatggcatgaacccaggaggcggagctcgcagtgagccgagatgcaccactgcactccagcctgggcgacagagcaagactccgtctcaaaaaaaaaatgctattgtatataccccttgtcctagcaactcagcttgtaggaattttaccatacagataatcagagttgctcaccaagatgcatgatcacgttcatccaggctttatttctgatggtggaaaatgagtgctgccatactagggagtagactagaccattataataatgtttatagtagactaggcaactataaacattattttggagaagaatcctatttgacattggaaaatgttccttaggtgtgaaatggaaacttggtaaagtttttagagcctgtataaatgtgaaagtattttcattcatttatataaaaccacaccgagaatcaaataatagaatcaactgttcattaggtgtctacagtgtgtcttctgctgagtattaggtaggggtacattgaaagtataaatatattttttcttgttctttaggactttacactatcatggaactgttgtagggcttaaagatgtgcatttgttccttgcacacccagtaggtatagctataatcaatgggaagagcacaggacatagctagacagagatttcgatcttgtccctatcacatacttgtccactcacttagacaaattatttgaaaatgatgctgacctcatggggtggttataagtatgaagggaggcataacaaggactgcttcctatgatgcctcatgaataggaagtatgttagttcctttactttcccttccagaagtttctatttcctcagtataatatctgcagcaggtatattgggaaactgaactactgaatgaatgaatgaatgaatgagatactggatttaaaaatatgttataagccttaaagcattatgaaaatgttagctgttaatatttgcatagtttcattaatatgtataatatggcaaaattcatgtatacatatataggtgtatgtggggggagggggaggtgtttgtatgtgctaaatgttatggaccatatagagttgttatagaatgaaaagcaaaggaaggcattaatatggctggtaatcattgagggggcttccagggaaggtaggattggaatgaaaccttgaattaaggtaggttttgaaaatgaaaagcaatatatacaaaagtaaaaaagaaaatggtgtactcagggagtgataataagaccattctgcctagagaggaagattttcttgaaacatcagtggacaaggtaggtagaagaggcaaggtgtggccaagacaacaagaggccttacttatctagtaagaaatagaaaactactgtaagttctaagacaatatcgtgacattgcgttaccaacacatctatgtgttacaatatgtttgtagcgatgaactttgggaatggcagtgtaaacaaaaataaattttattttatatatgtcattgttttttccttccacagtatatagcctgaattttccatttagtggtaataacaatagcaagattgttttttaaatccttgtattctacataactgaatatttttggaatttgacttaaaaatatgcacacaaccctagcattgctgttttctgatgcttctttttgtgaaaacctaaagaaaaattatagtcaattttatatactcaatgttatttgatattactgttagcctactcttcctgtttctttccctgcagattttcaatgtgaagatgactgtcatgccctttataatttatgtctatatttcattgaaagaaaggagatttaaataacataacccttagcagtaaatcaactaataacttagttacaatgtattcactttcagtgttgtcttcctggaatttcctcttttcttatgttctttttcacatttttttacagtatggatggagcagatctgtgttttgaaatcgtaaagcgagctgacgctggttttgtgtacagtgaagctgtagccaggtatgtattgtatatctaatcaccagaggtcaagttgaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggtcaggagatcgagatcatcctggccaacatggtgaaactccttctctactaaaaatacaaaaattagctgggcgtggtggcatgcacctgtagtcccagctactcggaaggctgacgcaggagaatcgtttgaacccaggaggtggaggttgcagtgagccgagattgcgctattgcactccagcttgggcaacaagagcgaaactcagtctcaaaataaataaataaataaaatgaaaacgtgggtttataatacaggcttacattttcagtactgctgtctttcccatttctgatgatttttgtacaggaagcggggatctaatagctcaggaaccatgtagaattctacttgggtttttttatttttgttttggcaaatctgcctcattagttcttcattttgccttttagtgatatcaaattatctcacaataattaaggaaaagtaaagaacagtaaaaggaagagaaataaaagcaccatttttaaaaatatatttgcttcaggccagtgtgagacctaccaatcaaatggcagctgttgttctaagtggagaagttgtttgtaaagacctaatgactcaaaataagaaggaaatatgggccgggcgcggtggctcatgcctgtaatcccagcactttgggaggccgaggcgggtagatcacgaggtcaggagatggagaccatcctggctaacacagtgaaaccccgtctctactaaaaatacaaaaattagccgggcgtggtggcgggagcctgtagtcccagctactcgggaggctgaggcaggagaatggcatgaacccgggaggcggagcttgcattgagcagagatcgtgccattgcactccagcctgggcgacagagcgagactccgtctcaaaaaaaaaaaaaaaagaagtaaatatgaaaaatcacaggagccatgcacgtgctgggccacttgcttatacatttagagcaacacagctttctgttttggttacattcaatcataattacccactcctgtaggttgcctttttaatacatggaatacagcatccctccttagtcaccagccatagtatgttgaagggttcaaactcacaaacatattaagtttttttttttttgcggggggtgcgggcggcgggggacggagtctcactgtgtcatccaggctggagtgcagtggcactatctcagctttctgcaacctctgcctcccaggttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattgatttttaaagccacctgtataagctgttaaaatggtgaaaggaactttccagagtggaccagaaaagagtagcattgggaccagtagatgacattgcaaagagagaggtttggaggcagtttattaaaggttcttcctctgaacaataaaaaaaagtaggcggggactcagaaagtattattatgtgtgtttgctattgcagaggatcaatgaccatgcaacaagggcgcgtagattcttccattggtttaatgacagatgacttctaatctttcttcgtcctctctgattctgtgatttattgttaggaaattcagcttgtatcagtattctagtgagaccgactgcaagaagactctgagacaccaagtaatcaaattgataatgttgtttttctccaactggctgagcttcaagaggagcagcaaagcatggcataaaataaaactgtgttcagtccttagtgcaacccaattagttattacctccatcctttcaggggtgatgagttgtggagtgagctaacacacaagatcagattatcaaatcaaactctcagagatcttcttaactagtaccaagctttactaaataatctcaaggatacaggcagtcagaaggctcaagtgaagcagagaagggaagggcagccccccacgtcacttcttactgcctcagaaatgcacctctggcccagaatagatgaggtttatactggggtttgtgggtttccacacacaaaggggagcattgcaaatatcttcattttacaccccagagatttggatagctccattgacattctccaggaagccatctgtgcctcagagatcccgtgttctacttaccatagtaatccttagccagagatatcctattaagggcatttcagagataaggtctcttctgcctagcaaatagcattaggcttttcacctgcattgacaagaatagcagactgaatcacctctcttctaccatgctgcacccctgaaatgcctccttccaaaggcagtaaatgcattgctggccagctttttccttccatggagttattatcttgctgatccttaggaaagataaagataaacaaatatattgctgagtttctctgaaagcacaggtctctatgatgcttcatgaagtgaagttttttgattaaaagtttagtcagcaacttcctagaacatgtgggcagattttagttcttgttttattctgcttgcacactttgacatgcattgcctcgcaggatcatgactgggagggtggagaaagatagttcagttctgttataacttgggaagaaaaacagttccactgtctccacacacgccgcaaagattctgctgtgtacatacgtttgggtcaagtaattgagtgttctcatatgcaaatgaaaaaagcctcattcattgagtttggttttgtgttatgagactttgagataggaattttctttaggttaaagataatttaggtggctgtctcagtgctttgtatccaaaatagttcattctgtgggtacaagctatgtccactttaactaatttaaatttacccagtatttccatgttgacatctagatggacaaataagctgttcctaaatctttgattgaacttaacaataataatattgtactaataatgtcttaacctttgtagcatggtttagagtttacaaagcactttgacaggtgtagtctcttagccatttcaaggggttacagatcttccaaagcctgatttgaaccagtaatgggccacaacaccaagttaacccctcatttgaacaaaacttatggccaggcgtggtggctcatgcctgtaatcccagcactttgggaggctgaggcaggctgatcacttgaggtcaggagtttgagaccatcctggccaacatggtgaaaccctgtctctactcaaaatacaaaaactagccaggcgtggtggcgcatatctgtaatcccagctacttgggaggctgaggcgggaaaatcgcttgaacccaggaggcagaggttgcagtgagccgagatcccaccattgcactccagcctgggagacaagagggaaactccatctcaaaaaataaaaataaaaaataaacaaaacttaattacaggctacaatggcccaagcaaagagtatatgagcacaaccccttatatgtgcatttgcaaagtaagataaattaaaacatcagagctaatgattacatgagcctagctctctggcttaaagccccgttgtaaggagcctgtgattagtacaggaacaaggcttgtgattagtacaggaacaaggcttgggtttgtttttgtttttgttttttctcctacctttcatttttaaaatggaacctttccaattaattgtaatacatgaaataatgcatatgctaactagagaaatattcctgtgagcttgattaaatggtatcatgccaaagagggaacttgatggaaatgtcttttaattgtaaagccaggatagggattttttttttttttttagtcctgagtcacatacacatgttcaaggtcacttgtatcagaaatataagatctggaaacaaaacaaaattctataaatattatacagtgaacagtgttaagtctattgcatttctgtcatgctggttgggaaggaaaagggaaaaaatgagaaaagaaggggaataggaagaaaagagacaaatatggagggaataaaatacagaaaatgaaacagatactcagagaaagagtaatagggcaattatagaagaactttagaaataggagaaggaggttctaaagtggtactgaatcaactgctcttgtcacacatggttgctagttaaccccattaccattttttaattcctgttctttaaaatgctgatttcttctttgttcttcacctgtgctccatgagggctcctcagctggccatgtaaggagtcaggctttctaggacatgtgcctagaattaactccactttgttcaagggagccccaactaaaacttgattatgttacaaaaagaaattgtccgataagggtggctcttccctcatttgtcctcacagctaaatagaagtaagatgaagagcatcttattatttgctggcagatcaaaggctcccactgcttgagtctgaatccttggggcagccctgagcactgtttacataacgcagtccagtttaagtagaattacctgagtattggggaaaaaaattgtcatgttttaagcttgaatttttagtttgcaaagcaaatttacttatgaactatgtgtaattcttttgacttagatagcttagaaaatatagagcatactatttcttcatgaagcccataaacttttgagtctgccaacattttcattattaagcctcactttacaccaatcctgtctgctcaaatcaaatgtgtccatggacagctaatatgagagtgggagttataaactaggagcactgtatattaagttttaaaataaaaattgtttacagtttttagatttcttttgttttttacagccattatatgagacagatactggaagctctacgctactgccatgataataacataattcacagggatgtgaaggtaagtcatttgttatcactaactttaatgtttgtgaagaaatactgatataacaatgataatcaagaattcttctttaatattgtcataaagaacatcttaattttacttctaagtaaaaatgtatttaactgctttgtatttgggaagtcattgtactaattcttactaggaacactataatttcaatttatttatttttactgaagtgttcatgcaatctaaaattgtattatttctcttttgccattgtgtgtgagagagaaatgaaaaatccaataaataggaaaaaccaaacaatatcctatactgagttaattgggggggaaattagaatttggtttatatagtaaaagttaatcataacatattttcataatattgcaatgcagaatagtcagcattgtatttttttgcagatagtttttaaatatagtatgaaatcataattatacatgtaatacgattttatgcttggaataccggtattatcattattcagtctttctgcctatttcatcccagtatcgggttaatgagaactctcagttcctggttctttaacggtgtcaagccaaacatagagggaggcaagaaatgagaccagtaggccttcctcctgatccctagcttctcccaaggcccagaatcactagggagcccctgaggtccctttgaccctgggctacacttttaagctctgatattttgtcactggcctttctctaacctccagcatgcacatacatagtgttccttccctcaagatatattattaaaggcctggcttcttcgatgtatttaatactttaaatgattaagaaaattaagtagagtttaattaaagtgtctataatgtttgggaaattttcacagaaatccttgtagttaaaagctgagggaaaacatgagcaattccaaaaccatctagtaaaatattttaatagcaaatgaaaatcactggagaaatatacaaaatacacattagtgtaaattagttgtaaaatatctcactcatccttttcagatgtgttaagaaaatgatattgttattatcagaactcaacaccgagcatctcaatgggtccccctttatgaaaaagtattctggccaagcccggtggctcatgcctataatcccagcactttgggaggccaaggcgggtggatcacctgaggtcaggagttcaagaccagcctggccaacatggtgaaaccccatctctactaaaaatacaaaaattagctgggcatggtggcacatgcctgtagtcccagctacttgggaggctgaggcaggagaatcgcttgaacccaggaggcacaggttgcagtgagccgagattgtgccactgcactccagcctgggcgacagagcgagactccgtctcaaaaaagtattcttcagttatccaaaaagaaataaaagtgtggaaaggtaaaaggcgggaaattgtcaactgtagtagtttgctgtgcagttattttgcattaattaatgtaagaaagttcatatgtagagagtaaaatatatctctttgtatatattctaaactatatacaagaaaaaaatgataatttaaaaacctaaaatgtgttcatgtaatagcattatgttaagaactgttttgctcaagaggcaattttattttgaatgaattattctcgaaagataattatatcaacatcatataataaacaatgattgacaatatattctactgtaatactttcaataatgtagtcagcttttgattaactggtatttgatatgacaacctaaacctaattaatatccaaaagtagataatttgacctcaccttttaatttaccttctgatttatttatttaacaaatatttgagtgcctactttatacagattactgtgcttggagccctaaaagtattatggtctcagtagggagataaggctcggtatctcttatctactgtagcagatcaacacatgccaaaacatagtgacttcaatcaataactgctgcttacttgctcacaattctgcagtttgggcagagcttgataggactgctcaattctgtttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttagggctccaaaagagcaaaaatggaaggtgctaggcctcctgaagcaaactgacactgtgtcacatcttatgcatttcattagttgaaacatacttcacaaaaaggtcacaaggctagtctgagttcaaggggaagaaacatagattcatattttgattgatggagtgccagatatatacaaggatgggagaacttgttcgtggccacctttagaaagacaaataattattgtgcaaggtagaaggtgataagtatcattaaaagatgaggtcagagaagtttcctgggggaggtcacattggagcttgttcttgaatcatggggtagttatatggagacaaaaagacatttcaggcagaaggaacagtttgtgcaaaggcccaaaagtagtcttacgttggagtatgttagattagtttattatttctaaagtacatgctaaatagtttagaggaagcacgtagaaacatgccaaggaatgaaaaagaagtaattctcaaactgcaaataagtaagaagaaaccaccccaaaaattgccattgttcagttgggagacacactcaacacagagcacacgttaatgttgatattctttttttgtttgttttttgtttgtttgtttgttttgttttgtttgttttttgatacagggtctcgccctgtcacccaggctggagtgcagtggcgcaatctcggctcactgcaacctctgcctcctgggctcaagcaatcctcatgcctcagcctccagagtagctgggactataggcgtgcgccaccacacctggctaaattttttttgtagttttttgtagagacgaggtttcaccctgttgcccaggctgctcttgaactcctgggcttaagcaatcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattctcattctctctctctctctcataattcttggcatatgatccaaaagcattacatttcccaaggatcctgttattatatttattaatacttttttctttacttttttacaaaaggtatttccttttgtaatcattgtaactgagtcttaaaaggattatttggttagatttgaatatatggtaccatgtaatctatttttgggaactgcttgctctgaagaagcagtttcacataaaactgcataaaaagcaatcatataatcctttgaaattcgagagatgtgtgaacatagtgctgggcctccccacagccacacttagtgacatatcaggctatattctttgctgtgggaggctgtcctgggaattgtaggatgctgctaagcatccttcacccactagatgccagtagcatctccccctagttgtgacaaccaaaaatgtctccaaacattgctaaatgtcccctggggcacaaaaattgtccctggttaaggcccactgtcataatagactgttataattctcaagatttgcctccctacaggtattaattaaggcatgcatataaatttctatttttttctgtcatcttcttccctttaattctactttttcttgtgaaagaatgtgaaaactttcattatgtttctggtatttttttttcttcctctcacccctaaattaaaagtactttagaaagaaatagcacagttgtcaaggtaaatgcaactcctggctctttgccttctttcatgggctctactaagcactgagagtttgtggaattttctcctctctcctaactcttgcaggcagccttagatcatgaggttgtggggagacttagttttagacctttctgtcactctgacctactcatgtataattctaataactgaagttgaagtgaaacagtttctctgagaatgcaaattgctacccacaatcactttctattctgaatggtgcctgtgcccagaaggtctgggtgctgtttttagttcttagaactgtgcaaaccccagtcacacacacactcagccagaggccagagtgtttctgagtgtgcttcctttaaatggttttccttgctaacctgtgtgaacacgcctggctgctttttggttcccttctggtctcagttctccttttacctatttaaggccagactttatgataaatttgtgtttatcatataacactggttggcatgacattgtggatttcttaaagcattccgtagtctcttgttctccgttactgatgtttcttttacacctgataccacaactccccaaagtttatcatgttgtatagagaaatttaaattctcataaaacaaaaacgtatttattctttatttattttatttatttatttattttttttgagacagagtctcactctgtcgcccaggctggagtgcagtggcgccatctcagctcactgcaagctcaacctcccaggtccacgccattctcctgcctcagcctcccgagtagctgggactacaggtgcccgccaccatgcccggctaatttttttgtatttttagtagagacggggtttcactgtgttagccaggatggtttcgatctcctgacctcatgatctgcccgcctcagcctcccaaagtgctgggattacaggcgtgagccaccgtgcccagccactattctttattattatattaacattggttaatcttctgcatttcttttataagattttttaacataatgtgcacgttcagttttaatgtggcattttaataattgtacttaggaagatctcatggattacatgattattataaatttatcttgtgtttctaactgctatacttctctttgcccagcctactcctacaaaaaaagaaatcaactccttggttttaagtttctcagcctgagcaacatagtaagaccctatctctctctctccttttttttttttttttttgagatggaatctcgctctgttgcccaggttggagtgcagtggcacggtctcagctcactgcaacctccacctcccacgttcaagcaattctcctgcctcagcctcctgagtagctgagattacaggcgcctgccactacgctcagctaattttttttatatatatattttttagtagagacagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtgatccccccacttcagccccctgaagtgctgggattacaggcatgagccactgtacctgactggaagttgtatttttttaaaactcctaagtccagtgagattattacatgcagtatagcttatgttaaacaaacattactgtcttagtcggatgagttttggtctcaaaactcatgtaagaataaaactacttagtctgggcacaatggcttgcccctgtaatcccaacactttgggaggccaagatgggcagattatttgagctcaggaattcgagaccaacctgggtaacatggcgaaaccccgtctctacaaaaaaataacaaaaattagccgggcatgatggtgggcacctgtggtcccagctattcagaaggctgaggtaggagaatcacttgaccccgggggggtggaggttgcagtgagccagatcacgccactgcactccagcttgggtgacagagtgagaccccatctcataaaaagaataaaactacttttgtaactgtggagaaatctgtgcatctcaggaactctccctgatggactttgagttactctatgatttacatgtctagaaatcactagattggacacttccatttacagctagcattcagggcggtcacctcaagttcccaaatctcctttgtctctgcacattaatgagccaaaaatccaattactactataaacgaattgatactcactgtaaatatttgaagccagaatgtgttcagacttttctcagaacattttcatgtctcagttaagcatcaaagtagaaaaggaaaaaaaaatttactgggtttttgtgtgtgtgtgtgtgtggttttttgtttgtttgttttgcccccggaataacctctggtgatttttgaacacatggctcttgggcaatgtactgtgaattgcttttacagctctaactcaggaacaaaacatgctatgagattaaagccttggaaggattacgtgaacttactttaaacttcattttggacactgaagtaattactatgtgaagaaaaaaaggagtctttaagcagtctctaacaaagtggcaagttactattaatggttgattttattcagctgtttttgtttggttatctgagaagagaatatcagtaccatggaagtagaaatagacaagaagtttatagctccaaagtgcttatgatctctttgggcagatagtacacgcttttttttttaatcataatatatgtacttattacagaatatagtcaccatcatttgtctactgacaagattacatgaaagaaaagaaattaacattaagaaatgcttatctttaaatgttcacttaaatattagaaaaaattggggtgatttacttaactatgcacatatacatacatacatacatatatatatatatatatatatatatttttttttttttttttttttttttttttttttgagacagagtctcactctgtcgcccaggctggagtgcaatggcatgatcttggctcactgcaacctccgcctcctgagttcaagtgattctcctgcctcagcctcccgagttcaagtgattcttctgcctcagcctcccaagtagctgggactacaggcacacaccaccacgcccagctaatttttgtatttttagtagaggtgggtttcgccatgttggccaggctagtctcgaactcctgacctcaggtgatctgcccacctcggcctcccagagtgctgggattacaggcatgagccaccgcacccagcccacttcaatattttcatcagtaaattagtatactttagagttgtggtgattaaaataatatatgtaaagcatataagtagaatgcttggcaaacagcaagtgcttactaagcgttagctactcataatagtaacagctgatttaataataggatctgtaaataagatagtattttctgctctacaaatgaagaaattaacacgtacagaggataagttaatttgcctaagattgtccagctaaataaaaagtagagccagattgaacccaagaagtataacttcagagatcaatctcttaactgcaatactattacactcccttattattcattcatttatttcacaaaaaattaactgccaggtactgtttgtcactaataacattatttatattgaatacagaagaaaatatgcacaatgtgatgaagatgggcatataatgacatagctttttactttgacaaagcctaatccaaatatttaagcatttttataagtatcatctgctttaaaaatatagtcaatgaatattgcttctccccaataacatgagccagataatttcaaataaataatatgtttataaaaccttggatttttttcactgtattattcatgcatttaggtaagatgtgaatgaggatatttcttatttatttttttacttatttttatttttttgttttgttttatgagacagagtctcgctctgcctcccaggctgtagtgcagtggcacgatctccgctcactgcaacctccgtcccgggctcaagcgattctcctgcctcagcctcccgagtagctgggattacaggcgcccaccaccatgtccagctgatttttgtatttttagtagagacagggtttcaccatgttgcccaggctggtcttgaactcctgacctcaaaatgatccacccacctcagcctcccaaagtgctgggattacaggcgtaagccactgtgcccagctacttatttttaaagattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccattggaaacctttcaggaaatagatactcatgaaaggcatggcactgcacacaagtaagtttgcagtcacaaggtgtgacaggtagatgtgcgttgatgtttttttacctatttttgttaaaaatatccattgagagagagtgtttccaaaaacaccaacaatacaaaggaggatgtaaatgattggtaaagccatggaagagatcatagatggttgaatacatgttgtattgttgttcatttatgtcaggttttcttgaattttgtcacaggagctagaatagaattgcagatatttaatattaaaattatttttggtacagtatttaagctgaatagtttttaaaaaagaaaaacattgaattaaataaaatagtaacaaaaatgtattggatggaacgggaaagtatagatggcttcttaccttttctaatcacgattgtccggttgaaataaagacaaaaagttacttattgtgatggataatgcctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaacataaatgctggtttttacttttttctgtcttatatttaaatctttctcgcttcaaagggtacacatgaagtgctgaagaatcatatacaaactgcttttattcttatttttctccttatttcctcacttctttcaggtgagaataacaaaagttactggattctggtcaaataagaaccatgatctctattcagaatgtgccatattctctgtgttcttcaccatagccttctgagcaccacattctccactctttcatgatctagagcaaggtttctcaatcttctttttaatcatgttctcttttgataaacataaaaactgtaccatacacaaccctttgaaattcttatatccccccagcccctcagggcaattttactctctacccccttcagaattatggtttgatttattttctgcatcttggattacagaaattggggttttttttcaaatatgatattataattttataataactttttaaaccaatccacacccaaagtcttgaaaacttgaggactgtgcagtgtctgtgggtttaaataacaagattcttaattaatgtttaccactgtctttataattttatttctttgctatttttatttagaaaacagtccatatgcttcattgtaagtttgtatctgaatctagtgcaacctgatgaattataatctggtttcagttagtgtagaccctggtataaatatataaaacctaatctgtaacttcaccagttcaaaaatcagtcagacagtgaaatgagccagtttatttaagaaaaaattatctgctcacagtaggttttgattttacataaggattggagcttccttttatgatgctgttaaagaaaagcagtagctcctaccttgtgcagataatgcatagtatactaaaaactgcaaaggtaatggtgcttctgtatgaatattaaatgcttccaaacaaaagggacatagacttctgcagaggctagctttatcagacagaagttgagtctctgtaggactctcagtgtagcagtcaacaactaggtcaccatctttaccttcccaaacttgtatctactatgtacatctccttcaaaaataaacttggatcataaaactactagataactattttccagaatttggaaagtactattaagaaatcaaataaaaattacatgttacagatgcaaaactggtctccagaaaatgtctctaagtctatattcccctcaggagaatgtctatctcaagtcactcatgcatacattttgtctctgctaatttgacaaatgaaaaaagttctacaactcttaacttcagttactaatgactgtctacatagttaatatgctgactgcctttcttaatgatcagctttcaaaatttaaaccattaggtcctgtttatttttatagagtttaatttttaagctaaaaatgaataataatcactcttacctgtatgagtagtttatgccaactaaggttatattgttcagggcagtgatgccaaatttcagacttaaaattctctgatcttcactcttccaatatctttagtcagtgtgaatagattcttgcatgacaccaactacagtgggaggaaaaggggaaattaaacagaatattgaagaaattcaatagttatggtcaatgtggcaactgcctcctcaaaaaaccctcatttctctatttctgtagtgggaggaagtggtgaacaatatacatattatacttccttatgattatttcatgaactagttacactccagtaacctttgtttgcacgattgactgaagttaagttcacaggtttaatcccccatggccagttttatatgacacagtgatagaaggagccactctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattgaaagatagttgtaatattatctgttcaggcataagcgtctttggtccgaaaaaagaacgctcttgttttcctccattgtctccaaactcagtaaatgataccatcactccttcagttattcaagccaaaaacttacgaatcatccttaattcctctttctttcacatctcacatctaatcaattgctggtactacagcttctactatcactaccatcattcattagccacatttcatgagagcttactatgtgccagatatctcgctatgtgccttacatccaagtcttatttggttttcacaacaccctgtgaaatgtctcattttaaaggtgaggaaaactgaaactcagaaagatctcataagttgcccaaggtcacacagccatctgtcctcacaggatggtgattggctcacctcaaagcaactaattcaagaacaagtccatagctgcaatgcctttttgtgatctagcctctgaagtcaacagtgtcacttctgcagtattctattggtcacacagagccagccctgcatcagtgtgggacgggtaaatatcaggaggtgatgatcactgggagccatcttggaaactggctatcacagatgtcaatcaaccgttgaaacaaaggaagagtcagaagtactgcttaaaaaccgttgtcagtccactggttgtttattggacaagcatacctggataggtgtaagttttgccagttcttacactattttggtttttaggtctatttttgttaaacagtgtaattcattcaacaaatacttattggagtttctactatgttcctagcagcatgtggaggtcacagaagtaggatgtttagtcacaagctaattgagggtctctggaaattgagcagattccacaagcaagccaagaatttagattaatatgtgatacagatttcaaatgctctgtgaattagagaagggcagaaacagtgactcaaagtggttctgaaaggctttgtgaaagcaaatggaaggaaagagaggagaacataacctagtaagtgacagttttgtgccaggtatgggacagagcattttatgactaagaaccctagagatgtgtggtgggagtcccattttacacgggaggaaattgaggctcaaagaggttaaatagcttgcctagaggaatacaattagtaaattagctttaaaatgacctcattctctgccttagaaagaaattattggttgttctagcaggtcaataagggtaccttatggtactcacaatagggtcatgttttaagtatttttaactttgttcagatagggtttcctgttctgatttatgtatttgtgtatcctgttctagacttgaggtagcagaaactgaccatggaagaaatcaagtccagtttttttctgtctttgaaaactctggactttgttaagcaaactattattccaacaatggcagtataaattctttaggattcagtgattttgagttccccaattgaaatatatgtaaattttattttcattcttctaagaaattaggaaatattgttacaattggtaaaaagagtaaatgtcagggaatactagattaataaagtatgttacaagtattctgtaaaagtggcccctttggacttttctcattcaaatcaccaatagttttctttggttctcattcatcttgcccatccgtctcttcaaggttccccttctattgtccaagtccaaatgctcttggcctaacagttctagttgattcctgtatcatctgccaaatattgatctcctaagtgttctgctgtcacccttaggatttacttccttgaggtgttagagttatgtcctacaattgaagttctgtcttgtattaattttcctgcttttgagatggatttgtgtatcaagtgtgttttttaatctggccccaaaattcatctggagtggttcagtgagagtgtttcaaagggcaggcatatacttacctggcagaggagataccatcatcaaagggcaggcatgtggacatttattttggcaatccatggtgggctatacatagcaaggggacatgagagctttcctgactcacatggattgttggggttagaattagggtcccttatcaatttccctcagagccagaacccagaggacacaggacagcttagtcattcctgaagccatgtgcttcatctagaaattattttaggctatccaaactagtgtttaaactggctgcaactggcctcttaagtactctcactaaccaatcaggagctcagggcattgggaggctggtatgcagaaagagaagacatgactaatttagtacacattagaatatcatattcaaaagataattatttctttaaatcaggggcagtggtaagtaagccttgtccagttcaacatacacccaagccagtggttatctttaggaggagtgagacacagtgcagttactcaaagctatggtttgttcaaggctcactgagccccctgccctctccaggaagtggtgtctggccacagccttgtttccagtcacactgttctcaggccctcaccgcctgccacaagcagctctgatcgtgggtgtcccacccttaatcagagtgtgaagaaaaacctctccttgttctgaagagctggtttctcagcaagcaatgggagcgtttctctcaagaattacttttaaaaacagcagaaaatacagtctgaagtttgtaaatttataataacacagaaaagttatcagcttttgtaaaaagtaaagcagaggttcctcttcgaagactttcctccccatttaattaggaataaatagtaacttctcttagaagtgaaatttattcaaagacctgtgctaacattcttaaatatctgctagccgtgataaagaaatcaatgtactttatgttcttagctcccacaatttagcctaaatatttgccctggcatgcttatactggtgcaagcaagcattgggtcatagcctgttcctcttccttatttgcaggtttttacttttctcagcattccacaagttacttcctccttcttttgttctcctctgcctttgccttttttaagaagttctaagttgctagccaatcgggacagatacagaatgcgaggtcccgttccagccaatggaaaccggacacagcagtagggtggacacgtcagcttataaatgaccctgtctcctttgttcagtgtactcttgtggcaaaactgctggcgagtgtaccctttctgcaggaagtaaaaatggccttgctgagtaaattaaatttatgttcaagtggtatttctttatggtaccggggaacaagcatttcaaacgcttttaagaaaagactaatgacaaaacagaaatggacttggtgagttgaaaaacacatacacaaactcaaagggcattttcttattagtttgcatttccttgtgcatccagtgaaccaactccccaggagttggatccatctctaaattccgctagtaacttcaccttcagtaaccgattgcagcacagctgctgctccaaactgtgggtgaccacccaggaattaaaggttcctcatctcccaaccctttcatcctttgtcttaccaaaccacatgtttccatgaacctgaaccagggccattccagcaaaccccacttcattgacactgagaaagagtagagacaggcttggcttcagctcacctccactagagcactcccactgatcacaaaacccacaccactacctcaaatgctaatagttcttaaagaattccaggaattggccttatgagataactaagattgcctcaggaaggaatgctgaacaattgatttacagccttgttgccacaggccacgccaccaggtggcccattactcaagataaccatagcaaccagatctgctgacctgctttgctcagcccagcctgcatacccttcccctgttaccagttcctgcactttgcctaataagaaagccctatgactcttttcagaaggaagcccgggaattctctctctcttgtgctgcctcccttttgtttgggcataagctccagtgaagctttgtctatgaaagcgcttttggcctcatatcaatttctattgcattgagagtccaagaacccatgatcggtaacaatgccaattgagggtagaaaaaagaaaaaaaatcacacacaaacccaaagtgctttttctattctctcattcaacaagagtctaaacagatgacctctgtgaccaaatgtgtggggatttctcccaatgaacaagcaagcaagcaattcagtggacaccagctgtgtgtcctctaattcagttctattctgacactatctacctggagatagcgtcagatcccacaggttgaaggctgagtccccaagacttcttcctaccttcagatgccagtggcaagccccaggttgtttcacctgtgcttctgaccgacaggctataaatcaaagatcccacagcccctctttgggtccaattaatttgctagagcagctcacagaattcagggaaatacgtttaccgatttattataaagtatattacaaaggatacagttgaagagatgcatacagtgaggtgtgggagaagagagggacgtggagcttccatgccctcctgggcgtgtcaccctccaggaacctccacatgtacagctatccagaagctccttgaaccctgtcattttggggttttatggggacttccttacacagccatgattgattaaagcactggctactgttgattaccttaaccttcagcccctctcccctctctggagggttgggagtagggctaaatgttccaaccttgtcatcctgccttggtctttcctatgaccagccccatcctgaagctacctaggagctgccagaccgcagtcacctcattagcatacaaaaagacatcactttggagtttttgaggattttaggggttgtatgccagacaacagacgaaagaccaaatatatatttcatagtatccagtccaccctctgtcttggatccctcacatcaaaaggatgtacaactcaaaagataccgccaaattactagaatctcattcaatcagtaataatcagtccagcccatcatattgtatgaatgtctcccaaggcgaggccactcaggtttgcaggcttccattcagtcttgtcagagtgctctcggcaaacatatagcttcaccctttacagcagctggtataattaagctaggagacagatatcatttcttgctctaagcctctttcaaggtattaatataatactgggtttctttcatttcataacccatttattctttactctcactactatttttccttatctctataaactcccaaacttttccacctttggatgggacaatagaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagccccactcatgttgaatgtgagcacacacttgcgaaggcaaataaggcagctcttcgtgctttcatctccctctgttttagacaaccagtgttttcattgcctgttccactctctatcaaaccgttactctgaggaagatatctctctgcccattgctgaacattataggctatataatgtgttcctgggtctgaagaagtgacagccatccaaatctgtgcaatatcttctgctctagcttttatggcactctgagcaaactattattctgagaagaatatctctgcccactgctggaacattatgggctgtaccgtgtgttctttggcctgaagaaatggtgttcagctctccaaatatgtgcaatatcttctgttctggcttttttatggtattctcatcattcacatcttccaccgggcaagcaaagcccagtccagaatcagtgtctactcctgtcaaaacccatttgtggcctcccagggctaccagcatcagcctcacttgccagcttgttcagggctttcccaccagggaaatctgccccacagccatgggcaatgtctgtctcttttgctggcagacagaacagtttttattggcattttgtgcctaagatggtgcaaaagaaacatgtctaaatgcagcctatctctgcactgttgcagtacccgtttatccactcatttcacagacccaggtggccacttcaagggagcacccagggttgtctgcttgtgatatcaatcactttctgaaccaggatcttttttttttttttttcaagtcagagttttgctcttgtctcctgggctggagtgcaatggcgcaatctcggctcgctgcaacctccgcctcctgagttcaagtgattctcttgcctcagcctcccaagtagctgggattacaggtgcgcaccaccatgcccagctaattattttgtatttttagtagagacggggtttcgccatgtcggccagggtggtctcaaactcctgacctcaggtgatccacccaccttggcctcccaaagcgctgggattacaggcatgagccaccacgtccagccaagaaaggagctcttctgatgggcattgacatgttctactttaatgcactcctcaaatttccatagggccattctccatatgggcatccctttaataaataggccaggtttccactgcccttctgcctgaccatgtggccaggccactgagtcagtaaaaaaatcaaacacaggggtttttgctattgttcatttctgcagaatgcaattcagccaccaagctaatttggtcttaccttctttgatcaagagtggcatccttccaaacaagattgttcaccttggaactgtcatttacacaccaagcaactctttgttggtcagttgagagctgtttacggggccctgtccaagtctcagtagaatcccgcagttcctcacacagttccagagtcagtcctaggggaaaagaggctccctgcatgagagtatttcctctttgcacttcccagggaggatgctcctgtataaaccatttccattttattatggaagtgttctgggcactgccatccccatttgaatgtttctctgacatcatgtgagaaagcatgggtatttcaggtgtcaagatcattttatgtccttcagtcataggggttaacttcagttaatgtcccatagcaaggtagtaaatacccccaagtggaaattctctactgcaaagtcccagtagttgtcactgggagatgctcacagacttctgagtaagccccagtaaacgctgacaaaggggtagcaaatggagaatttgtccctatgatattccagcttctattctacagattgtgggcttgggtaatcttactggtttgccatttagcatgttcaattaatattgctacaagggtgttttacaatacaaggtaagagaaacattccccagtcagacacaatatccccataatacagtcaagtgaaagagatacaaccacttcatgtaaagtgtgttcaaatgtaccaacttaccttaattttctcaatgcttactttcctaactgtagcctctattacgactttaccaacaggttttgagtttacagtactaggtaggggaagtgttccccacccagacataatatccagttccatcaaacattcaggtaaaggagacataacttctttacataaagcctgtttataaacattctaaatctcgtattcctaccaacccttactttctgtcccagtcccagaatttctcttcttcactcccagaccattttaccattttctccttagaaaaaagctttgaatccccagcagagggttgagccaagggaccttagcccttttgtcaatctttgtcttgattaacctgcctcaacactgctccaagtaattgttggtcagctttctcattgtaatctcttcctctcattttttcaatttctcctaactgggataaatacaccaaacctgtttggatcctcttaccgttaggagaacagcagaatctccctaccaaccttctatagtgatgacctttgttttaaccccatcgatttccactttattcatcccattttttaatagccctctaaagactctaccctgcttagatgagtcccatgactctcctttctttttcctcttagtttcaccccatcaatgttttcttcattcaccttatttctcaataaccatttagactttccaccttcctgggatgagtcctgtgactctcccctctgcctttccccagtctcttgttaattacgctcatgttttcattggtgcccatacaaaagaggctcccttagccatagcatttactacagccagagtaatggatgtattcagtgagtgaatatctcagtcatcataaagccagtcccacatggtctacataggaagcaaatgagctgctgcttcagggtacaccacttggcatttataggtgaaattggacagtccccttctcagggtaaacaggtccagtccaccacgctggccattcccttggaaataacctcctgtgtgtctggaaatctacctttccatctgtgattgttcaataatgaactgcaggtcctacctcaaccaaacatgctcttccactcttgagcatttaaaaccaaagaaactgctctgacagttccttcacagtataccctccagtttcaatagtttatcagttttaccctttccccacattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagggctattatttaaactataaattaaattccttcccaaggctagtttggcctatgcccagtaatggacaaggacagtttagaggttagaagcaagatggagttggttaggtctgatatttttcactgtcataatttccttagttacagttttgcaaaggcagtttcaatcgtaaaggtacttcagtgtccttgcataatttttccttgggggtcagctttgaggctagtggcctgggctcagacagacaaagtctaacctagcattctcctttaatttcatttagctattagagataaacaccaaagaatttagtatttcactttttcatattagtctgcataccctcatgcaaccagtgaaccaactccccgggagttgcatccatctctgaattccaccagtaacttttacctttagtagctgattgcagcacagctgcagctcaaaacagtgggaaaccacatggccacccaggaatcaaagattcctcatctcccacctttttgacgcaggatttttcttggccactttgccaatcagggacctccatggccagcaacgcccccctacctggcctttgcttggccatgggcctgctgaggcgtcaggcccactcaccccacctgtgctatggcttgtacctgcgttcagcagttcccaagctcctgtccttatccacgaagaatgaggatacgctgacaatttgaagggtgaggatgggtagggaagaattttattgagcagcagaacagctttcagcagagaggggacacgggtggcccccccacccctgcagtcgggtggtttgtctctctcagtgtggctgggtccatggtattttatggattcagaatggggcatgtgtgctgattggtttgtgagtatgcagaaaaggttaaagcgaagacaccactcaaaggtgggcacaacagtgtagaaaaccaattagggaagggtaggtatatgtaaaataggtgaggggcggggatcaatcagaggaaagcacaccaaacaggaagacaggttctcaatccagtccatggatttacccgggacatgtaggtaggctttaaactgtcttcagcttgaaggtcaatttcactgaggactcgcccctatctgtctaggcattttgtctgcctcctgctgctgtcactttcattctttctcttcccaaaccacatgtttctgtgagccaagtccattctagcaaaccctacctcactgaaaccaattcatagtttggaaggaaaacaaaactcacaaagtacttttctactctttcaacaacaattaacacagatgatttctgtgaccaaatgtgtggggatttctccccaaccaacaagcaagcaagcaattctgcagttgacaccagctaggtgtcctctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctcacagaactcagggaaccagttacatatacccgtttattataaaggatacagatgaaaagatgcataatcctggggcacggagctttcctgtcctctctggacagaggcaccaccatctgggaaactccacaagttcagctatccagaaactctccgaacactgtccttttgcggttttatggaggcttcattatgtaggcatgattggttaaacgattggccattggagattaatttaaccttcagcccctctcccctccttggaggttggggatggggcttaatgtcccaaccctctaatcctgcctagtctttcaaggctaccagcctcatcctgaaactacctaagggttccagccatcagtcaaccattagcatacaaaaagacatcattctggagtttctaaggattttagcagttgtatgcctggaaagagggttgaagaccaaatatatattttatagtatcacagacctgatcatcaaagtttcactatccttcagctttggcttttggcttttcatataagcttgagtgtgctggctaaacattgtcttttaggaatgcacagcatagaaactctagcgacttcagtggcagtcataagaactggaatcatttcaggggtggtagttgaaaagcagacaggaaattagcaggtttagaataggggagaaactttagcattgaattacgtgaggcaaaaatatatttgagggacaaattttgaattttgacatcttcaaatcagtcaaacttggttcatattatgcttcagaactaaccattcttttctgtagattctttaaaaagccaaaagtagataaagatttctatgaataaagcagttgaggatagaattccaaaaataatgctgttccattgtatcaccccaggtacaaaacacacacacacacacacacacacacacacacacacacacacacacacacaaaatctataccctgggaaacagtgacttggattgcagtgagatttagcgaatttaaaaggcatcatatatcagtgcccagaattctccacttcactgtctctttctagggccaaggtttcctggccattttattaccaatcacttcttttgaatttctagatacaattgtcttaaggtgaagtcccctgctccatgtaacttcctgtccttaatcaaggggaaaaaaagagatagatgtcaagggaagagaaagaagaattgaatatctcatgtcttccctcctatacccattagtgtctgtattcattttctcttaagcgccccaagcatgaaagtcacaggtttctctgagaaccacatttagaaaattaataataataagtgacagccactgatctgcttttatatatatattcatataattttagaaatatctctgagatagattctattattactgtcactttctagatgatggatgtgggtccacagaggataacttgcctacagtgataaaactgctctattataaggtctagatttgaacccagatagtctgactttagagcccacattctttactgttttatatggactctcataatatatgataatactcaatagaatctagtttattgctttaaataaggagaccagctatccccaatgaccaaaaatatatctcatttatgtacttgtttccaattttcaatctcgagatttattaactcctgccaactctccactgtaaaggtaccctgttttcattgtaattgataagtaatctgaaggtgatattttaagactctatgagtatactgtgtttccctttcacccactggattttgacattcttcgatgattctcttcttgcctaaatcagctgtttccttggtggtggcatcttggtaatcttttggtgaatggatatattagatttgaagtagtccttttaagacatcttttggtgagtggatgtattacatttgaagtagtccttttaagacatcactctaaacaagtcttgttgttttatattatttctcaaacagcactgtatgtggcatagtttctaatattttcatgttgcctcttcttccctttcctctatcaaaagccagcctaaaaatgtatggttttaataaacctacaaataaagtattgaacttggaagtataagttctctagagttccagaaatatctggagaaaaaaaaaactggaaagaagaaacctgcgttaaattttataataacactgaaaaaagtctttaagagggtcacttttttaatagtgccttggccagcagagggtaatatattaccagccctagttaaaccacttttgctgacgcataaactgcccacattgcactattttccagctagaaacataaagcaatagaaaagtttggggattttttgaagctctaatacaacaataaatttcttttagtagctgaaaaccactttacacatgatagaaaaaaagtaattgtatagacaatggatttctgtccttaagatgaaagcccggtgccactcatctgcccttaatagggtatgtcctttagggatagtttttgttttgttttgtactagtgattatcacaagagttacttttgtaaagtattcacaactacagttatcctagtggtagaaagaaagtcttacatttcagtatgtgaaagtttttattactgtatcttttagtttttctttaactttttttaatcatagaaattgatggacatagttttaaaagtcaaataacactgaaaagcttgtaataaaaacatgttatgtctattaataaatgtaatttaaagtattttcacctaatgaagacagtataggagaaatcacctctatcctcgactatagtcacttcctcctgtcagtgtaacaacttacgctacatatcccttccacttaagtggtaattttttttttttttttttttttgagatggagtctcgctctgtcgccaggctggactgcagtggcgcgatctcggctcactgcaacctccaactccctggttcaagagattatcctgccttagcctcccgagtagctgggattacaggcacgcgccaccacgcccagctaatttttgtatttttagtagagacaggatttcaccatattggccaggatggtctcgatctcctgacttcgtgatccaccaacctcagcctcccaaagtgaagagatagcttataataaccattccctctttattcagctctcttcatcagggggagcatgtacttgtttttatctcctagaacaagtggtttgttactaaatcttcagcagctccactactccctgcccttcattggtttggaaggtacattctgtctctctctctttctctctctcgctctctcatgcacacacacaaagctttcaagtaaaataactcaaggcattgtcttttttgttaaattactatatttattgtcatctttttagaaatcagtgctacacatattcttcatttatattttttatgcatcatttatctattgctgcatacttaactacccctagacttggtggcttaacacaagaaccatttattcactctcaattctgcaatttgttctagactcagctgggtagttctgtttgtctcacctggtggtcattcatgcagcttagtcatctgtcagctcagctgaggctagctggttcaacatggcctcactcacgtgtctggagcatcacctggaagagttgagcaggctgtgcccctctctccatgtgatctttcatcctgggcttctttacaatgtgatggtctcaggttccaagagggcaaaactggaagctgcaaggtctcttaaggccttattcaaatgtcatacaatgtctaccacattttattggtcaaagcaagtcttaatacctgcccagattcaactgggaaagtagactccacctctggatgagaagagtggccaggaattgggggcaatttttaatctaacacatttccttggatgtgctttcaactttaatgttctaactagacttgttatattttctccttgaaatgcagtgaattggctctttctttagggattactatagtatgtgtatctcagagttcgtagtttcctgggtaatattcctaaaagaaaaggaaattttgctttgtgagagatacccaccctgtcccactttggtcttggagctgtcatgttgttttggttgtttcttgtattaaaaggtatattcagtgtgccatgaatccagctgggtacagtggcacttgcctgtggtccctactacgtgggagactgaggcaggaaaatcgcttgagcccaggagtttgaggctacagtgaactatgatcgtgccactgcactccagcctaggtgacagagtgggactgtgtctctaaaaaaaagtatatgtgtatatgtatatataatatgccatgaatccatgatgtttcctttgtgctttttatcttctataaatcctctccctttaccttctctttccagaatattaatctaacttttcaataaaaccagaagaaaagtctgttgctcttgcttcccaatagctagtttgatcctgagagctggataagttcattgacatcttcaataccagagcttaaaaggatgtagaaagatgattagtctagcatggtggggtagctttccctcctaccatgcttattccctcctaccattattcaaggtttcattattttcaggatcataaatgtcaaactactgggccatgagacttgcattcacttacttagctgcatcctctccctacttgccacatctttttggaaccctgtaatcagtccccacaagagctgaccctgtgtgttcctgtgtttttcaagtttcactagccacaaaggggaactgaatatgaacatgcatgcaaacctcaccagttccctttgcagccagctgaaagttatttttcatgtagaggaaacagtgtttttcttttgagaacaaactgaatttccacacaaatatgaagtgtttcatcttctgacagttcagaggacccaagagaagagggcaccaaattgtgagaaaggccattaaaagagaaactaggaaaacaaagagacaaactgaattggggaagagagaggtgctgctgagtacaggaaaggaaaaaagcagaccacggggaggggtgccggggtgctagaaagtctcaataagtaatggcacacaggacaaggcaggaaatgtaggaaggaactgtctgcaaagggcctataatagctatgccagcagtattaatggaaggcattaagaacttttggtttagaaatttgctgttggacaaaatttcaaaatataccacatttacgtgattactgggcctgcctgagttcatgctatggagccaggtttagatgaaggtgccttgtcctcacttcagaatgcaatatggtgacctgtttggtgtctctgattagacggagaaaaaccaagaatcagatatgtattaacatctcttctaattttttttttttagaagatctctgtcacccaggcttgagtgcagtaacatgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgcaaattaaaaccacaatgagataccatttcatacctaccagattggcaaaaattagtaaatctgataaaaccaagtgttggtaaggttgtgggtaaacaggaactcatttctgccttgtagtgagatgggcatataaattggtaaaatcactttggaaagcaatttgtcaaaactgagataagctgaaaatgtacatacccttacaaccaagcatttctgcttttaggtgttagccataaacttcacacatgggcattgggtatacaaaagaattcacttgagcatggtttcaattagtggaaaaagtggaaaccaccaaattgcccattgttaggggaaatggagaaatgaaccattgtttattcatgcagtaaaacactacatcagtgaaaatgaatgaacaagacctacatgagtctacatagataaacaaaatttgagtgaaaagagttacaaagaatgtaatagtaagataccatttgtgtaaatttttaaaagaaaaagtgcatattgttatgcatatgtatgttgtaaaagcacaaaaatatacgtcagagtgatatacaccaacttcaggaaagaggtttcctcagggaaggatgtgaagtgagctttaatatatctaacattttggatgatgtatacgggtatgaaaaaacttttaagtaaaacgaaaatgttaacatcttttcaattggggtgatgggtacttagctgcctgttatgttgtgtttttccatttttgtatgtttgaaacgttttataactaaaaactatttatatgtgaaattaccaaaaaagaatataagtgtaacagttaactgttgctcccaaaaaacttgcatgacttattaaagcaaaaagagattccatgtatcatcaacacctgtatccaaaccataattagaaggcctttccatcttctgatggttctttatgcatttcatgggccagaagcaaaactaataagggtaggatgctctaatttgattccattttttttcttctattcaacctgtatgagtttgttctggattatcgtacatgtttcagagagagcttccagagtatataaatgtgtgatggttagaagactagttttaaagattgttttttgtttttgtttttgtttttgttttgagacagagtctcactctttcatcaggctggagtgcagtggtgcaatctcagctcactgcaacctccacctgccaggttcaagcgattctcctgcctcagcctcccgagtagctgggactacaggtgcgtgccaccacacccagctaatttttgtatttttagtagagacggggtttcaccatgttggccaggatggtgtcgatctcttgacctcgtgatctgcccgccttggcctcccaaagtgctggaattacaggcgtgagccaccacgcctggcaaagattttgtttctttggcatcacacaattatgatgagtggtaagcagaaatttttgcccccaatacatattaatggcaatttatgtttttttattttattgtaatttatttatttatttatgtttttgagacgaagttttgctcttgttgcccaggctggagtacaatgacacaatctcagctcaccacaacctccgcctcccgggttcaagcgattctcctgcctcagcctcccgagtagctgggattacaggcatgcgccaccacgcctggctaattttgtatttttagtagagacggggtttctccatgttggtcaggctcgtcttgaactcctgacctcaggtgatccacccaccttggcctcccaaagtgctgggattacaggcgtgagccaccgtgcccggcaaagattttgttttttttgacatcatacaattttgatgagtggtaagcagaaatttttacccccaatacatattaatggcaatttatgttttttaaaataaaagacatctcagcaatcaccattgtgcttggacagaactaaacaaaagtgaaaagcattagcagagacaatgtcagtagaatggaagtctaccaacttgcatccctacatatgtaaaatacagttgctgcttacatcacaatgccatgaagattaactgatgataatgcatgggaagcacctagaacagtgaagggcacataaataaacaaatgttactttgcttcccattcccttgcatgtgaacttgaagtggggaaataaaaggaaaaatagaagtttcgaacaaacttactacctcctttccagttctgtgctcactgttaccatccccaaccagctctccaagtcttcatctgaaaacatggactgactgaggcactatggcagccactcagctgggccatgtagctatgacagaggacactacatcatccaacatgggaatgccgcatagtttatctctcgtctgagttgacataattcagattatattccgagtttcaaatcttttcttccgattaaaaatacccctacaagcctctttacaagtgaagtttgtttgttggtggctgaaataaaaggctctccagtaaatgtcatatctgttgtgaatatttttcctgctttgtacttttgcttcagtttttatggtttgggacaaagaatctaaatttttaagtcaaatctatgaatttttccctatagttatttctattattttgtttgaaagttctttcccatctacagatgaactagtcattttttaatcttttatggtctcattatttacacttaattcttgagtgtccttataaattttggggtatgataaaaggtaaggctgtaaattggccttttattttaaataggcacagcactattatttattaatccatcccttccttcctgatgctttttgtgatgtttcctatatatgcagtgattttctctgagggaggagaatgtatgggggtcacctgagctttgcaaaaacacacttaaccccacctttgcaagattccagcacatcttgactaacaggaaccttttttttttttttttttttttttgagacggagtctcactctgtcgcccaggttggagtgcagtggtgcaatctcagtggggcatggtggctcaatgcctgtaatcccagcactttggaaggcaaaggcgggcggatcacctgaggtcaggagttccagaccagcctggccaacatggcaaaaccctgtctccactaaaaatacaaaaattagccaggcatggtggcacgcacctgtaatcccagctactccaaaggctgaggcagaagaattgcttgaacccaggaggcagaggttgcagtgagccaagattgcaccactgcactccagcctgggtgacagagtgagaccctgtctcaaaaaaaaaaaaaaaaaagtcatatacgtattttgtacttttctcatatatcatctaggatctgcttagacatgtgtattcagttccacagataagtttatccttgtgtctgctccccagtgttatccttactgaaggataagaatatattttaatatctgataaagtattatattttgaaaacctaaaaaataattagcccattaacatgttgctgcagcatccaggttgcttgttgggagaactctcttcatattgcttttcttttgtgggataactttcagtaagtctttcgttcaaatagttatattacctctacttttatgtcagcaggaataaagaatccattttttaaagttgaaaataaaactgtactggaagaggattgtctttttctactgacctaatcttagaaattcaaccaccatcaaacctggctctatacagcatacttttctaaaactaacagcaatattcaacactgaggtctcactctgacagccagacaattcattttgcccatatttggttttgcatgtatgagatgttatttagaaagctgttctgaaggtctttgcaaggtaaagatacgtatatacttctgaatttccttttcctgtatgcttctagaactaaaccttgggttaggagaggtaggaactgtttcctgcttgcaaatactaatgcttagtaagaaatgaaagattatatgtcataagtagccttaactttggtaagacagtagcatattttttctaaaaatttagaaaccttctcaggattcaagttactctaaggcatgttatcagatttctctcagtaagcaatctgttataaatagacagattgatttatatcaaaatgtattttattccaaataatatagcaataattaattgagtatactttaaaattttcttaagaatgccattgtgcagagctttatagtaatcatctagtataatgagacagcttctagaactatgagtgtatttatattcattttaatgtcccttaaaagtgataataattgataatataatttcaccaaactgtatacaatgagatatgtaagatgtttaccagtaatgtaaaataaatttttaagtttgaggacatgaaggaaaatagaagttttcataacttaaaaccatacaaacagaaatgctaaatttcatttagatggtatgtgttaacattgtcagggcaaagtaattaatataattttgtcacctttttctgaccctctaatttttctgcaaatttcagtatttatcctcaaatattacttatttttaaaatatacttttgctttgacttattctttattcagttaattatatttgcgggcacttattgaaatatagttaactggccgggcgcggtggctcatgcctgtaatcccagcactttgggaggccaaggtgggtggatcacttgaggtcaggagttcgagaccagcctggccaacatggtgaaatcccgtctctactaaaaatacaaaacagccggtcatggtggcgggcgcctgtaatcctagctacccgggaggctgaagcaggagaatcacttgaacccgggagacagaggttgcagtgagctaagatcacgccactgtactccaacctgggcaacagagtgagactccatctcaaaaaatatatctatatatagttaactgagcactgtatacaagccaaatctcattaaaataaactcagttctgatcaaaatcttcatggtcattcacattgatttctcagccaatggcctaccttaagttttaagaagtattctgactctaaaaaaattttatacaccatgatagaaactttcagatgagtccttggagtttgtcctaagatgcttttacataaattcagtcaataacattcaggttctgtgtatgaccaaagaactggacaaatgctggccaaactttcaagaatgtttgcctaatgacaccccctagattgcaactgtatggtgttctatacagctatattcaaatggactaggaaaaaagctaattactcccaactttttttcttgtaagcaccccttccttccctttctccctatcttattcatccgtccattcttcttaattattcaataaatgtgtattgatctcctatagccaagaaacatactaagctccagggaggcaatgacgaacaagactaagaccgctttcttttagagcttgctgtcctgttattttttaatgtacatgaaaattgcagagtttgctccttttaattctaatttgcaggtttttattgttgtaaagtatttcaaatacccaggagtttaccaaaaataatataatcacgtgcctactacctagatttaagacattaacattttgccatatttgcttcaaatttctccagatataaccattaagttggtatgtatcttgtatatattatcatacatgttttgtatctttattttatatgtattgatccataagaatgtggtattgttttctaccaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaatgtggtattgttttatgtttttatattttacataaatgatttcatgcagtacatacccttttgcaattttgtggggttttttttactcaacattatatttgagatatacccatgttgatgcatgtgagtgtagttcatttcattgcatcgctacatgatattccatttcgtgagtaaaccagttcacttctccatgcctttgctgttatgtccttatttccagttgtttcgtattatgaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggttttgtgaacaatttctttccagtagcaagatgatacatttagctgtgaagaaatgtagatgaatcgaaaggcatgatagggaacaaaacatatagtaaaaatgataagtacaataaaggagttacgagctgtagtggcatatttaccagaattaggaaattttgacctccttttagaaatcctcaatagattcttcccaatcttaatatatgaaaggattattagtaagaaaattagccagaacattaccacaagaatgaagttaaaaatggcttctccttttgcgttatgcttatctctgtaatggaaacacattgtggaattatgccctcctttcttaagtgttaaaataatcatagttaggaatccaccaagagcaagcatccatactatacaacagacataaatactttgtttggttgttattgccttccgttgctgtatagaccgattaatttttatatagcgatccaaactgatgaatccaagcaaaataatgctaatgtacatgttcatataaaacagtgttcccacaaccttgcacagaatcacacctagtgtccacttgttttggttaatatgatacattattcggaaagggaggcagaagatgagtaggaggtctgcaatggctacgttaagtagataaatttgaatggaatttcttttacggtgaatacccagaaatacatagagggcgattatgttcccaaccagtcccacgatgaaaataacagagtaggatgtggttaacacagtagatagcaatttttcatccatgggacaggtagtaacatttggtgttgctgagaagttttgtggcggttggtcgctatgattggttataaagcgcattctgtgggaggagtaaggccagctgctgactgaagttgtcgtcattgttatggtatgacttctcattgtcttctgtggagatcaaaaagtgaaagtgctaaatgacatattcctcatgtgtagttcttatgtcttcagatttttcctacaacggaatgccaaacattgagtcatttgctattttaataacagttactttaactaaaagtgtaaataataggctgggcttcccagcacacgcctatggtcctagctactcgggaggctacagcagaaggattgcttgaacccaggagttcaaggctgtagtgagctataattgagccactgcactccagcctgggcaacagaacaagaccccatctctttaaaaaaaaaaaaaaaaaaaagacagtgtaaataataaatgatttattttcagacattgcgagaaactttacttttatcctactgtatgtagtaacattattgtatcattaaacaagcagcacatagtgtggtatctcatggagtttcatgctctaacctttcctgtggccatggcctacattgaagttctgtttcatgtattatattaaaataactcaatttatgagatcatcttctcttagggaagttcttatgggaatacagatggtggtgaagagaaatgacagctcatatttctcaaagatgagcatcagtttctctaaaggtatgtacagccataagagagctgggcccactgctggccctgcccagcttcagaaccacttcctgccttgactttttccctcatatgtggcattcattcattttgacatgtattgctacatggcgtgtgacttgtggtggtctcattctataagtgggaataaagaagaggatcctaaatttcttttcagcctaagaccaaggtaggggtcttagggcatgcaattaacataatagactaagagaatacagcacctgcaaggttacacagactcttgtatcactggacaggagaaaaaagtaaccaaacaaaaccaagttagctggcagctgccagttagccactcctaacctagaagcatagagtaataacgtagatgggaaacagcatgtgcaatccaagattttgaaagtaacctgaccaaagcttaaatgtgccctgggttcaataatttgagacttgctagaaccttcgaagagatagtgtttgaattctacttgtttgtggcagcagagaatatttgcaaagctacttattattggcccattgactgctgtaaagagcttagtctgagagctggtcataacaagtaaagaaagcatttctggaggtctcatcacattcctctcatagagtgactgccctatttctctacagcagccacttagcagggttaacataaagatgcccagagcaaggttctcaaaatcagacccaactaacttgtgaccaagggcaaataacttaatcttttctatgccttagttttctcatttgtgaaaatgaaaaatgcataagaagaacttaatcctggcacatagtgactgcttaataaaagttagctttaataaacaccttttgattaatctcattttagtaaatatctcacacttggctaagtactgtgtgggaaaggaaggtgaataagacagagaccctattagtaaacattttggaggagtggacattcaaaccctgactgctaccatgcaaagtggatttgaattacataaattaagtccctgatttgatcttatacacagagaaaaatagcctttcttaaagctctacacataatttgattaaaaacaaagcattttggtagagggtaacattaagatttaaaatgttgtaaagttggggagcattgattccacagaagaggaactggctggtgaagaggaagttatgtaatccctggtaagagcctgtttccagaattcaggaaagtggagggagaaaggaagggagcggggaaggactgagtctagtctgtcatgtgtctcaactgcaggaagacaaatttcagaaagtttatagaaaggtataggcatgtttcttgtgatctaagattctggtttttgtttgtttgtttgttttgttttgtttttgagacagagttttgctcttgtcacccaggctagagtgcaatggcgtgatctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaaggaaatcatttttttctaatgaaatgatctctcttgggaggcaatataaggatcttaccactggagatttttgagactaccaccaattgggttctttgtagaagggattatcagtggttctcaatcctggctgcatattagaatcctcttgagggttttttaaagataccagtgcttggctccttccccagatattctgatttaattggtctggaatgggtttcaggcactggtttcctttaaaagctccttaggggattttaatgtgcagtcagaattgaactcttaagctagatggccaaaccattaactaatatttatttagtactttctgtgtaccagacactgtgttaaacacatttatattacttcctttacataattcttgcaatactctgtgaggtaggtatcacaaaagaggtaatgaaagatcaaaaggttggccaggtacagtggctcacgcctgtaatcccaacactttgggagactgaggctggagaatcacttgagaccaggagttcaagaccagcctgccagccaaggcaacatagcatgaacctgtctctaaaataaaaaaaggaagaaagaaagaaagttcaagaggttatgatctttactcttggccacacaactctttttttttttttttttttttttttgagacagagtctcactctgtcacccaggctggagtgcaatggcatggtctcagctcactgcaacctccgcctcccgagttcaagcagttctcctgcctcagcctcccaagtagctgggaccacatccagctaatttttgtatttttagtagagacggagtttcactatgttggccaggctggtcttgaactcctgacctcattttccgcccgcctctgcctcctaaagtgctggggttacaggcgtgagccaccgcacccggcaggccacacaactcttaaatgacagtgcccaagttaggactcagatctgacttttagagcccatgatgcttttcaccaaatctcactccttatcacatagggtcagcattttctttattaatattgagttctatcagcagtattttgacatgattcctttaacatacactttaacaattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctctacaaaaagtataaaaattagcgggtatggtgacgtgcgcctatagtcccagctactcgagaggctaaggtgggaggatcgcttgagcctgggaagcagaggttgcagtgatcctagatcactccactgtactccagcctgggtgacggagtaagaccttgtctcaaaaaaaaagaacataaaaaaaaaaaaaattggccgggagcagtggttcatgcctgtaatcccagcactttgggaggccgaggcaggcaaatcactggagtccaggaattcgagaccagcctggccaacatagcgaaaccctgcctctactaaaaaataccaaaaaaaaaaaaaaaaattagcagggcgtggtggcacgcacctgtagtcccagctactccggaggctgaggctggagaattgcttgaacccgggagacagaggctgcagtgagctgtgttcatgccactgtactctagcctgggcaacagagcgagagtctgtctcaaaaaaaaattttttttttaattaaaaatcacaattacattctgttttaaacttggtgactgtttttttttctcctttgaagttggttagtacattacaatgtcattcactatataaggctatttactgatattttttaaactacctgtttgatatgttaagaattgcttgtgaagacaagaaacaaaccactgtgtttacataggggattaatttcccagtgggcattacttgtgacccatgtgctatattgaagtggtcacaatagttttgtaatagtagatagtgttttttaaatgttgttacttggcaaatcctattcacaagttcaaaaacctagtattagtgcattgtacccccgcaccaccacctactcctgcagttttttttcaactggctcatgtaggagtactggacccagagggcaggacccaacagattccactgtgactccagatgagcagaagcttttaaaatgcagtttgggtatgtttgtgaaaatatcacattgctatgttgaaatacatacctatttggtaatagtcgcaacctttcaccgtttttagtttgacttgataatgactgaatctattcagggcatgcttcaaaattgcattaactgctgtataaaaaatgaaaattgaaaacatattactttggaaataatactattaatagtgtgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagcacaagcactgaatttctgtttcttaagttttcatctgtacattattttagcatattttcatgtattcctttaagacctttgctaaaacaaacttgtattattaggactagatgagatttctgatggtgttctccccttttgatcactatgataaactctcccgagcaaattaaaacatcacctgtattttaagcgaaataatgatgggattctgcagtcttggttttgatcctagtccaaaatttaaccactatctgtccatctatgtaactgctggccctgcagtttagtgttatttccctttttttgttgtcatttgaaatgaagaagttagtttttattctccccataattgttatcctgcagcttgtttgcactaaatatttgactcattgggctgtatctaacattctaattatttctgggtacactcttctgaacattatattctccagagctttttgtttgttataaatatgatttatgggacaggatatttttaaattaatagaataaaaatgttttgtagctcttacttccccttagaacctctgagaaggaaggtggttgctgtattagtcctgcaatattgttgtattggcaggattttattttattgtggtacaatatgtaacattaaatttaccatcttaacttttttttttttttttttttttgagacggagtttcgctcttgttgcccaggcgacaagagattgtacaatggcacaatctcggctcactgcagcctccacctcccaggttcaagcgattctcctgcctcagcctcccaagtagctgggattacagacatgcaccaccatgcccggctaattttgtatttttaatagagacagggttttgccatgttggccaggctagtttcaaactcctgacctcaggtggtccacccacctcagcctcccaaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacaggatttccttcttttatcaaactgcattatattccactgtatatgcaccacattttccctatgcattcatctgttgatggatttttgggttgcttccacctcttgactaatgtgaataatgctgcagtgaacatgagtatgcatatatctcttcaagatcctagcaggaattttttaatgactaaataggcatttaactacgtgcattctatttcatataatctagcatgaatatatttttttctatattattttcctacacctaagacaacccttttcaaaacactaattgttttaatcttcagtttcctcatattgtgaccacattttctcctcaatgtgagtcagcacagctaccaccagatttgagtataatctttttctagttctttctttatataagctttttcctgttcattctgaacattctggtttgtctctgcgttcttagctcattttcgatatgtcctcttcccttcacgcttcctctttctcttgttgggattataaggtatttatattaagatagaagtagaaaagaacaaatgtatacgcttgtttggtgccatctattactgatatcactgttctctttaaatcccaaccctggttaaattcagctcaccacctactccaggcctgaaccttgccatgtaaaatgaggactgctggatacaaacactcaatgatgctgattggtctcacttcaaattcatgactacaaacctcaagtgggcccctgggctgccaacagtcctagtatatttccttagtccagtggttctcaaaacaggggtcccaaacgagttgcgtcaacaccactcagaagcttgttagaaatgtatgttcttagctgggcatggtggcgtacgcctgtagttccagctacttgggaggctgagatgggaggagcacttgagcctgagagtttgagtctagcctgggcaacatagcaaaaccttgtccctaaaaaaaaaaaaaaaaagaaagaaagaaaaggccaggtgtggtggctcacgcctgtaatcccagcatgttgggagaccgaggcgggcagatcacctgagggtcaggagttcgagaccagcctgaccaacatggtgaaaccccatctctactaaaaacacaaaaattagctgggtatggtggcacgcacctgtaatcccagctactcaggaggctgaggcaggagaatcgcttgaacccgggaggcagaggttgcagtgagccaagattgcaccattgcactccagcctgggtgacagagcgagactccgtttcaaataaaaaaagaaaaaaaatgcatgttcctgacttcatcccagacctgtgagccagaaattctggggatggggctcagcagcctgtgtgattctgatgctaaggtttgaggaccactgcttaatcagttcattcttctattccttgaaaatactttttcacacctgtactcttctcagactgccaggaacccctctccttcctcactcccacctggtgatcactttttatttcactgagaaaatagaatcactcagaagagaattttattgtcttccagtgtccacctctgctagtatatacaaatgtctctctaagaaacaaaagccgggcgcagttcttcatgcttgtaatcccagcactttggccagctgaggtgggcagatcccttgagctcaggaattcgagagtagcctgggcaacatggcgaaaacctgtctttaccaaaaactacaaaaattagccgggtgtggtggcacatacctgtagtcccagctactcaggaagctgaggcaagagggtggcttaagccccaggaggtggaggctgcagtaagccatgattgtgccactgcactctagcctgggtgacagtgagaccctgtctcaaaataaataaaataaaaaatttaaaaacctccacaaaaaagctctaggtactactatggaattacctgtagaatatattgttatgtggaaattttgaatatttgtacatattttcttatttttaaaaaactgaaggataaactgaaaactgataaaaatagttaccaatggggaagaaaagattgggagtgggggaagagtgcaaaagctagacctctctgaatagtatctgttttacagtttgtactttagaacctatgtacatgttttatacaattaaaacaccaaattaaggcaaaatctagttgaaacaaatgaacctcactctattgcaaagtgaaagcataaccacaaggagaattatttttggtaacttttaaaatagggtaggggtttttgttttgtttttacgtaattttagacttatagaaaagttatgagaacaagtacgaggattctagataccttttactcagattctctatgttaacattttttccttcatttgtttaatccttctcaatctctcactcttatccatttatgtatttcctaaaaatagggaattcctttacatagctgcagtacagttatcaaaatcagttaatttatgttgacctaatatcattatgtattctacagaccttgttaaaatttcatcagttgtcctagtaaatatcctttataacaaaaataaaaacaaaccgggcacagtggctcacacctgtaatcccagcactttgggaggatgaggcgggcggatcacttgaggccaggagttcgagaccagcctggccaacatgccaaaacactgtctctaccaaaaatgcaaaaaattagtcaggcatggtggcacgctcctgtaatcctagctacttgggaggctgaggcacgagaatcgcttgaactcgggaggtggaggttgcagtgagcagagatcatgccactgcactccagcctgggtgacaaagtgagaccctgtctcgaaaatatatatatattaaaaacaagatctatctttttagtctcctttaatcactttaacctggaactgtatttgaagaatataggccagttactttctagaatgtccctctttgggtttgcccagggttccttcatgattagatctcgttatgtactttggcaggaataccacagcagtgttgccaagttctcaatgcatcatatcaggaagcacatgctatcaatcagtcccattagaagcagtgttaacttcgctagtttctgctgggtttctcccttgtaaaattactagtttcctgtttgtaattaataagtatgctgtagggagatatttagagatcacataaatatcttaccactcttcaaacttccactcacaagttagcatccttgatgattcttacctgaatcagttacgataatgaaaactgacagattccagcatttcttctacatttaattgattttctacttaaagcttttcctccttccccattcatgtatttgtttatttatttacatcagcatagactcatggattctttacccagtagtaaaatgctattttgaccgggcatacctagtgggatatatcttaaggacaaaaagaaccacaaaatcttaaacagcattcagtggtgttgttattgataatgtaggtattactattattttaaaactttcacacacacatacacacacattctgaagcacaaagcaaatgagtaattatgttagtatcattaggtaccaagattacagttgacccttgaacaacatggggattggggtactaatccccgcacagttgaaaatccatgcataacttttgactcccccaaaacttaactactcctggaagccttaccaataacatagttgattaacacatattttgtgttatatgcatcaagggagcctcaagtgatcctcaagtgatcctcccacctcgaccttccaaagcactgggatcataggcatgagccaccactcccagccggtttgataattatagaaagaggtttggctttaaaaatgtcaaaatagcaggatgcagtggcacatgcctatagtcccagctactcaggaatctgaggcaggaggtttgcttgaacccaggagttctgggatgtggtgcattatgccaatcaggtgtccacatgaagtttggcatcaatatgatctcccgggaggggggtaccaccaacttgcttaaggaggggtgtgaactggcccaggttgtcagcggagcaggtcaaaactcccgtgctgatcagtagtgggattgtgcctgtgaatagccactgcgctccagcctgggcaacagggcgagactcccacctctgaaaataaattaaaattaaataatgtcaacataacaggaggatcagtttttgtcagcaaagaggcagcagatgagttctcagatgccattcagaaaagtattgaagaggagcaatatctgcctgaacaggctgttaatatggatgaaaagtgccctattctggaaagaaaatgccacagagaacatctattaataaggaacagaagcaagcaccaagatttagggcaggaagggatacactaactctaataagcatagtcctgatataattccaactgcatttgcacaaaacagtagagtcagcctatctgcctcacttgaggtcaggagtttgagatgagcctgggcaacataacgagacactctaaccccccaaaaaatgtttttaattagccaggcatggtggcacacacttgtagtgccagcttctctggagactgaggcaggaggatcgcttgagcccaggagttcaaggctacagtaagctatgattgcaccaactgcactccagcctgggtgacagagtgagaccctgtctcttaaaaaaaaaaaaaaaatttatcaaactgtcttttgccaccattgcattctccagcttttagatccttcattttttttttttttttttttttttttttcctgagacagtctcattctgtcacccaggctggagtgcagtgtcagcctcctgggtttaagcaattttaccgcctcagcctcctgagtagctggaactacaggcacgcgctaccatgctgggctaatttttgtatttttagtagagataaggtttcgccatgctgcccatgctggtctcaaagtcctccactcaagtaatctgcccaccgcagcctcccagagtactgggattataggcatgagccaccacacctgaccccttcaccttctttttgctttaagttgctatttcgctttttctcaaattatgttagaatctataggtatgtcttttttatacccacataaaagctgcattttcaatactacttaaaaaggtatttcacaaaaagtgcaagattttagcacctactggtgttagctgcaggagtagcttcatgaatttcctttcctttttttttttttttttttttacaatggtccttatgttggattcatttatcttgagatggcagccaattgcagttgcagacctcaatctacaatacatatcaagcaattcagctttttctttttttttttaagatggagtctcgctcttatcacccaggctggagtgcagtggtgcaatctcggctcactacaacctccgcctcccaggttcaagcagttctcccacctcagcctactcagtagctgggatttacaggcgcctgccaccatgcccggctaatttttgtgtttttagtaaagatggggtttcaccatgttggccaggctggtctcgaactcctgacctcaggtgatccacctgcctcagcctacctttttcttgtaatgtcatgactttcctctgtttcttaggagcacttctagcatcaccaatggcactttttatggatcctatggtttaaggtattgcactaaacacagtgaaaataatatgagaactgtgagattacttttactgtgatatgcaatttattggagagatgaactgctcaagcaaagataagtagcatcacacaacatattaggtgaatactcgcaagacttgagctcactgcaacagcaacaggagggagctgtgaaattattacagtagtataatatgtactacagttaattttatggttatgatttaatattgcattctttgtatttgttcacatttctcttgactgaatggcaccgtttacagtctgtgtaggtgtaagttttgataaattttaactctttataatagatttgtgtacatttttatagtactaaataataaaatagtatctaaatatgttttatgcatttatgatatagctttttcttaattttttattccagaagtcatccttcacctttttcttaatttttaaaatagttctaggcaacatggttggtccacgagttttttcaaattgttacgaatctccaaaaaaaactttcaatatattttgttgaaaacaatccatgtataagtggacccacacagttcaaacccatgttcaaaagtgaactatacttgccaaatcaaagaattaaagtaaaaatgctataattgaataggaagaaatattagcttgaacttgtggtttatttatttattttttttttttgagaccgagtttcgctcttgttgcccaggctggagtgcaatggcatgatctcggcttaccgcaacctccacctcccaggttcaagcgattctcctgcctcagcctcccaagtagctgggattacaggcttctgccaccacacccagctaattttgtatttttagtagagacggggtttctccatgttggtcaggctggtcttgaactcccgacaggtgatcctcccgcctcggccttccaaattgctgagattacagacgtgagccaccacgcccagcatggtttatttttctcctaaaaatgcattcttttttcagcactgtccactgaaaagccaaagtaataataacccagtaaaaataatatgcctagtacccacatcatggatttatttatatattttattttatttttatttttattattattatttttgagacagagtctcgctttgtcgccaggctggagtgcaatggcgcgatcttggctcactgcaacctccgcctcctgggttcaagcgattctcctgcctcagcctcctgagtagctgggactataggcgcatgccaccacgcccagcaaatttttgtatttttagtagagttagggcttcaccatgttggccaggatggtctcaatctcttgacctcttgatccgcccacctcggcttcccaaagtgctgagattacaggcatgagtcgctgcgtccagccaattttttttttttttttgagacaaggtcttactctgtcacccaggctggagtgcagtggtgcaatctcagctcactgggttcaagtgaagctactgcctcagcctctcgagtagctggaattacaggcatgtgccgccacgcccagctaatttttgtatttttagtagggacaaggttggccgggctggtcttgaactcctgacctcaagttatccacccaccttggcctcccaaagtgctgggattacaggcatgagccaccgcacctggcccacatcatggatttaaatcgttttttgcactaaaaagaaacagggctacttagagaaatggctgattccagatctggggcaagaaatggacatgacaagcctggaacatcatcttgtgactgaaagcaaggaagttatcagacttctggagtcttacaaaaatacagaagaactgacttaaaggggctcccactggcccaaaatgggacaatttgagcacaaaaatttgtaaaggcagcaactgattaaaacacattaaatatataaaaatctgtaagttcataataattaaaaaaaaaacacctcatcagtcacctttggaggttgcctagaaactaacttggtattctggaaataaattataacagctttattcataatatccaaaaactagaaatagcctaaatgtctgtcaacaggagaatggacaaactgatatattcatacaatgcaatacttacggcagtagtaaaaagaaatgaactactgatcacaacaaaatgaatgaatctcagaacatgctgaatgacagaagccttacataaaagaatacatacttacggttttgtgtctatcaagttctaatataggcaaaacaaacctatggtgaaaaaaatatcagagtagtggtttgcactgggggagatggcagcagagattgaatgggaaggggatgagggagggaggtttgtgggataatgaatttttttagggatttgggttacacaaatgtatgcagttcatcaaaactctaatggtacgcttttgtgcatttcacagtatatacattttttaccttaagcataactttattttttttttactttttatagaagttttaagagacagggtcttgctgtcacccacgcaggggtgcagtggcacaactgcagttcactgcaatcttaagctcccaggctccagtgatcctcctacctcaagttactggtcccaagttactgggaccacaggtgcacgccaccaaaactggcttttttttttttttaagtagaggcataattttaaacaaatattaaatttcaatgatatgtgtgctaaggtgtattaaaaagtaagatggatagaaggataaagagatagatatttgataaagcaaatgtaacaatatttaattgtagaatctaggtggctctttacaatataattctttcaattttctatatgtttgatagttttcataacaaaatgttgaagaaaacctccattttggcacctctaattatgggtctaggcatcaacatctgctaacatcattgagtgaaaagttgatggtgaatcttataatgatgggtcaggcagacaacacctgaacccactgctcaatcctgtcactaaaagtaggatagccaggtgctatgttcttcctgttgcaatacaatagatatatcacctatgaagtattagtgcataaaactaaaattgaatctgaatctaatcaagattctagatctaactacaaatttacaggaaatacaggagagtaaaaaacattaaataataccatgtaggtaccattagtcaagtacagattgtgggggatttcacaggaaaaattacctagtatcttaacaaatcaatggcatgaacattggaaaaaaaaaagcataaggaaggggatctgttacagagtaagagacactcacaagacatagtcatcaaatgcaatgtacagaccttggatcctgtctagaaccaaccaaccgtaataagacctttcttctttttttagtctgttctactccttcaagttattggtagagaaaagacatttttgagacaatcaaggaaaactgaatgtggactgagtattagatgatactaaagaagtattgctcattttgttggacttaataatgatattatggttatttttaagtcctgtgttagaaatactgaactattaacaggttaaattacatttatgttaaaatacttctggggaaaaaaagtaaacagttggggatagatgaagcaaaaatgaaagaatgtccttgtttttgggtttttcgtttgtttgtttttgttttatttttgcctggagacgggcaagttgcccatacatcccagcaggccaggggaggagctgaaagaatgtcagtaattgccaaagctgggtgatagatacatggaagtttattaatctattttctccacttgtaaatgttaaaaagaggcatcctcagcttcacactttcttctacatcccatttctccatttttactacagtaagactgtgaaagatatctgtatttactgtcactacatcatctcctcccattctctcctgaacctggtccaatggggatttttgcctccatcgtgccaccaaaaccactcttatcaaggtcaccagtaacttccaaattgccaaatctaatggtcagttctcagttctcattttaaatgacctttgtaacattgatgactactaatcattcctacttgaaaaagtttcttcacttgacttccggataccaaactgattttcctcctgcttcactgtctagaccttgttttctttgctagattttttcttctgacttcagatattggcgtgcaccaggactcaatcctctgactcttctctatgatttcctaagcaatttcattccttaccatggctgtaaatatcatctgtgtactgttgattcccaaatttacacctctaatcccagcttccccttaatgtcatcttataaaatctcaaactcaatacgtatgagaccaaattcttttttttttttttttcatttttctataaaatagagatggggttttgccatgttgcccaggctggtctgaaactcctgggctcaagcaatcttcccgccttggctccccaaagtgctaggattacaggtgtgagccaccgcacccagcctgaaaccaaattcttgatccaccttacaaactcctccctcagtgttccctgtttcagtaaatggcatcttcattttcactcagttgctcagaccagaaaactaattgttataattgacttgtgtctttctctcacgctcatatccagtagcaattcctgtcagctttacctttagaacataaactgaatttgactacttctcatcatctctgcttctgtcactctagtctagtccaagtcaccatcttctcttgcctgtgcaactgcagtagcctcttaattggtctcctttttccctgtttcttcacaatctcctcacacagcagccagagtgatccttttaaaacctaaaactgatgatagtactcccctgttcaaaaccttatggtgatttcccatctcgctcaacataaaacccagagttcggagagcaggccagagcccaggcccggcccagcggcgcccgccaggtagacccaggcgaggccgcgtgccggcgcgaggggagcccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttttaggagcccgtaggtcatcttggagggtcgtctcaagtattgaacaaaagacggaaggtgctgagaaaaaacagcagatggctcgagaatacagagagaaagttgatacggagctaagagatatctgcaatgatgtactgtttcttttggaaaagttcttgatccccagtgcttcacaagcagagagcaaagtcttctctttgaaaatgaaaggagattactaccattacttggcagaggttgccactggtgatgacaagaaagggattgtggatcagtcacaacaagcataccaagaagcttttgaaatcagcaaaaaggaaatgcaaccaacacatcctatcagaccaggtctggcccttaacttctctgtgttctattatgagattctgaactccccagagaaagcctgctctcttgcaaagacagcttttgatgaagccattgctgaacttgatacattaattgaagagtcatacaaagacagcatgctaataatgcaattactgagagacaacttgacattgtggacatcagatacccaaggagacgaagctgaagcaggagaaggaggggaaaattaaccggccttccaacttttgtgtgcctcattctaaaatttacacagtagaccatttgtcatccatgctgtcccacaaagttttttatttacgatttatgacaggtttatgttacttctatttgaatttctatgtttcccatgtggttttcatgtttaatattaggggagtagagccagttaacatttagggagttacctgttttcatcttgaggtggccaatatggggatgtggaatttttatacaagttataaatgtttggcatagtacttttggtacattgtggcttcacaagggccagggtaaaactgcttccctgtccaagcaaagaaaactgcctacatattggtttgtcctggtggggaataaaagggatcattggttccagtcacaggtgtagtaattgtgggtactttaaggtttggagcacttacaaggctgtggtagaaacataccccatggataccacatattaaaccatgtatatctgtggaatactcaatctcaatgtgcacacctttgactacaactgcagaagtgttcctttagacaaagttgtgacccattttactctggataagggcagaaacggttcacattccattatttgtaaagttacctgctgttagctttcattatttttgctacactcattttatttgtatctaaatgttttaggcaacctaagaacaaatgtaaaagtaaagatgcaggaaaaatgaattgcttggtattcattacttcatctgtatcaagcacagcagtaaaacaaaaacccatgtatttaactttttttttttaggttttttgcttttgtgattttttttttgatacttgcctaacatgcatgtgctgtataacaatccaagcataattgttaagaacacatgtattaaattcatgtaagtggaataaaagttttatgaatggacttttcaactactttctctacagcttttcatgtaaattagtcttttggttctgaaacttctctaaaggaaattgtacattttttgaaatttattccttattccctcttggcagctaatgggcttttaccaagtttaaacacaaaatttatcataacaacaaaaatactactaatataactactgtttccatgtcccgtgatcccctctcttcctccccaccctgaaaaaaatgagttccaatttttttgggagaggggagattgattagaaaaaaatgtaatatgttccatttaaaattttggcgtatggcattttctaacttaggaagccacaatgttcttggcccgtcatgacattgggtagcattaactataagttttgtgcttccaaatcactttttggtttttaagaatttcttgatactcttatagtctgccttcaattttgatcctttattctatttgtcaggtgcacaagattaccttccttttttagccttctgtcttgtcaccaaccattcctacttggtggccatgtacttggaaaaaggccgcatgacctttctggctccactcagtgtctaaggcaccctgcttcctttgcttgcatcccacagactatttccctcatcctatttactgcagcaaatctctccttagttgatgagattgtgtttatctccctttaaaaccctgcctatcctgaatggtttgtcattgtctgcctttaaaatccttcctctttcttcctcctctgttctctaaataatgatggggctaagttatacccaaagctcactttacaaaatatttcctcagtactttgcagaaaacaccaaacaaaaatgccattttaaaagaggtatattttttcttttagaatgtaagctcctcaagagcagggacaatgttttctgtatgttctgttgtgcctagtacactgtaaatgctcaataaatattgatgatgggaggcaaaaaaaaaaaaaaaaaaaaaaacacccagagttctcaccacagtttcaaggccctacacctttgatcatccctcagatcacatttcccaccgctctgccccttgctctcatgcctttccagacacactgggcttccttcttcttctccaaacaaccctccttattcctgtgggcctttgtattggctgttcttctcatctggaacttgcttccatgtggcttgctttttcacttcgttctggtctctgttcagatattacccattagagaggccttctctgaccccaactaaaatagcaattccctagtccccatccctataacacctccttaccagcttaattttacttcctaacaagtaatactacctggctttacattctgttaatttgcatttatggctctatttgctttcttaaattcaactctttaggccaggcacagtggctcatgcctgtaatctgggcactttgggaggccaaggtgagaggatcacttgagaccaggagttcaagaccagcctgggcaacatatcaagacccctcatctctttttaaacataaattaatttaacttaattaagttcacattttataacttgtcttaaggattcaagaatgactgaatctacacagaggagaattatataaattcccttgtaacattaacttaagcctaaacatcatcaacatactattaagggcatacagaactttggagttctgatttcagcttctactccttcctaaggtgataacagttacacagccatggccagaagaccctgttggagtctagtttgcacttttttcttctgtatcatgttcattcttttctaggcttgctcacttgctgtgtcccatactggaatcatgctaggggtattgccatcttagtctgttgtcattgttctctctttgaaccaacagaaagttctaactaacagcagtctatcagttgatttcggtagaggtttgcctgctctcccatagactcttcttgctactttgtgtcatgctgtggtttgctcactattcatttctacacttgccttccttctttctctggctctcacatacacacttgtatttcctggctcatctctgtttgtgctagactattggaaaagtctttaaacttctttggacagaaagaataacttccaaagtagaatcctgatgctcccattgggcagagtaaggattcctcccacctgtgtgtcatcatcaaacacaggtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaaccctcattgttatcacaaagcatatgatataaaggagccctggtcaagcaggataccccttggggagaggatgtctttgccctggactaggaatcaggcaagtggttttctttccccttctcctttttcacctcccacccccacagagaggaaaagcagatccagagaagacatgcccaggaagagcgttgaagtccctgggaacaaggcttaattaaaatcattaaatctgacccatccatgtagtactccttggcttaagggtggaatgaataaagcaaagaaaagaggactgggcagggtggagaaagaaagggccatggctatcccctaacaaccaggatacaatggctctgtaggtaaaatcagaggtttcaagaaacattttggaagtgtaaaatatattttttcctaaagaaatctagactgtcactcaaaggaagacaatattgcatagtaaggcaaaaaaaatgtatctgtgtttcttgaacatccatgcttccttagtaattcttagcactgtactctaaccttacaagcaaataatacctaaagaacattggatggaacaggtatgtatttggagaaatcagccagacgtgagaatatgacaaataattcaagcatccagaataatttagaagtttttaatgtgtttctctattatcatgttatctaattttatgtaaactgcattgttcatcttcaatgaatccttatcttcgggtttgttttttgtttgtttgttcgtctgtttttcttttcagccccactgtgttctccttgcctcaaaagaaaactcggcacctgttaaacttggaggctttggggtagctattcaattaggggagtctggacttgtagctggaggtaagactgctttaaaaaaaaaaaattcttcaaaacctggtcacttgcgactggtataaaactttcaagctacatattagcccaacctcagtgtttcatacctcattccaccccaccccaactcccaaaaagcatcatcagatagtttttaatttaataactctgtagtcataactagaatcttagtcccttaagaatagactcttttttctctttgtacctccagtacttaagagactgtacaagattaaaacagtgttcagagaaaataagtttgaggcatagtgccttttaaagttgaactggccaaatgaagtcaaatctaaaatgtgtagattagccacttcctggtttacactgatggctaatttttaatttcatactgtttgcctttttccatttatcaaagaatcctgctcaagccatcagcctgtatattagcaaagaataagcagatgtgaatgcaggctgattttattattagccaaagcaaaacataatttttaaattcccatgtcagaataaaaagaaaaaagttacaaattatataatcttgcacagcacatttcatataactcaattccttatagctagaacatcaagcagtaacaacatagaccatcttcagaaaaatgagccataggtcatagttgtaatttttttttttttctttcagacaatgtcttgctctgtcacccaggctggagcgcacagtggcacgatcatggcacactgcactgcacccttgaccttccaggctcaagtgatcctcccacctcaacctcccaagtagctaggatcataggcgtgtgccaccatacctagcaaactttttttatttttagtagaggcaaggtctcactacattgcccaggctggtctcaaactcctgggcctaagcagtcctcctgcctcagcctcccaaagtgctgggattacaggtgtaagccactgcacccagccaatagttgtattctttaaataattttttcaccacagtgccctctaaaattaaattacattcaaattttcttttagtttcacattcttttccagttaatcatttccaataatatgcaaaactgcaagctgagtatagtttcaaagaatgctaattttttcccctaatttaaaactttctgttagtgattggaagactgaccaaagggtcaggtagtaaagcacagtttaatcatagaatctcaggactccaaagggccttaacttctccagtcttgtaactaatgattgaattcttccataatattcccaagaaaagattgagttctggtattaaacctcagagagcaaagtagtcactacatcccaagacagttcatttcatttttggataactccttaagtattaaaaagctcatctttgcatctttctgtaacttctacccagtcatcctaatcctgacttttgaaaccactctgaacaattttcatccttccgtatgataaccgttcatctgtttgtagacaactaccatgtccccctaggtcttatccaagttaacttccctagggtgatttggccattcttcatataaactggttcaaaatctcttcagtatccacaaagtacagggcctgaactgaacactctaactacaggtagtacagtacagccgatccagtgcacagtagcattgggctatcacttttttgtgttctgggccttaaatttccctcgagttccccaaattgcattagctttttggacaactacatagcactgatggttcatactgatcttgtaatcaagtgaaaatcctaaattattttttaaacaaatgtcactgttaagctaactctctcaattctggtacttatacagatcatttctatgttaagactacgtaattataacaaataatttctgatgattatattaccaaggttaatgggatgaaatgaaatgaatttattttatatgttatatactggccatatataatgactttgtttctgttgctctggatctatatcctgttggtatttagaatgtcatgttcttcgtattttattgtacatcttgactgggggggaaaatagatgcattatgtttacctggacattttctccatattaatctttttctaaagtccatgaacctttcacctaaattgtttatttttaaagctaattttgaactcccccccaccgcccaccgctggtatgtcagtattcaaaatgtatttttctccatgcttctagaattaaaatacttcctgatggtcaaaatattgtcatttcttagcacacctttttttgtattcttgaaataactgaatgttacgttttaaaaaatagaatatgaataaattagagataaattatttctcttagaaaaagcttttctgctgtttaaggtacttttgaaattttggtaattaaggttgggcacggtggctcatgcctctaattccagcactttgggaggctgaggcgggcagattgagcccaggagttcaagaccagcctgggcaacatggcgaaaccccatttctccaaaaagatgcaaaaattagccaggcatggtgacaagagcctgtattcccagctacatgggaggatcgcttgaacccgggaggcagaggctgcagtgagctgagatcgcaccactgccctccagcctgagcaacagagcaagaccctatctcaaaaaaaaaaagaaagaaattccgtcaatcatttaattatttatcaactttaaagcagaaagccattttcctgtcagtttgaaatcccagtccctagtcctccaaatagaaaggaattcatttctttatatgttgcatatagtaaaaatcatttaaacatatttacactccccctacctgaaactcagctatttaggaaacttacttatccagaatacaactagaaacctagaaaataactacaatagcagcaaaattattcctacccttaaaaatccactcatgctcctcacaattgagcatctaaagacactctctaaggctgacttgctcccatgttttaaaaagttgtatagattcgtgttccttcataccttgcacatgctattccttctagttggagtgccttttgttattttatctatctggttaactcctactgttctggaaggctgagctaacaattatctcctctttaaagcaggcttaccttcaccatcccgagttggatagccctattccttctctctatattcccataactatctgggctacatacctccatgtagcattggatgcagggacttacatcaaagactgtgatttgtaagagtaagggggaccatggctgagggtatctaggacctagcaagcacttaggaaattgctattaaatgaaataaactggttgctagtcaggttctagttaatagcagattataaaagcaacaaattaggagaacgcagaactaaagcatagtgagagaaaagaaataaaagcctgacaaaaatatatatgatatatactgagcagacaccaaaacttggaaagcgcaacagcctttcaatatgaaagaaatcaactcttgcatacctctgaagttcctgagggtgctttctgttctacagcctaggtctttaatcagtatctacaatgacaactctgagtcatcaagaaaaggttaaattatgagcagcattctgtgtaaaagaagtcaggaaattgtagaaagccatacaaaattatttaactaaggtgggcactgtgactcacacctgtaatcccagctacttgagaggccaaggcagaaggatcgcttgagcccaggagtttgagactagcctggggaaaatagtgagactctgcaaaaaaattattaaaacaaaaaggattgtgcgcataaagattcaaatcacaatgtatttaaaaatgtagctattcagaacaattctccccctgagattctggtaggaaggttttattgtattatcaaaatatataatatttaaatatttgtccaaaatatctcaaactgccatttaatttagtttgctaatttgtttccttttcttaaaattttgtggtcaaagtcctaaaagtcaagaagaagtatcagcaaaaacaaggatttttaggaagttggtgtatattaaagattaactccagtcctttttaccttctactgatttacatgaaataaaagagccttcctctacattctttctaccatggtttttcccctatcatctgtgagcaaattattgaaccaaacaacaggcatcttcccgaagattgaacactaattctccagaattgggtagtcttcgtctagctaaatggagagaaccttctcaggatggctgggactggccatggtcgctctgattattcccaagttaaggcccccattttgagtggcttggcccaggaagtggtaggagtcaagttgagtttcaaagcatcatccaaactgtcagcaggtacctaactggtaccctggtaccaattgaatgatactggtttcccctactcctgctagctcctgtccatcagaacaaggctaattctccagtggcccctccctgtccaggctattaatgaagtatggaaggcttagttcccatccctgcagcttcttcgtgttacttgaggaagcaaaatggggcaatacagaaataaaagtatttctctagccaggtccttctagtcaatagttttcactgatctatcgtacattttaaatgaaaatattttcactactggaaccctgaacttaagcttttctattatggggggaggaagggaaaccatatgatctgcagcaaaggtacatcctgatacacaagctaagagctcttttatctttctgcatcccaactgagtttcataatcatgaacagaacttgatatattctctctagctgaaccagaagatctctaaggtcttttaaaaccacagttctgagttctagataaagtattgcacaatcttcaaactaaaaattatcttgaactcagtatgatgaaagagagagacagagggaggaagggaggtggctgggcttgcatatatctagaagagctgccaagtctagtgggcagtgccccatcccacagtgatcttcctgccgggtacaagcctttcattccacaatagaagacttcttttgggatactgagttaaagatagttatgaatgtgcaaacagctagtatcagattccttacagaaagctaatttttgatagagaaacaaaagaaaactctttaaagaagatgaaagtcaaagaggattgaatgggaggagcttcataattttgcttttgtttatgccatatatttgctctcattctcttcatatgttaatgttaggaggaagctaaaaactcctactataacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaaccttctttgtgtaatttgagaaaggggcttcatttttaaagccttctgcttaatttgtaaagttaaaatggaatttcatccaggtataattttagtcattctttatcttaattttaaatttaggccagcacagctgaaaacatttgccatttacattccaggataaactgaaatgccaggatgacaactgcatttcatgatacaatatagaggcatttcagtgtggcttaaacattcctattcttctttggctattaggtgttggcagcctcatgtactatcacagacttgtgattagtaaatcattactttaactagtaaaaaattgaaaattcattactgactttatgaatagcgatatcacaaacacctaaggacttcttggaaataagtaagcttaaagttgatttcactaccccagcttttagactcctttgccctgtcccacaaggtacgactgacagtgactaggaggctgggcatgggaagcatggggatgtgtgtgtctgggtatcaggttaaggctgtttaagttggggaaattctttttcctctcattattactgaaactcatactttctattcaacctcatcactgtttcattttcagccatgactgacaacataaaaccaaaaacatgtgtatgtaacactggactctaaaactatgaggcccctaaagttttctcttcaattcctcggtaatgttagaattttatatgggacttggaaaaataaaatttaaaaagaagaaaagtaaagtggttccagagttacagtcttatccttttaagccataactgaagtttatggagatgagaatggtatatacttttgttggtttatttacctcactcaccatcagtttatgagtgcatataagtttgtcttttgttttagttagtttaagatatataccaaaactctgttaacagagaaagatgttttcagtgtagcatattctgctcctcccagagtcagctggccactggggaataaaatcaatacttaccaggtaactaaatgtctcaggaaactgcttgtaagtagtcatccctcttcaatccagggaagttgtaagttgctctcaggaatgcacagccaaattctggttgaatttagccaagtgaaatcacagatactaacgttttaaaagaaacatgattagtgatacatcagcataataataatactagcaataatgatagctaactcaggcatagcacatagcatagcatactttacataagtaaagtgcttagaatagtttaattcatttaaccctcacagcaacttgtgaggtaggtaccatataataataatcccccacctgcgtttttgagttataggcatttgctaataatagaattcttcctttgtgtttgttcagttgttaacttcctagtttccaaggcaatgtgcttcattccaacagactctggtattttatttcgtctatttttaaaacattgaatagttatttttgtttcttggtaaaaagacttagactattcacatatgtgcaaaaattaagtcatttaaaaattccctcttcctagtattatagtaagtcagatggatggtggcagctacatcataatttttttttgtacctggggtttgaagctttgaggttaataatttatttacttttttacttggctaacctcacctctcatttatcttcaggactttccttacaaaaagcctaggttttcaccaccttagtttgaagtatagatccatctctaccatctatgatgaatctcggcctttttcttttagtatactgtcatatgattctgtcagcatttatttttctatcttttattatcaaaaatttcgaacaaaaatagtagagagaatagtataatgagctcccagcttcagtaacacagacaatcttgttttatctgtattcaacatattattacattattttaaagcagatctcagctgggctcacttgagctcaggagctcaagaccagcctgggcaacatagggagacctggtctctacaaagagtacaaaaattagccaagtgtggtggcacacacttgtaatttcagctacttggaaggctgaggtggcaggattacctaagcctgggaggtcaaggctgcaatgagccatgatcacaccactgcacttcagcctgggcagcagagcaagaccctgtcttcccaaaaaaaaaaaaaaaatagatttcaaaaaaattatttcatcaccttggtggttcttttttgagacagagtcttgctctgtcacccaggctggagtgcagtggcacgatcttggctcactgcaacctccccctcccaagttcaggtgattctcgtgactcagcctcccgagtagctgggattacaggcgcatgcaccacgacacccagccaatttttgtatttttagtagagacgggggtttcaccatgttggccaagctggtctcaaactcctggcctcaagtgatccacctgcctcggcctcccaaagtgctggaattacagctgtgagccaccgcacccggccacatttcatcaccctaatggttctgagcaaaagaactattaacaaaattcttgatctctatggatattttaaagaaaagtttgatgacaccttttaaatgcagtactttttttttctttttttacctccagcagttgcaaatgtgagaccacattagaaaatactgtttcactggagtatatgctaacacttaacctcaattaacttctttgtaaagggcaaaaatatatttcccaaaccatatataagaagtgtaatgtcatatcattattacagataaccagttagtatatacacagcaagattctaagctgctatgggtttggtattcaaataagtaagattgttttatagccttattttgttcccccgtatagattcaatctccccaatttgttttagctactcttctcagctgaaggaatagaaaatcctgtgttggactgtcttgtaaaaaggacaagggagtatccttctaaacctctactcatttcagaaatcttaccacccctttcagatgatttctcaaccactttgtcaaggaaaaattattcagactttaaagagcacattcgctccaggatagggagaggaaacaagtctacccaagccctgtctaatcacttacctcatttcaaactggtcagttgaccacaatttcactaggatgaaaagtgtgggatttcatccctcccaaagtgtgggattacaggcatgagccactgtgcccggctggataatgataattaaacagccttatggcattagtcttaatgggatttgacaagcagaagtggctactatttgaaattctgcctgttggggggaaaaatgaagcacacttcaattttaagggctatccccaacataaagacacttttcactccccatcttcaagtacaaagtctcacattagtcagagctaatgctagcccttgctcaaattgtgatgattcatttatactgcagtgcaagtactgcagtttcatttggctttaaaatgttgtggagtttattcttcatctttcttccttagaaggtgatgtaggtctctgcctgttaaagccatggctttgcttgaaggtcctggcactgggtagctcacataaactcaccccatcagtaaacctgttgatattgaacaaggaatgagaccctactctgtctctgtctcctttccccacttgccttcccaaccccatgccctaaccactctgatttttttttaaatgattctgggtctcagacatatcccttttcccaggagccttctagcacttggctcacagatccacagcctttctcataagtcctgtgtcttttgaacaattcataattatttttgtttgattttaatcaatataccatgtggcttagttgtctcatctctaaaagagacaaaagtaacttcactgaggacagtattcaagcaaatctgttattctgtgggacctacggtagtagaatactttttcctaaacaccgaagttgatatgcagtgaccaaaatatcctattaaaaactttgcacagttcacaattattgctaacctcgattttttaaaacatatcttaaaaatatttctttaaaaattttaagttttattttagttctttctggatcgatgtattctagtctccctagctaaggatctaaagatagaaactggaataatgaacattctagtcttcaattattgaaaatattatcacttacataacaagaatatgggtatggaatatttactaacacaaattcttatgtagtaaagaacaacagaagaattgcatttgtccttttcttagaatgcaagcctttagaatcaaatttctgttctttgctctcagaattttattcacattgaagcaatataggaatattaaataatagtgaatgttaatgtctcatttaaggtaactatgtagttttcctttcctcctcctcagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttctgtcttaggaaaacggcaggtttttttttttttttttagacaaggtctgacaacattgcccaggctggagtacagtggcaccatctctactcactgcaacctctgctcctgggctcaatcgatcctcccactttaacctccccagtagctgggagcacaggcatgcagtaccacacctggctaatttttgtattttttgtagagatgggggtttcaccatgtcgcccaggcttgtctcaaactcctggactcgagcgatctgcccgcctcagcttcccaaagtgctgggattacaggcatgagccactgcgcccagccaaaaggcagattttaaaagttcattttatatcccatcttgccagtgagtattaaggaaaattataacttgggacagcagtgaaacagtactttttgattaaaacattatacagcccaataattccaggcaattttcattttagatgttagaaagactaacgcttggagaggttaagaatttgcgccaagttggccgggtgcggtggctcatgcctgtaatctcagcactttgggaggccaaggtgggtggatcacaaggtcaggagtttgagaccagcctggccaatatgatgaaaccccatctctactaaaagtacaaaaattagcctagcgtggtggcgggcgcctgtagccccagctactgaggaggctgaagcaggagaatagcttgaacccgggaggcagaggttgcagtgagccaagatcgtgtcactatactccagcctgggtgacagagcgagtctccgtctcccaaaaaaaaaaaaagaatttgcaccaagtcacagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatctctactaaaaatataaaaattagctgggtgtggtggcaggtgcctgtaatcccagctacttgggaggctgaggcaggagaatcgcttgaacccaggaggcagaggttgcagtgagccaagatcacgccatagcactccagcctgggctacaagagcgaaactctgtctcaaacaaacaaaaaaaaaagaaatataaaagaatatataattcaaaagacactgccacattactagaatctcattcaggcattgataattagttcagtccatcatcataatgtatgaataggtctcccagcatgaggccactcaggtttgcaggctttccattgatcttgccaggttctaaaagcaggaatggtcttggtttcaccgtttcagacacctgatataattgagctaagaaacagtatcctttcttgctctgagtctctttcaaggtgttaatgtaatgtgataatggatttccctgaattcataacacatttatttattcctttactctcagctgttaattttttcctcactttattaataacctttggaagaaacattagaatcaacatcgtgctggtctagatggcagacagcaatattagtctagtaattacctcctcctcagtccactcccatgcagggagactaaggttacataggtgccaatttagtggaccgtttttaccaccaggcaatatagctgcattcacaattaacccgttttgcacaacccacccccatcaggtccttaggaattctgacacaaggtttaaaaacatagttacaatttcttgtttaggaatcatccctggttctaacactggtagttatggctctggtcctagaaccactgcatagggaggggcagggggagtttagatgatatgggaaagaaggaaagaaaaaagtatagtcattatatcagcatactcccctcttgtcaagaattgcatagtcataacagcatcctctaccaccccccttccccagatcaatcagaaaaacgaaagaatatctagtggggacactcctttagccccactcatgttgagtgtgagtacacactggtaaaggcaagtaagccagcccttcctgctttcatctccccctgttttagacaaccaatgttttcattgcccattttagtctctatcaaactattactctgagaagaatatctctgcccactgctggaacattatgggctgtaccgtgtgttctttggcctaaagaaatggtgttcagctctccaaatatgtgcaatatcttctgttctggcttttttatggtattctcatcattcacatcttccaccgggcaagcaaagcccagtccagaatcagtgtctactcctgtcaaaacccatctgtggcctcccagggttaccagcatcagcctcacttgccagcttgttcagggctttcccaccagggaaatctgccccacagccatgggcagtgtctgtctcttttgctggcagacagaacagttcttattggcattttgtgcctgaaatgatacaaaagaaacctgtctagatgcagcccatctctgcactgttgcagtacccgtttatccactcatttgatggacccaggtggccacctcgagggagcacacagggttctctgcttgtcaatgtcaatcattttccaaacccagaaagaggctcttatgatgggcatcaacatattctacttattgcacccctcaaatttccatagggccattctccatatgggcatccctttaataaataggccaggtttccactgcccttctgcctgaccatgtgaccaggccactggtgactgtccatgagtcagtaaaaaaccaaacacgggagcttttgttattgttcatttcttcagaatgcaattcaactgccaagctaatgtgatcttaccttctttgatcaagagtggcatccttccaaacaggatgctgtcgattcaccttggaactgtcatccacacaccaagcagctcttcgttggtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcccatagcaaggtagtaaatgcaccgagatggaaattctctagtgcaaagtcctagtggttgtcactgggagatgctcacagactttggccataagccccagtaaacatcctgcaaagggcgagcagatggagaatttgtccctaccagcactccagcttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatctcatactcctatcaaccctcacttttaccctttcttgtttaaaaaaaaaaaaaaaaaatgttgagtccccaacagcaggttgagccaagggaccttgccccttttgtcagtctttgtattgattaacctgcctcaacattaccccaagtaactgttggtcagctttctcactgtaatctctgccttctgactttttcaatttctccaaactggggtgaatacagcaaacctgtttggaatcccttaacattgggagaacagcagaagctccctaccaacctttgatagtattatattgagatctttgttttaaccccatcgatttccactttattcatctcatttctttttatttcttttttatttttttgagacagagtcttgccctgtcacccaggctggagtgcagtggcgcaatctcagctcactgcaacctccgcctcccaggttcaagccattctcctgcctcagcttcccgagtagctgcgattacaggtgcccgccaccatgcctggctaatttttttgtatttttattagagagggggtttcaccatgtttgccaggatgctctcaaactcctgagctcaggtgatccacccgcctcggcctcccaaagtgctgggattacagatgtgagccacagcatccggccctattcttcccatttcttattagccctctaaagattccaccctgctgggatgagtcccatgattctcctctttcttttttctcttagtttcaccccatcactgttttcttcattcaccttatttattaataaccatttaaactttccaccttcctgggatgagtcctgtgactctcctctctgcctttccccagtcttttgttaattacgctcatgttttcattggtgcccatacaaaagaggctccctcagccatagcatttactacagccagagtaatggatgtattcagtgagtgaatatctcagtcatcataaagccagtcccacatggcctgcataggaaccaaatgagccgcttcacctggggtactccacttggcattgataggtagagttggacagtctctaccttctcagggtgtacagaccttacagtggcttttattccattcactaggctgactgttccctcaggaataactccctgtgtgtctggatcacattatacccattgttgattgttcagtagtgagctgtgggtcctgcatcaacccaaacatgcctgtccactctgcagcatttaaaaccaaagaaagtgccctaaattagttattctcacaatccattttagtaaaggattttcagtaaactgatgataccaatctatgaaatgagacaatttcttcacactgtaccctctggtttcagtagtttcttggttttgcccttccctcacatcaactaccttcgtggtaaccacaggtcgtagaggtactgtcatccctgtataatttttcctttgggggtcagcttgaaggctagtggcctgggctcagatagactgaaatctgagcttggtctagcatcaaggcctcatccagcatttgtttcatttctgttcagctattacagacaaccaccaccaagggagtgaatatttcatctttttcttactagtttgcatatccttatgcatccagtgaaccaactccctgagttggatccatctctaaattccactggtaacttttacctttagcaattgattgcgacacagttgcagctccaaaccatggaagaccacgataatgaaccaggaatcaaaggttcctcatctcccaccctttcattctttctcttcccaaaccacatatttctgtgagccagggccgttctagcaaaccctacttcactgacactaactgaaggtggaaaaactcagaactgttttcctctgctctcgcaccacacaacaacaacaatcaacacacaagacttctttcaccaaatgtgtggggatttctccccattaagaagcaagtaatcagccctgctgctgggtattctctaattcaattctgacactatagtatcacatcccacagtttgagggcttggtccccaaggcctccccttcccaccctttcagacaccagtcacaagtccaggcctccagaatgtcagactgactggctacaaatcagagatcctacacctgctctttgggttccattaatttgttagatcagctcacagaagtcagggaaacacttttaccattgtgttataaagaaaattacaaaggatacagatgaagagatgcattgatggaggtataggggtgaagtgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaaggtgatgacatggaatagtattacaggacaattttgagatttcagtggatcttgattctccttaagaatattacttctcagcctgggcaacatagggaaatcccgtctctacaaaaataaaaattaaaaaattagccaagcgtggtggtgcgcacctgcagtcccagtgactcaggagcctgaggtgggaggactgctacttcaaaaatatgcattcacctctctgatactcagtgctagttattcctgatttcccctagaaaagagtagtgaacaatttttagatactttctttgttttgttttgttttttatttgtttgttttgccctcccagatatataatgaacactttagaggtaattcctatttctcctttacttttctcactttctccataacggggatcttttgttcattcaaagctggtttaaatgccaaataacaatgaaaatggcaggcattttagtcatttttcaaatctcttagaaggtggtttaacattataccatacctacttacagtgctttcaaagcttatcttggctaatagcatatttatttttggaaacctttgttcctgccaatgattatagttctcgttctaagtaatttgagcttaatacataataaatttctagcacaagaaagacaaaaaatgtcagtaacttaaatgaaaaagtttaagacggctctttgagctgagtatcgcatgccatgtctaaacaacagtttaacttcactacttatgtcatctgaagatggaaaaactcaattagaatgttatccagctggtaagagcaggcttatgttatatttcagtatttgtccatgtgtatttataaatcattactgtggatgtaagaggtatttttttagaatggttgaaatttaaatatgaaaaacacctggataccttgcaaattgaagaaataaaatgatactggttgcagtggcttgagcctatagttgtctcagctacttgagaggctgagtaagtaattactgagtaattactctaagtaattagagtaaggtgggaggattacttgagcccaggagtgaaaggctgcagtgagctacgaccatgccactgtactccaacctgggagacagagcaaaaccctgtctccacaaaaagaaaaaaaaaaacaaataagatgaagaaaaactttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatggaaaacaaaaaaaaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacctagattcaaaaagcaggtccttagagacctaaaaagagacttagactcccacacaataataatgggagactttaacaccccactgtcaatatcagacagatcaacgagagaaaaagttaacaaggatatccaggaattgaactcagctctgcaccaagcagacctaatagacatctacagaactctccaccccaaatcaacagaatacacattcttctcagcaccacattgcacattccaaaattgaccacacagttggaagtaaagcactcctcagcaaatgtaaaagaacagaaattataacaaactgtctctcagaccagtgcaatcaaactagaactcaggatgaagaaactcactcaaaactgctcaactacatggaaactgaacatcctgctcctgaatgactactgggtacataacaaaatgaaggcagaaataaagatgttctttgaagccaatgagaacaaagacacaacatactagaatctctgggacacatttaaagcagggtgtagtgggaaatttatagcactaaatgcccacaagagaaagcaagaaagatctaaaattgacaccctaacatcacaattgaaagagaactagagaaacaagagcaaacacaattcaaaagctagcagaaggcaagaaataactaagatcagagcagaactgaaggaaatagagacacaaaaaacccttcaaaaaaataaatgaatccaggagctggttttttgaaaagatcaacaaaattgatacaccgctagcaagactaataagaaaagagagaagaatcaaatagacgcaataaaaaatgataaaggggatatcaccaccaatcccacagaaatacaaactaccatcagagaatactataaacacctctactcaaataaactagaaaatctagaagaaatggataaattcctggacacatacaccctcccaagactaaaccaggaagaagttgaatccctgaatagaccaataacaggctctgaaattgaggcaataattaatagcctaccaagcaaaaaagtccaggaccagatggattcacagcccaattctaccagaggtacaaggaggagctggtaccattccttctgaaactattccaatcaatagaaaaagagggaatcctccctaactcattttatgaggtcagcatcatcctgataccaaagcctggcagagacacaacaaaaaaaaggagaattttagaccaatatctatcgggggacttgccccgataatcacgtaggttcttttctatttttcttaagcgtcggccggcatgataaataaagggacagagtacaaaagagagaaattttaaagctgggcatccaggggagacgtcacacgttggtaggatctgtgatgcctttcgagccacaaaaactagcaagtttttattagggattttcaaaaggggagggagtatgcgaataggtgtgggtgacagacatcaagtacttaacagggtaatagaatattacaaggcaagtggaggcagggcgagatcacaggaccacaggactgaggcgaaattaaaattgctaatgaagtttcaggcactattgtcattgataacatcttatcaggagacagggttttgagatcaactggtctgactaaaatctattaggcgggaatttcctcttcctaataagcctgggagtgctatgggagactggagtctatcttacctctgcaatcttgaccataagagacaggtacgcctcggggtgggcgggggccagttcaaagacttactcctaggtgcgcattctctttctcagggacgttccatgctgagaaaaagaattcagcgatatttctcccatttgcttttgaaagaagagaaatatggctctgttctgcctggctctccagcagtcagagtttaaggttatctctcgtattccttgaacaattgctgttatcctgttcttttttcaaggtgcctacatttcatgttgctcaaacacacatgctgtacaatttgtgcagttaatgcaattattacagggtcctaaggtgacatagccttaggctgacaggattaagagattaaagacaggcataggaaatcacaagggtattgattggggaagtgataagtgtctatgaaatctttacaatttatgtttagagattgcagtaaagacaggcataagaaattacaaaagtattaatttggggaactaataaatgtctataaactcttcacaatccacgtttttctgccatggtttcagccggtccttctgtttggggtctctgacttcctgcaacatctctccctttctttttatataaatgtgccatggcgatgaaggcttgttcgttctctcgattttgacgcaggattctttgactggtccagcacactaaaaacaaaccgattaaacagagaaacttaattctaaaatttactacagtggagcccccaataggcttaatctaagtcgtggggtttaatctataaagattttctgccacctgatctaacgcctcagctccaggcagaatggataagtgagcttgagaggcttcaaaaatttgtttctttaattatgtctaatgataaattatcttctttacctagaaggtgtcctttgactttttcctatgaattatcagtctcattataggaatacggggtgatgcagaaatccgaagtattccaatcgcactgcatttgcaatgcgatgttcgagactcactacttgatctctaagccaaataacagactgtcttaaatcattaatttgatttgccaatttttgatcgatgccttgttgagaattccacatttgggtggaattggcttgccaatcattaacaaaatgagccctttgaatagattggtgtaatgccattctagcagtggtggccattgcagtgacagtaattaggcctatgataacagcaattaaagtgaaaacaaatctcttagatctttttttagaattcgctgtagcacttcattaattaaatgtattgagggggaggatacctaaggtctaggtaaagttaccggaacctagattccttcttgagctcgaaccaacattacacttttcctggagtcaaaatgggagttaatacaagtgtatagatgacaattgatgcatcggacggtttgattattcgtctaaattttgatatttcctactaacagtgtgtaaggaggcttaacacaactctgtatgggaatagtcaggttggaggtaagtaaagcagaatgtctgggtctacgttgatactgagagagtgggatggtaatgggaacaacagtcgaaatagttttcttttcctatactggcagtccagacatggcaatagccaatttttaaagttctgggtgttctgggctcagaatggggagtatcatacgaggcctgggggtgggtaatgcctttatcttcctattttaagagaaagaatgagctgatcctcgtatgcacagtagaatgatgattctcattctcctgataagaagtaaaataagtagcctccaggcattcctttccaccagaggagcaattgttttttaaatagccttttggtgcctagtctattactagaccatatgagtcattttttagtattactgcatgtgagttaacacagtcttcctaaattaaagttttagatgggccctcaaaatttttagggcatggttttcctgcaggtttatattgaaagtatggggtatctcctattactcctcctttcatttgttttaaaggagaaagggagagaccagagactaaatgtcctgttttatctgtagctgatgtttccggaagataagcagcctagacttgagttcgtagatggatgcaactaggtgcatgtccgaggcacagaggggggtatttataacctatggtaacattaaatgcagtgccttcttctcctggttgagcagggcaacggtcatctgtggctctaggcatccacacactatcgttagtgtagatttctgcaggagcatctatctaggtgagaggtcgaataagtggaggaaaaggcacataagcctaataagaataattatgtgtagcaggtaaatcagtgtgagaggaaactggtgagacagaaagtataaggaggagaatcattaaataaaacctagtgtaagcgagattgagtgctgaaggaggaagagaagaacagagggatgttattttcaggctaatagaaatggtgagatttttaggtttgtaaggagaaaaagaaaagtaatcaggagaagtgggattagttagatgggtctccattgccttcagggaggattgatttacacctattgtgatttgatgtgcctgtttctgaggaatcagcacagatctcatcatatctgaaggcagtctctgacacagacgtcttttctctgtggttttgattgtcagtattcacctgaagcttgagtcttctggtgggtacttagacaggggattgatgatctcctggtgaaacacaagcatatcctcttcctcatgttataattgtgccaggttcctaggtattggtttgggagtttttccataacactggcttgccttcgtttaaggaaaattttttgcctgtataatggcattcggctgcagttagagtattatctttaggaacatttaaaaaatttaaagtaaacaatgccaaatgtaattgggagtggggagttgttaaatcatgttttggttgttcagactgttgggacaattgggtttttaaagtgcgattgtaagggattctagtagtaggatctgtgatgcctttcaagccacaaaaactagcaagtttttattaaggattttcaaaagaggaaggagtgtgcgaataggtgtaggtgacagacatcaagtacttaacagggtaatagaatattacaaggcaagtggaggcaaggcgagatcacaggaccacaggactgaggcgaatttaaaattgctaatgaagtttcaggcactattgtcattgataacatcttatcaggagacaaggttttgagatcaactggtctgactaaaatttattaggcaagaatttcctcttcctaatgagcctaagagcctataggagactagagtctatcttacctctgcaatcttgaccataagagacaagtacgcctcaagggggccagttcaaagacttactcctaggtgcgcattctctttctcaaggacgttccatgctgagaaaaagaattcagcgatatttctcccatttgcttttgaaagaagagaaatatggctctgttctgcctggctcaccagcagtcagagtttaaggttatctctcgtattccttgaacaattgctgttatcctgttctttttttgaggtgcctacatttcatattgctcaaacacacatgctgtacaatttgtgcagttaatgcaattattacaaggtcctaaggtgacatacatctttctcggctgacaggattaagagattaaagtaaagacaggcataggaaatcacaaaggtattgattaaagaagtgataagtgtctatgaaatctttacaatttatgtttaaagattgcagtaaagacaggcataagaaattacaaaagtattaatttgaggaactaataaatgtctataaaatcttcataatccacgttcttctgccatagtttcagccagtccttctgtttaaggtctctgacttcctgcaacaaatatccctgatgaacatcaatgcaaaaatcctcaataaaatactggtaaaccgaatacagcagcacatcaaaaagcttatccaccacgatcaagtcagcttcatccctgggatgcaaggctggttcaacatatgcaaatcaataaacataatccatcatataaacagaaccaacaacaaaaaccacatgattacctcaatagatgcagaaaaggcctttgacaaaattcaacagcgcttcatgctaaaaactctcaataaactaggtattgatggaacttatctcaaaatagtaagagctatttatgacaaacccacagccaatatcatactgaatgggcaaaaactggaagcattccctttgaaaactggcacaagacaggaatgccctctctcaccactcctattcaacatagtgttggaagttctggccagggcaatcaggcaagagaaagaaataaaaggtattcgattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaatagagagccaaatcatgagtgaactcccattcacaattgcttcaaagagaataaaatacctaggaatccaacttacaaaggatgtgaaggacctcttcaaggagagctacaaaccactgctcaatgaaataaatgaggacacaaacaaatggaagaatattccatgcttatggataggaagaatcaatatcatgaaaatggccatactgcccaaagtaatttatagattcaatgccatccccatcaagctaccaatgactttcttcacagaattggaaaaactactttaaagttcacatggacccaaaaaagagcccgcattgccaagacaatcaatcctaagcaaaaagaacaaagctggaggcatcacactacctgacttcaaactatactacaaggctacagtaaccaaaacagcatggtactggtaccaaaacagcatggtactcgtaccaaaacagagatatagaccaatggaacagaacagagccctcagaaataataccacacaactacaaccatctgatctttgacaaacctgagaaaaacaagcaatggggaaaggattccctatttaataaatggtgctgggaaaactgggtagccatatgtagaaagctgaaactggatcccttccttacaccttatacaaaaattaattcaagatggattaaagacttaaatgttagacctaaaaccataaaaaccctagaagaaagcctagacagtaccattcaggacataggcatgggcaaggacttcatgactaaaacaccaaaagtaatggcaacaaaatccaaaattgacaaatgggatctaattaagctaaagagcttctgcacagcaaaataaactactgtcagagtgaacaggcaacctacagaatgggagaaaatttttacaatctacccatctgacaaagggctaatatccagaatctacaaagaacttaaacaaatttacaagaaaaaaatcaaacaaccccatcaaaaagtgggtgaaggatatgaacagacacttctcaaaagaagacatttatgcagccaacagacacctgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaaaacttttacactgttggtgggactgtaaactagttcaaccattgtggaagacagtatggcaattcctcaaggatctagaaccagaaataccatttgacccagccgtcccattactgggtatataaccaaaggattataaatcatgctgctataaagacacatgcacacgtctgtttattacagcactattcacaatagcaaagacttggaaccaacccaaatgtccatcattgatagactggattaagaaaatgtggcgcatatacaccatggaatactatgcaaccttaaaaaagggtgagttcatgtcctttgcagggacatggatgaagctggaaaccatcattctcagcaaactatcagaaggacagaaaaccaaacaccacatgttctcactcataggtgggatttgaacaatgagaacacttggacacagggtggggaacatcacacactggggcctgtcgtcgggtcgggggaggggagagggatagcattaggagatatacctaatgtaaatgacgagttaatgggtgcagcacaccaacatggcacatgtatactataagtaacaaacctgcacgttgtgcacatgtaccctagaacttaaagtataataaaaaaaactataacatgaaaaaaataaataaaagtaaagttttttaattaaaaaaaagataggaattatttctttgataaaaccaccaaaaaaaagttctattcacttatttcacatcaaaaaagaatttgagtgttagaccaagtaatatgttaatgtcttatgactgttaaatgatacctatttaacacctttatctctctgaattaatgatacttggtgtgaatatttattccaacaaaagtaggccatctaagattatattttcctcacagatggttgagctcttctcacaccctctatagccttaatatatagactgtaaagtatactgtcattttaaaaaaagtgaaaaggatatttatatcaggctaatcaatttgaattttgggtaatgaacacaccaattacccgtgttttccaaatctcatgtgcacaagggactatgaatcatgtacttcattaaagtgcaaggcacattactattgaattttttctgaattcatattacattattattattagtgtcaggagatactatttaattcagaaaaaacagcctggacaacatggtgaaactccgtctctactaaaaatacaaaaattagccgggcgtgatagcgcatgcctgtaatcccagctacttgggaggctgaggcacgagaatagcttgaactgagaatgtggaggttgcagtgagccaagatcatgctactgcactccagcctgggcaacaagagtgagtctctgtctcaaaaaaaaaaaaaaaaaaaaaaaaagacgagataccttaacagacttttttttaaatcttgtgattttactagcttagaaaataattgatatcataattgaagcataattttatttaaaaaaatacattttgactctgtcctcacctctctttccacatcaccttagtgaatggtgagcagaaaaggtgtttgctaaaaatagagttcacagtcagatatgtagtaaacttaaacatatttgcaatatgtaaagaattctcaaaactcaataataagaaaacatacaaacaacccaattcaaaatgagaaaagatttgaacagatacttcaacaaagaagataatacagatggcagataagcacaggaaaagatgttcatcattagtcattaggggaatgcaaattaatgccacaatgagatacctgtaaacatgttttacagtggctaaaatcaaaaagactgaccataccaattgttgacaaagatatagaacaatggaggccaggtgcggtggctcacacctgtaatcccagcactttgagaggccaagacaggcagatcacaaggtcaggagatcgagaccagcctggccaatatggtgaaaccccatctctactaaatatgtaaaaattagccaggcgtggtggcaggcgcctgtagtcccagctactcaggaggctgaggcagaagaatcgcttgaacccaggaggcagaagttgcagtgagccgagatcatgccactgccctccagcctaggcgacagagcaagactccatttcaaaaaaaaaaagaacaatggaaactcataacactgttagtaggaacgtaaaatggtataaccactttggaaaacagtttggcagtttcttaaaagttaaacatactcctatcatatagcccaggcattctactccttagtatttacctaagaaaaatgaaacacatcttcatacaaagacattaatattcatagcaactttatgtgtaatagccaaaaaatggaaacaactcagggtccatcagcaggtgaaaggataaattatgatacatgcatacaatggaataccactcagtgttaaaaaggaatgaactattgatacatgcaacaacatggatagattcaaaatcattatgctatatgaaagaagctggacaataatgagcacatactatatgattcaatttatataaaagtctagaaaatgcaaactaagtgacagaaagtagatcagtggctgactggggatggggatgggggctacaaaagggcatgaagatacttttgagcatgatggatgtgttcattatcttgatcatggtaatggttttatggttgtaaatatatgtcaaaacttatcaaattgtacattttaaatgtgcagcttattgtatgtaattatacctcagaaaagctttttggagaaaacaaaaaaatatatattcagagtctatctctctttcaccctttttattatttccagctggtttcatccaccatcatctttcacctggattactgtaaaagcctcctaactagtcttcccgctttttttttttttttaaaccctcatctccttccaatctattctcggcaaaactactaatgtttatttacagttcagggttgaaggctgggcgtggtggctcgcgcctgtaatccgagcactttgggaggccaaggcaggcagatcacgaggccaagagatcaagaccatcctgcccaacatggtgaaaccccgtctctactaaaaatacaaaaattagctgggcgtggtggtgcacacctgtagtcccagctactcgggaggctgaggcaggagatttgcttgaacctgagaggcagaggttgcagtgagccgagattgcgccactgcattccagcctggcgacagagtgagactccatctcaaaaaaaaaaaaaaaaagttgagggttgaaaatttacctattagttctgtaattgctctggcttggatatcttgtactgtgttgaataaaagtgagggaaaacaagaaaaattacctattgaatacagtgttcactatttgaatgatgggcacactagaagccaaacctcactgttatgcaatataaccatatagcaaacctgcatatgtaaccccagaatctataaaaataaagtcagatcatgtcactctagctcaagaccctccactggcttcctctcctactcagaataaaagccaaaggcccgcatggcctaccccagccttgtcatctctctgatctgacccgctattctccttgaccccttcacatcacttcacacacattggtctcctggctacttcttgaaaattccaaacatactccctccattgggcctttgcattggttattttctctgcctagaccactccctcacctcttctaaatgtcactttctccattgggcctactctgaccacccaatttgtttttgtttttgttttttagaaatggggtcatgctctgttgcccaggctggagtgcagttgcagtcatggctcactgcagccctgacctcatgggttgaagcaatcctcagcctcccaagtagctgggattacaggtgcatgccaccacgcctggctaattttttaattttttcatagagacaggttcttgctagatcttgaactcctagcctcaagtgatcctcccatctcagcctcccaaagtgctgggattacaggtatgagccaccacacccagccaaccaccctattttaaatatcaaggtacccaatccctcttacctgctttacttttttgccttattccatagtacttttgacatactctacaatttaccttttttgtgttttctcatcttcttgcactagaatatgatctacatgagggctggaatctttgttggttttcctcatgtatgccaaatgcataggacaatgcctggcatataatcagctcttgaaatatttatgaaattaatgagtgcttatagcatatgaatcctcaagatacattggcaaattagagtaggaccaaagtggggagaagagtaagaagaggtttaaaatacacatgagggaccaggcacagtggctcacacctgtaatcccagcactttgggaggccaaggtgggaggaccccgtgtgagtccaggagttcaagaccagcctgggcaacatggcaaaaccccatctctacaaaaaatacaaaacttagccaggcatggtggcacttgcctgtagtcccagctactcaggaggctgaggtgggaggattgcctgagccagggaggtcgaggctgtggtgagccaggatctcaccactgcactccagcctgggcgacagaatgagaccctgtctctaaaaatatataaataaataatgggggattcatttatttttgagacagggtcttaacgctgtcacctaagctgcagtacaatggtgagatcctagctcaccacagcctcaacctcccaggctccaacaatcttcctgcctcagcctcccaaagtgctgggattacaggtgtgagccaccacacctggcttgcagtgagctatgatcagcccactacactctagcctgggcaacagaggaagaccctgtctcaaaaaaaaaaaaaaaaaaaaaaaaaaaaaaaagcgtgtcctaattagaagagtctgtaattgttatagtccatgacaacgtagaatgctgaatcagttgtggaattgatttttcaaatgcttgttttacctggcaaatcatgtcaaaggtaacctgaggccaggcagagtggcttacacctgtaaatcccagcactctgggaggccgaggcggaaggatcgcttgagctcaggagtttgagaccaacctgggcaacatagcaatactccttctctattaaaaaaaataaaattagccaggctggtgcacttatatcccagctactcaggaggctgaggtgggaggatcactttgagcccaggggtttgaggctgcagtgaggtatgattgtgccactgcacgccaacctgggcgacagagtgaaaccctgtctcaaaaaaaaaaaagtaacaatgcctttataataattacgatttgttattttagccacatagccatatatatgaaatttacgtgacctattatttcagccctttattgctgaaaatgaaatattattttattactatcagtttaaccttaatatccctcatttcagattgcttaccagtatcatggaataaaatctccaatctaaaattcaatctgagttttatatttaagaattttagctttattatttgttttagattaagcttctgcacttttttaaacggttatatatgttcattatctttcatcttacataggagcgggatcgttacgcctacaagattcatcttccagaaacagtagagcagctgaggaaattcaatgcaaggaggaaactaaaggtaaattaaacaaatcagcaaaaaagccaaacagatatagttaatgatcatgtttttattctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttttcaaacttaaatattttgacaaatgtatgtttagttcaatggaaataactttgaattagaattggaattaggggccgggtgtggtggcttatgcctgtaatcccagcactttgggaggccgaggcgggcggattgcctgaggtcaggagttcaagaccagcctggctaacatggtgaaaccccgtctctactaaaaatacaaaaattagctgggcctggtggcaggcgcctataatcccagctactcgggaggctgaggcaggagaattgcttgaacttgggaggtggaggttgcagtgagctgagatcacaccattgcactccagcttaggcaacaagagcaagacttcatctcaaaaaaaaaaaaaaaaaaaaaaaagaattggaactaggattgaacaactatcagaaagcagtaaataaaatcttacactaccttgatctactagaaaatattttcagctcagatcacttttctcaccttctttattcttcctaggtgtctttctccctcttactactctccctatcctccacctcaccaaaaaaaaaaaaaaaaaagaagaagaagaaaagaaaactggtaatcaccccatatggggagtccatttgactttaaaaggttctgaaaaagaccagacataaagtaatggaatcttttcagcactgagagaaaatgctgagagaccatcccccacccaaccctccagagtaacaaagggaaattgattatcttaacttcttagaattaatttatgtttgacttacttttgatactgaaaaatgttaactgttctctaagtggttgattagatagtagtcttccttagtcacatgactcctgccaactataaaacttttcttcttaagtattttcagatatgccataaattctaataataccattttatttttcaacccctgaaattagtgaattattatgtataactctagacttataaaaacatttatatgaattttgaggaaactattaggctacaatattatcctatagacctgaaacttttaacatggtacccactggccacatgcagctatttaaatttaaattaattaaaattaaataaaattaaaaggtcagtttcccagtcacactagcacatttcaagtgctcagtaaccacagttggctagtggctactatattagacagcacagatgtagcttgggacatttccatcattacagaaggatctattcaaccatgctactatagaacaagggaaatattaacatatcattgttggtgttgattattcccattttagcctttcttctcactgattttgcagtcaagggttcaaagtgactcttctctatttgctttaaaaatccttggccaaaataattattaatgataagccattattgagatggtagccaaagaagtttcccaaaacttttattctttttgccttgatatccacctaaacctgtgtagcctacaaataaaaaactcttttattattcaaagtgaaatttggtcaactgtttttgaagttagtttcctccccaaagaaactattattacacttttttgtcaacttttctataagtcattctaaacctaattgctttggcctcatgtgacattacgctgtatggggttgaacctttcattgcccaaatacaaacatttcaccagagagcttgggcttgccccatcacaagaaacacatgctgtacttctcccggggccacagaatcagacttgggcctaaaatagccaaagtggtgactaagattcatttggacagggccaagctgtcaaaacagagaggggtcatgtggatttaccacatccccttgcagggctatttaaagttttaagacccaccaaacaacctagaactaggaacatcagcagggtcattagtgaatgtgtttggcttctgataaggctgtattcttttgagtagttcagccaccttgttaaaacatgttacacctaccatcctcaaggaactaattcccattctgcctcttcagtggacttctagaacagagattgcaacttccttggctttcagagtccaccacacactttattttcacacaactaggtgctcatcctacccagacactattcttaacctcctcagtggtgggtgacagtttaatttgtaatgactcccttggaagtgattaaaagggagttcacagaaagcggtagaaaattacttttgtggccaggcacagtgtttcacacctgtaatcctagtacatttggaggccaaggcgggcaaatcgcttgagctcaggagttcaagaccagcctgggcaacatggtgaaaccccgtctctacaaaatatacaaaaattaaccaagtgtggtggctgtgcatgcctgtaatcccagctattgggggcctgaggcaagaggatcacttgagcctgggaggcggaggttgcagtgagccaagatcacgccactgcactccagcctgggtgacaaagtgagaccttgtctcaaaaaaaaaaagagaaaaaagaaagaaagaaaattactttggtaacttagtcatgatggaatgatggaaaatgtattttccccattttggttaccacatgtttcatgtgtcgagttttttcctcctaattcatactaagctctggaattgtaatacttcattaaaaaaaaataaaaaaaaagaatcctctagataacaatactttctttaataaactacatcgttctgagcacagaactgaatatgaggacattttctcaaactgaatattaggatacatgagacagactgcatgatctccaggctgtgtggaaaatctgtgctctgtggtctggggcttttgagggggcacacctgtactctaaccctggctgtcatctactgaaggaggtactgaggaaagtggtaactgttgttatctgaggatgtctatccagagaagagactcaggagggaatgtattctgaagtcatccctattgcttcttcaattatttctacccctagaaagcaaattccccacagtgaagtgtgttgaagaaattctatacaaatagaagcaatattctatgtttgggtaagtttattgcagtccatttaagaaatggtgagtcgagtccacgtgattcagttaagaggataaaatcatttatttcctatatatacagaaagcaaggatttctaataactttctacagtttttctttattattattattatttttttttttttttttgagagagtcttactccatcacccaggcttagagtgcagtggcgcaatctcggctcactgcagcctccgcctcccaggttcaagtgattatcctgcctcagcctcccaagtagctgggactacaggcaccaccacatccagctaatttttgtatttttagtagagacgggatttcaccatgttggccaggctggctttgtactcctgacctcaagtgatccgcccgcctcggcctcccaaagtgctgggattacaggcataagccaccgcgcccagcctttattaattttgcaaattgcaaaagtattctctgacttactgattggtcacttgtgttcctgaactgtgcataactacgaaaggtttgtttaggagtgccattttctaatactgtataaagctgtactatccagtacagtagtaaatagccatatgtaactgtttacatttcaattttaataaattaatattaaataaaaagtaaaatttggttgctctgttgcgctagcacctttcaaatgctcaataccacgtgtgactgatggctactgtattagacagcacaggtttagaaaatttccttcatcacagatagttctattgtatggtattgctatagagtcttggtaactgcagagtaatgcttatacataagcagcactttttgataggtcaaccaggaagctataatagatattttttggcaattttctttctgttagttcaacaaaaactaacttaaagatttatcaaagacctttgtaccgtaatgaaacccagcatttacatacagtcctctctgtagtaagggtttgtacaaaggcagtaaattgagatagcagtcgttgtgggcttcagctaatcagagcattaaatctggtatccaaaaggtaacctttgagcctgagcaacataaggagaccccggctctacaaaaataaaaaatttgccgggtgtggttgcacacgcctgtggtcccagctacttggaaggctgaggtgggaggatcacttgagcctgggaggtcaaggctgcagtgagctgtgatcacaccactgcactccagcctgagtgacagagtaagactctgtctcaaaaataagcggggtggggaccttaattctaaaaactgaaaacttattctggtatgagcagttccgcaaatattctggtatgaacagttccacaaataataagtgaagtgattttgatcttacatattgattttacaaatcaattaatttgtgattttttttaagaaatacatatataggccaggcacggtggctcacgcctataatcccagcactttgagaggctgaggcgggcggatcacctgaggtcaggagttcgagaccagcctgaccaacatggagaaacgccatctctactaaaaaaaatacaaaattagctgggcatggtggcacatgtttgtaatcccagctactcgggaggctgaggcaggagaattgcttgaacctgggaggcggaggttgcagtgagccaaggttgcaccattgcactccagcctgggcaacaagagcgaaattctatctcaaaacaaaaaaagaaaagaaatacatatatagatatatgttgttttttcttttttaattgagacagggtctcactctgttgcccaggctggtctcaaactcctggactgaagcaatcctcccaccttggcctcccaaagtgctgggattacaagtgtgagccaccatgtcccaccagtttatgattctgaaatgtagaatatattacttcctgttgggcaatagattttgaaaattatgtacatttaagaccatctctataaaatacttttacatagacccaaaagaatttctaagatatctattctgtgcaattactcttaaatataactatatctagtacacttacaagtctcatttttcattttctctagagaaaatactgcagcctcttttagtcatatatcctgactgaaaattatgaaattaaaggttttagacctatgtttaggttatgtttgagtattatatatgtataggctatgctgactaaactgaatgataactctggttttggctatatggagacatatcaaaagttctgatttaattaatcatctcacctaattatcatctaggacctaattattaagtataatcaacccaaattctttaacatctctaccttgaaatgattttcttgacttttggtcatctctgttcagcctcaacctctccaaattctccaccctttttagggcttttgagttcagtcgtctgaattctaataggatgattatctttcaaatttctttgtcacactcctattggtatgttctggtgatacactttctcccctcagtatatttccctgttcactcaggaatatgactatatattaccttgttatttaggtacaaagccaattattctatatctgatacttgtatattttgtatttagatgttttaaaatgtaccctcctgccatgactgtgtattgccttgttatttaggtacaaaaccaattattttatatccaatacttgtgtattttgtatttaaggtttaaaaatgtacccttctgccattgtgcctatcaaacttcatgatgcgtgtttctgagctcaggaaataccaaaaagggagtattcggtttttggtttttgtcttcaagtcagcaatacatctttgttcagctcttgtgttcctcaataactttgttccctccttaagtgcattcagtagttaaacttagcagaaatctgacctaaccattttcttgttttccacttccttaaatgccacacagaatcatctagccagaagcataccattttgatgtttgacatattgacatttcaagaaaactataattatgattaagaattatttctagttcttaactacaaattaaaaacttgtggtgctctttttctctgaatttataatctgccttctcctttctaggttaatttgcttgatagaaaattacaactttaatattatttatcttaacagattgtgaatagtctaattaactcaaaagtattatgtttcgcccttaaaagatactaaattataccttctaaattaaagcaggtagaaaacttctttgtcaagggtttaataaaccagaaagtttgaagaactacttgtataaaatctgattttttaattgttgtattacattattgctatcgatgagcaatattacattattagcaatcagtagcaataatgtaatacaggggttggcaaactatgacctgggggtcaaatccaacccactgcctattcttgtatataaagttttattagaacatagcaaagtacattaatttgcatattgtccatggctgctttcacactacagtggtagaactgagtagttgcaaaagagatcatatgacctttagagcctaaaatacttactgtctgattatttacagaaaaaaaattgctgacccctagtatagtagaaatccttgaactggggagagtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattatttaaaaaaaaaacaaactacgtaaacaaaactgctagtcataagacagataaatttaaagcatactactattgtttcaaaagcatttgcatctcagggctcttttagatactgttttcctagtagtataggtatttattacagatctttgacaatagtagcaagaacaggccttgaagcgtataactaacatcttaagaaatacagttgtacttcatttggaaataaaaataaagcatctctaaaagcctagtttccgtgtgtgggaaacgtgatttgatatataaaaattccattcccacccagcttttaggaaacatgtataatacgtaaagtaaaataagtttttataaaaagaagaactcaacattcactactgttttttcaacatggtaactataattctgcataagaacctttcatgcgtaactttagactttcagaaatctcaaaagttacctggaatgttaacatcaatatcacttctctctttttgcccttccctttctacagtaagtaaactttgtggaaatatattttattaatgttttctggccaggcgcagtggctcacaccagtaatcccagcactttgggaggccgaggtgggtggatcacttgagcgcaggagttcaggaccagcctgggcaacatggtgaaaccccatctctacaaaaaaatacaaaagttagccaggcatggtggcacacgcctgtagtcccagctacttgggagactgagatgggaggatcacttgagcctgagaggttgagactgcaaagagccgagattgtgccattgcactccagcctgggcaacagagcgagaccctgtctcaaaaaaataataataatgttctcatattagcagatacctaaacacaaacaagttttatctttccagaaaaattcaagagttaatatttaaaatttagacttagactacttaggtgatttgataaactaactaaatgagtgattctacatagaccagcaaaaggctgtgctcatgttctagatctttattagtagagttagtaatgatatgcacttacagaatgctttacaatttgcaaagcactttcattaatacattatgacttttgccaatcctgtaagataagtccattttaatattctttttttttcttttttgagacggagtttcacttttgttgcccaggctggagtgcaatggcacgatctcggctcaccgcaacctctgcctcccgggttcaagcaattctcctgcctcagcctcccaagtagctgaaattacaggcatgcgccaccatgccgggctaattttctgtatttttagtagagacggggtttctccgtgttggtcaggctgatctcaaactcccgacctcaggtgttccacccgcctcggcctcccaaagtgctgggattgcaggcgtgagccaccgcgtccagcccgttttcatattcttactttacagataagaaagcctagagaggttaaatgatttactcccaaataccacatgttctcccttataagtgggaactaagctatgggtacacagaggcatgcagagtagtataatggacactagagactcagaataggggagggtggaggggcaagggatagaaaatcacctgttgggtacactgtacactactcagaagacagattcactaaaagcccacacttcactactgtaccatttatccatgtaaccaaaaaccacttgtacccctaaagctgtttaaataaaaaataaaataaatatgatttactgaagcagtaactcccaacatttttccactctacagtcctaagggatgtcatgcactcaaatggcagtgatttccaactaggaataaggggaggctatgcatatagcttaaaagagtcatatgtagttgattctgttgtgtggcctgatggagaattactatacaaaagtaagacattgtcattgttaaaacaaaaagagggaaaaaagattttaaaaagaaaaatgacacataatcctaccacccagagataattaataacattctggtgtatatgcagtcttttatatccatattaacttttttacccaaaaatgagattataatatacattgattttaaacctttttcatgtaattaatcacagacatcttttcattccactaaacacccttctacaacatcattttataataactgcagaatattccatcctgtgttacatgtttgaattcaagatgtaagtggtttcatatacttctacaattcccgattagtgttattctggtatatgcatatgtaatttatttcaaggaatctgaaataatttaaaaactacctctcttctagccatcatctcctatatatttgacttaatggataatccttaagataaataatttgttaaataacttatttatatttgtgtatttgttttaataatctattttttcatctctttgttttagggtgcagtactagccgctgtgtcaagtcacaaattcaactcattctatggggatccccctgaagagttaccagatttctccgaagaccctacctcctcaggtaattggataattcacttattcacctgtgtgggtcatttggcatttacatccattctctcccattgtgaataaacttttcctgtgcatttagttaaatcctccaacggattctaaggaagtttgtcagcaaccaaatcctgtctacatgtgtcttgttccttttcattttaataccaaagttgctttctcctgtggctccaaaaccaacacttcatttttttttcttttcacctcagtaatacttcttcccctttccacactctagacccagcattgcactccatccaatccaacatcctagtcagtcttttgggatctttctgattaccttctctctcaacaaaaacttctaatataagcttttccccaggtcagtcgtattagatcagactgtgggcagcactgctttgaatggaatctttcagtgtagagctgtcttgtgagttatctcctgaaacagttaccaagttcttctttctgtataaaaatctataacacggccaggcatggtggctcatgcctgtaatcccagcactttgggaggccaaggcaggcagatcacctcaggtcaggagttcgagaccagcctggccaacatggcaaaaccccatctctgcaaaaacacaaaaatacaaaaaaaaaaaaaaaaaaaaaaaaaagccaggcgtgctggcctgcgcctgtagtcccagctacttgggaggctgaggcaggagaatcacttgacccgggaggcggaggttgcagtgatccgagatcatgccactgcactccagcctgggcgataatgcgagactccatctcaaaaaaagaaaaaaaaaatctgtaacacatgcatacaagtatccaaaggggaagaacacagaagagttatttgttttgatgaactgtatataagtacccctgaaacaacctgccagtgttcacaaaatcattttataagccagtgcagtggtgtgcatgtgtagtcatagctactcaggaggctgaggcacccggctcagggggatcacctgagctcaggagtttgaggatgcagtgagctgtgatcacaccactgctctccaacctggacaacaaaatgagacctcgcctcttaaaaattaagagataaaaggccaggcacagtggctcacgcctgtaatcccagcactttgggaggccgaggcgggcagatgatgaggtcaggagatcaagaccatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgctgacttggtcattatccagagcccttcccacatgaaaggcagggatctagttgtgtttataggtgtggtccccagtgcttcttattgtttcacgtctgtcttttcttccactccattttgttccctccacctgtaacttcttttgttagctgaaacctctgtcttctctcctcacactcagattacagtggaccctatttaaggggagtggatccagtaatggtttgtattgtcatactgtggctgtatgatataatcacatgcttataatatatttaggataaatctctttgagattttaggtcaagatctctactaccattttcatctttagaaatggagctaaaggctgggcatggtggctcatgcctgtaatcccaacagtttcagaagccaaggcaggaggattgcttgagcctaagagtttgtgaccagcctgggcaacatagggagaccctctactttgtaagaagtcaaaatattagccaagcgtggtagcacacacctgtggtcccagctactagggaggctgaggcaggaggatcacttgagcccaagaggtcaaggctgcagtaagccgtgagtgcatcactgtactcaaaactggatgacagaacaaaactctgtctcaaaaaaaagaaaaggggccaggcacagtggctcatgcctgtaatcccagcactttgggaggccgaggtgggtggatcacttgaggtcaggagtttgagaccagcctggccaacatggtgaaacccccatctctactaaaaatacaaaaattagccaggcatgatggccacgcgcctgtaatccacctgaggcaagagaattgcttgaacccaggacacggaggttgcaatgagccgagatcgtgccactgcactccagcctgggtgacagagcaagactccatctcaaaaacaaaaggaaaggaaaataaaaagagtaatactctatgcatttaggaaaatatgaatatttaaaataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctcaaaaaaaaaaaaaaaaaatcaatgttgaaatattcttttctcatatttcaaatcaagtaattcagaatcagaacccaacgtttgatgtctgaaatcccaaacagttccagtgattgtactcatggaacatgagggctcactttggggtcagctgggggaccatgcttctggtggctcatgtagtgggccgaactgtggcttgataacctgcttgttctaaaatcatactgtttgttgtttgtccatatgctgccttcctcctaggacttctagcagcagaaagtaggtatccctttgttttcctttaaggtgtatcttttatgcaaaagtgtttggctttgcatggttcgtaatcagcttgactttttccttggctgtttgtgtgtagttgtttaagtattaattttaacactgcctggtcataaaattaaaacttggatatattgatttttgaggcattgttgcacaaacaatattaagttctcacttctttcataagaggaaaaaagacagtgttaaaatttcaacggcatttaatacttcacatctgaatttcacatacgaatacattaattctggggaaagagtaacatttattttagagtttgctttcaagaaaactttcagggtaagtgaatttttctttgacaattacatcacctgtaagtggtctttattgcttcctgttactgagtccattttcagtttatttggacctgtgaaataaattctgaaatcatatctcttaacaacttttaccatcagatagaacatttataaggaataatgtaatagctagattttaattacaaaggggcataatttgagtttgggagaaaattaaaatgtaagaaatgtacacacagttgagtacatgtaaaactgaggcaatctgaataagatgggtggattgtatcaatgtcagtattctggttatgataatatactatcgttttgtaaaatgttaccaatgggggaactgagcaaagaatacaagggatctctctgtattatttcttacaagtgcatgtgaatctacaattatctcaataaaaattctaattaaaaaaataaacctttacctcaaagataaatgagaaagcctgggtactaatgattgaattcattttcacattttcttacattagttatctgtagctcaaattgcagctgatttaatataaatcttatagtatattagttacctattgttgggtaatgaattaccttaaaacagcagttgtcatctcacagttcctgtgggtcaggaatctgggcgtggcttagctgtgtgcctctggctcaagatctctcatgagattgtggtccagtgctgctatctcaccggaaggcacaactgcaggaggaatcctcttccaagctcactcacatggttgttgccaggcttcggttccttactggctgtggtcctcttcacagggctggctgttcacagcatggcagctcacttcccagcacgaaagataaaagaggggggcaaaagtgagagacagtgcccaagactgaagacacagtctttacagcctaatctcatagtgacgtcttatcacttctgcactattctgttcattagaaatgagtcagtaagtccagcctgcactccaggggaggggactgattacacaaggctggaaataccaggagaccaggttactggggcccatcttagaggctgcccaccacgtacaaattaataactattaaaatgtaagattcttcccgtctagatttagcgctcctcttttttttttttttaaatcagccaacctgtcatgttatttgagaatgggcatcttggatgtatcagtagtgattttccttagttgtaaagctttacacgagtgggtacttaatagcagaatgttattaaagtactttgaaaaatctgtgctcgaagatgtttctatatggaagcataaactattttaataatcataatggcattagagattataacatctatacgctgacagaatacatatgcagagtttacttcctttaataaatttcaaggtatctgtaccataatccacatatggagaatctaaagcatgtatcaccatatgtaagttctcataacttgagttggatatggcacagatgcttatgtccaaaatacagtttccattacaggattcattattgcttataacttgattgataacaaagaatttgctttgtgcagtgggaataaaaagtgttgaacagggtgtggtgatagagggaagagattggctgcaaagggacaagagagaacttttttgaagtgatgacagtgtacacttaaatggcgacttttaacttaaaacagtataccttagtaagcagattttttttaaaaagtattgtgcttgcaaggaggggctttgattgagtaggtgataatgtgtgtgtgtagtaatacaatgtattaattgatcgctaatataatagaaaaggtattgattactcttagaagaagctaggctaggttcagattctagatttgctcagtgatgctgagtttcatagctatacattgtaaattaagaaatacacacacattgagaatttaatgtgttattttgtgaaaatctgagaagcaggaatgggatttaatgatctcaactgtcatccatctgaaaaacctaacttgtgattttaaataagatggcatactgccttccactattcccttttaaaaacaggaaatgtccctgcttttatctttatgaagttttatttatgaataaagtttgtactatttaaaaaaaaaagaaatacacaaatctttattgaaacaattacagtgaaaacttgggtatatcaaaactcattgaatggtacacttaagatttgtgtatttcattctatgtaaattttacctcagagagaaaaataagcattgcaatctttgctgaagtctttaagggtgaagtgtactaatgctggccactgccatttaatttgaaatgaatgaaaaatacgtgaactgatggatagatgggtagacatgtgataaagcaaatacagcaaactgtcaacatatgtaggatctaggtggtgggcacgattctttcaaactttctgtatgtttgaagcttttcgtagtaaaatgtaaggggaaaaacttttaagacatactcagcctactttaacactgagaactttttagtctaaacatttgactgtttatttttctgtcctccttttggtttatttttacttggtcaacctttttatgagacttccactctcgtaatgagattattctagactcaaagcttttattgaccttaaaagcatatttctctttaaagaaatagaaacattttttaaacagttgacatatttatgctttttttgactattatttcataatagtagcagaaaacttttgaaaaacttgtttgtactggtgagattatttgaaaaagtagaagtattcaaagttaaaatgtgcaggccagtcatggtggctcatgccttgccagcactttgagaggctggggtgggaggattgcttgaggccaggagattgagatcagcctgcacaacatagtgagatcccatctctatttaaaaaaaaaaaaagtatgattataaacctgatttttagatacaaactttattgccaaatgaattatgaaaacaaaatactattctgaaggcagggcattatagtatctaataagttcatgaatgtggaagtttggaccaagggctaggaaaaaaccttatatggtaaatcaaattgagattaaagagagaacagaaattaggcatcacgcctgtaatcccagcactttgggaggccaaggcgggtggatcacgaggtcaggagtttgagaccatcctggctaacacggtgaaaccccctctctactaaaaatacaaaaaaaaaattagccaggtgtggtggcgggtgcccgtagtcccagctactcgggaggctgaggcaggagaatggcatgaacccaggaggcggagcttgcagtgagccgagatcacaccaccgccctccagcctgggcgacagagtgagactctgtctcaaaaaaaaaaaaaaaaaaagaaattggacatcacctcattaccaaatgcaaatcattctgatgcattgctgaggataaaacatgattttgtgggtgggggacagtctattatggaaggaacactgaattaggagtgagacctgggttctaggatttgatcttctgcttattgcctgtggcccttggaaaggttatttaaccctactgagcctctggtttttcaaatataaaaacacttgctgaccaagcatggtggctcaatgcctataatcccagcactttgggaggctgaggcgggaggattgcttgagcccaggaatttgagaatagcctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctactttaaatgcctgctaacagatgcctttgtgctttccagcaaagtatctgctggtcctgtcaacacagctttgatcctgtgtgggggtggtgaattcctgctcatccacctctctgcggctccccaactcctccctaggcagcctgtgtgtcagtttgtttttacctcttctataccgtttacttcagggtataatatgcctacttcacacaccagtctgagagccccttcctcagggccggtgatcatatctctgatttctctgaagcccttgcctagtacctagcaaaaagcaggaatattcaataaagattttggggccaggcgctgtggctcacgccagtaatcccaacactttgggaggcctaggcaggcggatcactcgaggtcaggagttcaagaccagcctggccaacatggtgaaaccccgtctctactaaaaacacaaaaaattagctgggtgtggtggtgtgtgcctgtaatcccagctacttggaaggctgaagcaggagaattgcttgaacccaggaggcggaggttgcagtgagctgaaatcatgccactgtatgccagcctgggcaactgagtgaaactctgtctcaggaaaaaaaaaaaaaaaagattttggttattgtctgacccaatagggcattgttcaagttcttttccaacctccatattcatgcataaaccacacaacttcttgttgaaggtttcctgtatgtttcctagcatagcctattagtgtagtaagttaggcaaaacatagactttgaagccaaacaaacccaggattgagtcctggctccaccatttactagttatgcccttccatgaaccttctgaagctcagttccctatctagaaggtgggataatatatctgccttactgtgttgtcctgaggatgttcctggaacataataaacactcaagaattgggagctgctgttagtgtttccttaagtacttaattcagtgcatactttgtagatattataaaatgaataaaataaagagctgccttaaggaccttacagctaagggaaaaaaagagtgaacaagcacgcacataagtaactcatggagtgcgctggtggtacaggaatggcatggagcacttgggaagttcacagaccaacaaatgatacatccctggtctggtacagccaaaattgcttcctggtcttgagactgaccatcttagtattcacttgataaaaggttgtttttgctttaatcttatattattaataaactgctacataaactgtatatcagcatgagcaatgctggtaaaaggccgagcacagtggctcaggcctgtagtcccggcactttgggaggctgaggcaggcggatcacttgagcccaggagttcgagaccagcctggccgacatggtgaaaccccgtctctactaaaaatacaaaaattagctgggcgtggtaacctgtagtcccagctgcttgggtggctgaggcacgagaatcgcttgaacccaggaggcagaggttgcagtgagctgagatcatgccgttgtactccagtctgggtgacagagtgagactctgtctcaaaaaaaaagaaaaaaaaaactcagtaagatttcagtaagataactgagtgaagatgataattaggtttctgtggtatcagctgaattttttaatatacaaaaaaggcacttgattagtatttttgttattgtggtttcataagtccagaagtttagaactggctttagtaacttgataaacctagcatcatttaattctgttgttgatgacatgctggggtcaggggttcagtgggacatttgggactaatttcttcacatcatctcttgctttccaaggctttcagtaaaggatgaagagaaaattggcttttaactaatttccagattttttgatggaggggggggcactctgaacaaagtaaatcctgagaagatcaggtagaaggaagtggattgggttaatacctctttaggaataacagaggagatgaggactgatttctgccatttatctcttttatcccacttaatatccacttaatgttttcagtgaaaggataccaatagcctggcaggcataattcaaaatttaatattatccagccgggcatggtggctcacacctgtaatcccagcactttgggagctcaaggcagaaggatcgctttagctcaggagtccaagaccagcctgggcaacatgacaaaaccccatctctataaaaaatacaaaacttagatgggtgtagtggtcccagctactctgggggctgaggtgggaggatcacttgagcacaggaggtcgaggttgcagtgagccgagattgtgccactgcactccaacctgggcaacagagcaagaccctgcctcagaaaaaaaaattatccaggccaggcgcagtggctcacgcctgtaatcccagcactttgggaggccaaggcgggcagatcacgaggttaggagtttgagaccaacctgaccaacatggtgaaaccccgtctctactaaaaatacaaaattagctgggcgtgttggcacgcacctgtaatccccgctactcaggatgctgaggcaggagaatcgcttgaacctgggaggcagaggttacagtgagccaagatcatgccactacactccagcctgggcaacagaacgagactctatctcaaaaaaaaaaaaaaaaattatccatagttccttcaacagacgaatggtcaaacaaactggtacatccacacaacaacctggatgaagccccagataattatgctaagtgaaaaaatgcagtcccaaaaggttacatactgtatgatttcatttattctttttattttattttattttattttttaatttttagagggactcctccttgcagaccagggctaccccataggcagtatgcccagaataggagcctcatttattatcaaaatgacaaaattgtagaaatggagaacagatgagtagttgccacaggttaggaggggatagggtaggaggggaatgagcatggctataaaaaggcagtatgagggatccttgtggtaatggaatgttttatagctcgactgtatcaatgtcaatatccaggttgtgatattgtactacagttttgcaagatgttactattggaggaaactgggtaaagggcacatgagacctttatgttattttcttttacaactgcatgtgaatctacaattatctcaaaataaaaagtcaaattttaaaaaatagctacagtaatttccacgtggacagccacacagtatgtggcttaagacccaaatctttaacataattaaatagagctacaaaaatcagtagcttatatagcattttgttttgttttgctattgtagaaaaacttggaaagtatggataagaacagaatgaaatagaaataggacagtaaagataacaactgtaacacttttgctgtgtttcattctgttttttgtttttccggagtttgcatatatgttttgtttggttttttatcgtaactgggaatatacagtttatttagttttgcattctgctttcttgaattcttttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcctgttctcaatgagctgttgggtacacctcccagacggggtggtggccgggcagaggggctcctcacttcccagtaggggcggccgggcagaggcgcccctcacctcccagacggggcagctggccaggcggggggctgacccccccacctccctcccggacggggcggctggccaggcagaggggctcctcacttcccagtaggggcggccaggcagaggcgcccctcacctcccggatggggcggctggccgggcggggggctgacccccccacctccctcccggacggggcggctggccaggcagaggggctcctcacttcccagtaggggcggccaggcagaggcgcccctcagcttccagacggggcggctggccgggcggggggttgacccccccccacctccctcccggacggggtggctggccgggcggggagctgacccccccacctccctcccggacggggcggctggccgggcgggggtctgacccccccacctccctcccggacggggcggctggccgggcagaggggctcctcacttcccagtaggggcggctgggcagaggcgcccctcacctcccggacggggcggctggccgggcggggggctgacccccacctccttcccggacggggtggctgccgggcggagacgctcctcacttcccagatggggtggctgccgggcggaggggctcctcacttctcagacggggcggctgccgggcggaggggctcctcacttctcagacggggcggttgccgggcggagggtctcctcacttctcagacggggcggctgggcagagacgctcctcacctcccagacggggcggcggggcagaggcgctccccacatctcagacgatgggcggccaggcagagacgctcctcacttcctagatgggatggcggcggggcagagatgctcctcactttccagactgggcaagccaggcagaggggctcctcacgtcccagacgatgggcagccaggcagagacgctcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccatctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctaaggcaggagaatcaggcagggaggttgcagtgagccgagttggcagcagtacagtccagcttcggctcggcatcagagggagaccgtggaaagagagggagagggagaccgtggggagagggagagggagagagagagggagagggagagagagagggagagggagagagagagggagagggagagagagagggagagggagagggagagggagagctgctttcttgaattctatatcatgaagatttctctgtgtctttgaaattcttcaaaaacaattttcatttggctacatattccattatatggatattctataacctacgtaatcatcctctattagatttattttccattttgtatgataatatcattatatataaatcttccatttttttccttaaggtgggtttttgtaaatggaattactaaatcgaagtgcatgaacatttttaaggctttttgatatatgttaccagattgctttctggaaaagtggtactgatatatattctcaccaataattgcatgagaatggataaggtctaagtcaggaagaattagaaacagagttctggagcataaagatttttatctttatcaaaaatataatttctcaaccacagcactactgacattttgggccagataattctttgttgtgggggctgtcctgggtattgtaggatgtttagcagcatccctgacctctacccactagatagcaatagctgccctcccgctgtagttgtaacaaccaaaaatatctctaaacattgggaaatgtccacctgggtaacaaaattgcccctggttgagaaccactgatccaaagacttaaatgtgcaatgagacacttattcttagagtttctctactgtgtactaatgttctgaagcttagctccttggagctctttttttgtggagtatatatgtgtattctgcatattgcctgcaatgtaaaagaggctgatcttttttttaaggctgtgtaaatggctttgttactcctcattgtgtatctttccctactgacatctgcctggtttcctggttatgagaagaaacttaaagtgatggcacttccatttgctttgccctacaaaaatgatttgccttgaaatttaatatggtatttggaagtgtcagtcagcgtccctatactttgtctttatcttctgagtaagaagggtaagagtaaaacagaatgagaatgactttggatctcttgagtctgtatgtaaaggaaaaaaaaaggagtggactgggatttttgttaactaaagttcaagtcttaaaaactaagaagcctattttaagcagcaggagttcccagttgaaggtctgttccctgtatctacagctggctttaccttcagttcttgatggaatgcacctgggtaaaaggccaacctcgtttctataatatttcagaacatcttggagtcctgaaacccatactctcttcctgacataaaacttgctgtgtccagatcttctagtgcttaggttatacttgataaatttcattaattcaaagaagataagctgcagtttcctctgaaaaatgaagagcacacaaatacattaataagaacatgaactctctgaaaatactgtgtccttaaattatatgaaactcatttaagtctatccttcagtaaagacactagcctttgaagttctgatatgaattcattgttcttaagtgtaagatttaggtttaaaaagttagtttgacattgactttctatactggctgtttcttttctgtttgtcccccttaggagcagtctcacaggtgctggacagcctggaagagattcatgcgcttacagactgcagtgaaaaggacctagattttctacacagtgttttccaggatcagcatcttcacacactactagatgtaagtctgtctttttattattcttcttttttggtgaattgaatattggccgggcacggtggctcatgcctgtagtccaagcactttgggaggcagaggcgggcgtatcaggaggtcaggagactgagaccatcctggccaacatggtgaaacgtggtctctactaaaaatacaaaaattagccaggtgtggtggcgcatgcctgtagtcccagttaggactgagctgaggaggcggaggcacaagaatcacttgaacccgggaggcggaggctgcactgagccaagatcacaccactgcactccagcctgggtgacaaagcaagactctgtctcaaaaaaaaaaaaaaagaaattgaatatttagcatacctttttactttacatgaattctcagatgtctatcataacaattcttttcagttgccttaagcctatgagaaatgtgggaaatcatccatcaaaaattcatgattgaaatacagtatatggccgggcaccgtggctcatgcctgtaatcccagcactttgggaggccaaggcgggtggatcacctgaggtcaggagttcgagaccagcctgaccaacatggggaaaccccatctctactaaaaatacaaaattagccagttgtggtggtgcatgcctgtaatcctggctactcgggaggctgaggcaggagaatcgcttgaacccaggaggcagaggttgcagtgagccgagatcgctccattgcactccagcctgggcaacaagagcgaaactccatctcaaaaacaaagaaaaaagaaatacagtatatgtacagtacaaatgcaacagagcctagcaggctacaatgggaaaaaatttatatatctttatatttataaattatatgtacataatgcatgcaagtggtatgtgagttttaaaaaagagtagagtacaatcctactttactgaattatcttgtatttctgttaaaagaatccattgaggttagctgtgattactttttattgctttgcacattactttaaaacattatacctccagcatgagtataggagagagaaaagcaaatgagatactttgcaataggctgtattcccacacacatttcatatttaacattgttttgttccatagattcaatgtcttctccttaaaacataagcatatactccatctttaaatattacaggctccactgacagcagactgggatacaaaggaaaaaacagaagctgaccattttcatttcagtcacattttaagtaaaatacctttcttagagaacttggttcacttcagcaatgaaaactcttgggtggtttcgatggtatttgaacatgttagtctttttacaagaaaaatcttcccttaatgagagaatcatacttgctttggggtgcctagaactgtttggtgctgaataattcaccatatgatgtaaatgaagctaaagcaaaatttcccagaatgtgttctacagagcatggctctgggaggttgctatgggtgttgccatggtgggagggggaagtagatcttaaatttattggttaaattatttattgactaaataagtttgggaaatgctacattctttagtctttttatacagatccacaatgggtgttggtatattgatagctctgagatgatctaaagcaaagaaacctttttaactttctttatcagcatttctcaaactaatttgggcacagaacttttattcacaatcctgttgagttctgttttgatgaggaccagtttgggaaaagctcagctaagagtgtttgttgcattatgcttcagctttacactaaatgcagccgtaggtatctaacagttgcttctttccccaaatgtggtcagttcaaattaattatcagattttcatggctagtttggcctttgtatatagtgtacatattaattagggctgactaactgttataacatgtgattctaaaatttgagtggcttaacagaatagaagtttacttcttgctcacttcacagtccaatgcaggtagatgagggaggtcttttccacaccgtcattcagagacccaggcctcttccactaggtcacactgctatttcccagggtcttggaatcttctactgtatcctttgtacctagccagcaaatgagagaagagagaacatggagaatcttgcagggtcaagcttggaaatgggtttatctcacattctttggcaactgctagtcacgtgctcacctggatgtgagagctgaggaacgtagtttagaaatgtgctcaggaagataaggaattgggtcttctctttagtgtaatttatcttaagtagtatctattcactgtcattgctgcagaaagttttcacaattgtgtatttcccactgaagtttataccctttactagaactagttagtgcaatatttagaaaaggctacagcagtgtgtggagattttgtttattttattgtggtcagtgcttaggtcattgccaggtagatttactgaccttcttttgaatcaaggactttttgtaacaaagactttttgtaatttaaacactgagagaagcccaaattggtttcaaagttgtattttttcttactgatatagcaaggtatctgagcacatcaagcttgagattgcaggggagaagcaggaacattactggcttacacaaggaaaggggcagctattcagacacgaataactgctgcactgtttggtataaattgtcacaatttcagaagagattcttagatgttagtgagaaaaacatacttaactttcctttgcatttgtttacattataaagaagtatctgccttattggcatctgccctgtcagtgcaggtcaatttgaaagaggagctgttggactgaaaatgaaccatgcctattaaaaaggtgcagtataagaccaggagtagtggctcacacctgtaatcccagcactttgggaggtcattgtgggaggatcacttgagcccaggagctcaagaccagcctgggcaacaaagcaagaccccatctctacaaaaaatttaaaaagcagctgggcatggtggtgtatgcctgtggtcccagctactccagaggctgaggctgaaggatcacctgagcccaggaattcaagggtgcagtgagccatgatcacactactgcactccaacctgggcaacaaagtgagactctatctctaaaaaaaaaaaaaaggtgcagtatcttctgaattttgtaaacaggtgccatacatgagctccagtcaaattaatgactatgaggccgagccctggacaatatttgcatgcatgtggttctgaatctccaaactgagctatttctaaatgaaagtttaggccaggtacggtgactcacgcctgtaatcccagcactttgggaggccaaggcgggcggattacctgaggtcaggagttcgagaccagcctgaccaacatggtgaaacccatctctactaaaaatacaaaaatgtggtgggcacccataatcccaggtacttaggaggctgaggcaggagaatcacttgaacccaggaggtggagattgcagtgagccgagatcgtgccactgcactctagcctggtcaacagagcgagactccgtctcaaaaatgaatgaatgaatgaatgaatgaatgaatgaatgaaagcttaatcatcatgaatgaaataaaccatcattagaatgtgccctcataccctacatcccataaataaggcttattaagctcatttcacagctaacaggctacattttaataatataatcaatgaagaattcaagtgactgccatatagagaaatctaatcatttaaaaaattttaatatttaaatgtttgtggtatacattaaggaagaaaaatggctatgacgaactcttgaggagcagctgttaaaatgttggattttcagtctgggtgcagtggctcacttctataatctcagcactttgggaggccgaggcgggaggatcacttgaggtcaggtgtttgagaccagcctggccaacatggtaaaaccctgtctttactaaaaatacaaaaattagctaggcatggtggcgcatgcctgtagtcccagctacttgggaggctgaggcaggaggatcacttgaacgcaggaggtggacgtagcagtgagctaagatcacaccactgcacggtagcctgggagacagagcaaaactctgtcaaaaaaaattgggcctttcatttttctttcttcccatgttccacataccatggttgatttggaattgttttattttgcagaatcaaaacgaattcttctgcctttttttgtttgttgtttgttttttgtttaagacagggctctcccaggctggctcactgtagccttgaccttctgagctcaagcaccctcctacctcaaccacccaagtatctggaccacaggtgcaccaccacactcagcccttttttttttttgaagagacaggtctcaccatgtttgcccaggctaccaggctagtctcaaactcttgggctcaagcagttctcctgcctcggcctcccaaagtgctgagattacaggcatgagtcattgccccagcatgaattcctttttaaggattccaagtagggacacccagggggcatagttttatggaccatgaattaattaaggctaattaatcccactgagccattttaggaaatatctttaccatttttatgttatttctgttaactcaataacattctaaatagctaggtatgaagccataattttaaggctgacaaaaagaaacaggattaagttcctaagaaaaactaaagattatctatgacttctttattttttctagtcatgttcttaaaataataacaagctcaaaatttgaagaagcattattagaatttgtttacaggaaacaaaactgccaaactgaaacatttacattaaaatggagaagtactgtgattctactgaaagggaaatgctttctgaaaacctttgaatttgagtaaaacacatttagtttaatctgtagttagaaactgatacagaaaactctaaatatttgctatccaagtggttccagcctggcacacatatgcagcttctcattttgtgggaagaaatacagaggcatgaggaactgcttggtccagcttgttgcagtatgcctgtatttaaaaattaaaagcactggtgctaagatgatcttcgtatgaaatgtatagatcaattagtaaagtacaatttgacattagtttgctaggactgccataacaaagtaccacaagttgtgtggcttaaaacaacagaaattgattgtctcatagttctggaggctggaaagtcctaaatcaaggcattggcaggggcatgctccctccaaaggatccagggaagaatccttccttgtcttttccagtttctggtggttgcctgcaatccttgtcattccttgacttgtagatgcatcattccagtctctttttccgtcatcacatgtcattctctgtgcgtgtgtgtctgtgtatttacatggccttcttagaaggacaccagtcattggacaccctaatctagtatgacatcatcttaattaattacatctataaagacacttatttccaaataaggtcacattctgaggttctgggtaaacataaattttgagtgagggacaatattcaccccagtacagcatggaaaactgatttaaccctgaattaattcttcacgtgtgagtgcaaattacacaaatctaatataaaataatgaaatgttaccctgtcatccattaattatgctttattgggaattggtgttaaagtgttatttatgtcttgtaatgatattttgaatcagttatggattggaatttgtatgtgatacattggaaggtcagtgggtgggtgagtttttgatggactgaaaagccatgttttttggattaaaaacattttacaaatattatttggtagtagttttcagtcttctcagtttctagtataaattttcctattaaaataataaatgtttagtttgtaaatcaccagtgttacaaaacattgttaaatgacacatctctctgccaaactttgacaactaagttttaaacattaactggccatctgtcatacctctgaacagctgttagcatttgttacgcactgctgtttccatagtaaatgcccccacctaattaagattatttttgtaagaagtcttaaaattgtggtttctgaaaatataatgggtgattagattaatatagcaatttattgatgaatttttaaaattgcagtagcaattaatttaggagtctttataatattaatttataagtagacttttataatagacttagtaacttttaaatattgcattagcaattaactgatacttggaatctttcatattttgtatggccaacatctttattataattttttaccgtttagggagagttagcatttttccatctggcctggagttagccatggaaaactacaattcttgatttactatttcgcttttttgagatgacattaaattagtagccatatttagaagagcttatttttagaactcagaagtttcctaaaggaaaaagatggaacttctacaataatctggagataatgtttttgagcaatttggggtctgagaagtaagttaaatacaatgttaggtttggatatttaaagagattgccaatcaggaaatgccaaagctaagtttcccaagaatttgtagtccagccaatttgcatttaaatgtctagaataataaagcctatctgaggaccttcagaggatgagctactagtaatttctcagggccccatccagtcttaagagtcagctttggcaattatgaaaccagctgcacagtgggcccctgcccagtggtggtggtctttgtgcttcttgcctcctggggctgtagactgaagcgcattgctgttccctttgaatttgagtgtctctccactgttttctaactggaggggcaaaacctcccatatctgtttctctccatgtattgaagtagtattgtcagtgtaaaagtacggcatgaaacaaaatacctgaaagctagaaataccatatgtcgtgaatattctcaaagtatttttccttctttcttaatgtaaataaatgtcaataaacttagcaaaaaaaaaaaaaaaaagccgctaagcatatggttctttgttaagcagcaatagaaaactgatagaaccaggaacaagatgaggattgtccactccccacttctattcaccattgtcccagagactctggccagtgcagctaagacaagaaaaagaaattcagggcatgaagattggaaaggaagaagtaatatcatcctttcccagagttgttatcttgcatgtagaaaatactaaggaatccacaaaaaatctaatagcattataggcaagcttagcaaggtcacaagataccagattaatatacacacattatctaaatttctatatgtgagcaaaaaataacccaaaaataaaattaaagaaatattcacaatattataaaaagaataaaataggaataaattgaacaaaaaaaatgtaggatttgtatactgaaaactaaaaaatgctatgaaagaaagatctaaataaatgagcagagatatactgttggattggaggacttaatattgttaagatggcgcttttctccacattgatctatagattcagtgcagtccctatcaacatcccagtaggatttctttgtagaagtcaacaaggtgatcctaaaatttatataaaaatgccaaaacaattttgaaaaagaaaaaaattggataactgatttcaaaacttactataaggctacaataatcaaaatagtatggtgttggcataaggatagatatacagatcactgaaacaaaaaagagtccagaaataaaccctcacctttatggtcaatttattttcaacaagattgccaatgcaattacatggaaagggggatagtctttttttttcaaatggtcctggagcagttggagatccatatgcaagaaatgaacttagaccctgtctcataccatacacaaaagaaaattgcctcaaaatggatcatagattcactttaagagcttaaaactataaaacttttaaaagaatataggaataaatcttcattaccttgggttaggcaaagagttcttagatgtgacacaagggaatttggggggattacggaaatgttcttaagctggattgagatggtggttgtacaactatataaatttactatcatcccactagatttcacagggccattacactaaattaaaatttagctttgtggctaagaatttaccactgattcaaaaatactaaatatggttttttctcccaagaactgttttattaaccagcgtgtagttgtgccttatggaagaagtccaaattgtgttttttgtttgaaaatgttatgaattacataactttatagattttcaatatggaagacaccttagagcaacttattttagttcattccttctacattcaagtacatatttgccatttccaaaaattcacagctttttgatacttttttaacatcaattttttggtcttttttgttgtggcaagatatatataacataaaatttgccacttgcaccatgtttaagtgtacagttcaatgacattaagtatattcacattgttatacaaccatcatcactatccatctccagaactctttcatctttcccaactaaatgtctgtacccattaaatactgactcccattcacccctctccttagcccctggcaaccacccttctactttctgtccctatgaatttgactactctaggtaccacgtatataagtgaaattatccagtatttgcccttttgtgtctggcttatttcatttagcatgatatcttcaaggttcatccatgttgtagcatgtgttagaattttcttcctttttaaggctgaataatattccatcgtgtgtgtatagtacattttgtttgtctactcatccaatattgatgttttgtggttgataattatgtactaggaaaaaccaaattctcagaataaggctgtctaatcgtagggaattctgcctcgttccatctccacacaattactctttctaggatgcaagttaaatcttatgctatacatcttcgtgaaggaatgtgtgatttccactgaaagtattaatgactacggaagtccctccaattcccttatttgttcagataaattacttcttaaagcagggtttagaatttactctagaataccaagaataatgaatcagcttgtcaccagtatcagtgttacccactgagtgccattctctttttatgacaccatgatcaactttaccaaaaggcaaaggaatttgcagaaagccttctaagtacaataagcactgattcttctttatgctatgctcaaggaaaggaggggtttccccctagaaaggaatgtgatatgctcagttaaagaatgttcgatggagtggcttgcagcattcataatccaagaacatagctgttttcttctctttgtggcccttcaaacatgatctcataaaactcttctgccagactgcctttgtgctattctctttaaatttttcatgacagaaattcatttttgctacagctacaccaagtacaaatgcttggtgtttacctatgcaaaataaaaaaggtagcaaaagccaaaaataattaaataaaatattatctgacacacctaatgtaacataaatgttaccttttaaagcagcacattaataattgtatgttcatttaatgtaaatatcatttaactcttgtagttgcttaagaagagccaagctaggaaatgtgattttaacactttaaaaaaatagaaaggaaattaatatcatagtgaaaatttctcatagttgggcaagctcttgtatctgatactaaaaagtaccgtatttcagaagattttattaaaacaagataaaatctgcctatattatatcatgtaactggtttttttcctcatgctttcttttgctcaagaataggcattatgatttgtgttttacagggcttaattttagagttatttgaccacttgaaaaaggcatagagaacagtcaagctaggtcatctgaggccagtgtttgagtttctcagaaatagctgccaactgaccagaaatctgccacactggcctatgttgttaggccaccaaaggcacagtcttcttggattgaactaggaggtcaagcaagtcttaatttcttgaattcaaaaataaatccctgtaagtgcgatgttctaataggattagaacaaaagcagccctgtatacagacaaataaaacctaaacaaaacaagggcctccttagaggttcttttgctgtcaggatccaaaggatttttgcagctttttcaggaaatcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactccatcctaggcaacacagcaagaccccgtctcaaaaaaaagaaaaaagaaaaaaacttcttcctagtgtttaattgtagctccttaagtttttgaaaatgccattttaaattttgcaatgtttctttcacacttacgttgcccatcatgcaatctttaggccactgctaaatacactgctcttctccaagcttgaactacatgatgtttaatgatgccaaggatctttgaaaggactctgtgtgtgtgtgtgtgtgtgtgtgtgtgtcagggcctcagtctgtcactccggctggagtgcggtcatgcaatcatagcacattgcaacttcgaccttccaggctcaggcaatcctcccacctcagcccttcaagtagctgggattacaggagtgcgccaccacacctggctaatttttgtattttttgtagagacgaggtttccacatgtggcccaggctggtctcaaacacctagcctcaagcagtctgcccaccttggcctcccaaggtgctgggatgacagatgcaagccactgcacctggcctcaacaagtttatatgtaaacttgagcaagaaaaatagatttttagatcttacaaagttttctgtgatctccaacttcagaaaatcagttccagtacagtaattgaatatcagttctctgtgtttcagtattaaatcagctttccctaatattttgctcaatttcaaatgtatatgagaaaatacctgttatgtattgatggctgatctgctcagttcactgaaaagatgtgacattgaaactttgttcctatttacccacgtaattcacagaaactgaagaaagttcttaataagatagtcagtgtttccagaacaagttatttcaatggtcattattgctacacagtgtaattccgtgcacactgttattatctgttttattaggatcatcacagacacattcattaaatattttgcagctaaatatttgattcttgcaaactttcattcttttccagcaggaaacttcttcagtatctataaagtaagtgataagatgatggttgctaatgaacatcaatgttctttgcaaccctacaagcctatgcctacagtatagttgcaaaagttatcaacttgtctgaaacagtatacattctggtccttagatttggttttctctgtgcaaaaaaagttagtgggacatacaactcagtgataattattttatagcttcttaccatgcattccattttaaatgttgatcttgataaatactgcacataaactatgagcaaaacacaggtttctatttgataactaagaaatcagaagataatgtgatataatgagtatgataaaaaatgaaacttgatttagtgctttgaatgtaaataaaaggtgacatattaactgattttatcatctttatgtttgaaagtacaatctcaggagatttgaatttaatatcactaccaagtttattctgcttcatttgaaaacccatgtcaaatgtagaatgtgttctctttatggaactgtggcgacacttcctaagacagaaagatgaatgaagcgtgtcggtgtaggtatgtgtggtcatatctgactcagtaccagagatttgcagagagcaggcctatctgtgagacaatatgagacagtctgtttcccttgcagctgttcacatttccttgttttgccctggtgttgtgtgtacatgttttttgttttttgttttttttaataaaaagtgctgaatttgggtaatgataatttcattagaaaaagagagtaaacagtaacagattcattcttgttttccctctagggataatttattaacattcttccttctctcttcctcccccttcacacctcagctttacaaatacacctgataccttcaaatttcaggaaagcaaatagcaaaaggaaatacattttgtcattccaatataacttgaatttaagcttctagagcagggattcacaaactatggccctcaggccaaatccagctggccacctgtttttgtaaataaagttttattggaacacagccatgctcattcatttatggattattaacagccgccctcatacaacacaacagggtttagtggctgtgacagagatcatatggcctgcaaagcctaaaatatttcctatcttgccaggataggattaggatcctgatattctttttttttttttttttgagacagagtctcactctgttgcccaggctggagtgcagtggtgtgatctcggctcaccttaacctccacctctcgggttcaagcgatcctcctgcctcagctaccttagtagctgggactacaggcatgcaccaccacacccagctcatttttgtatttttagtagagatggggtttcatcatgttggccaggctagtctcgaactcctcacctcaggtgagaatcctgacattctttaacatggcaaggcttgtaattgagtagctaatagttttcaaatcatattgagtgtatttttccctgcagcctataaatagaattttttacagcttttttcccaagtatttgccaaagatatctccctggcacaaggcattgtgtattactgaattctagtaacaagctgaggagatctggatgagagaaaggacagcatatcagcagggcagggtcaggtccctgctactctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttaccttgaaagttgtataaagtaagtcagacttaaaagatacaaaagaaagaattaaatatagtcaaaacacatttcttaattttgagggaaagtttttaactgcacatgcaggatcgaagagaaataatatctggttcctaaagaaacaagctgaaataaatattcctggtgtgtttattttatgttactctgaattttttttaaatctatttacaatttctatgtactagtccaaatataatacttattttttctagaggaagcatttcttaaacactactatgtactcagcctcacgctaggggctattacctaatgtcagagaacccgagtctggtcgtgggaaagaaaaagaaccacttaaacagcatgttctataatgtacctcagacattcagttccctcttggctgttgatgcccttggtgtggcagacaccccagtgttggctctgtcctgagttgcagacgtgtggtttctgcatcgtcagtatactcagcacctggtctcagaaacgttctcgtcccctgcccccaggggttaccacatagctttttacttctgagtcctcttgtcctcctgggcagggctgtatccagatggctccagccaggctaccttctgcagtgtctccttgactcatgggaaacacacacatgcttaactcaacatacactacaagcatggcctgccccaggcggcctccagtcatgaaagaggcaggcaccagtctctttttgcttaggaccccaaatgctacatgtcaagctgccccaaggactctctctcacacagagatcctttctagtgtaccaaggtgggcctataagttgctacaattcagcaagcatccctccagagaatgagatagtgagctcttctggctggcacctccagtgtctaatgcgtggttcttttggggcatctaccatccttcactttgtatgagggagggtgcaatcccctctcctttcctcccgaacaagaaggagaagggaataatcaaatacttgctcttcttagtcctgtgactcctacaaatcccagacttctgcctctataggcagaatgaggggtcctggggtgaatatggaagggccattttgactgcctttcagcaagcccaggagaagtggtctagcagctttatagcaggttcagtgccatttacttcctcttggccttagctttgggctttagctgaaagtccaagactactggtaaggtcccaagtaacattttatatattctttatatatgatagaatggggggtgggtaaagggtaagaaagacaagctgcagtcttcctttgttctcaaaacccagctacctttcatttgccccagaccttgacaaaactctacctagatttgaaatttgagtcctgcatatctttgcaggcagcatataatatgcagatgacccatgagaatgagaaatccaaaagcactatgtttctaactactgtttttaaacacttcaatgttacatcgcattcgaacttttttccattgatgactttttatttacctgctttgccatatttctcaaatgctttgtatatgctatggatatcactaaagtattttgagtctctaagacaaaaatgtagaaattggtgggggaaatgaaggttgacatattatgcatatacatcaagatactttccaacttcgggttgcccactgagatcattgccagttgttattgctggggaccaaactacttactctctggtctccaaagggttgaatccttcatacatttctgggcctttggttatacagatttttggaatttgtgagctctttgaagacagaaactcatctttttcatctctgtatccctagtacatagaaccccacattttagtacctagtaagacttcaataaatattgagtggatgggtatgtggatgaaccaacaaagggtcacttctctctgacagtgacaaaatgagcccattcctcactccctcctgcttcagttcttacttgcccttttggttgatgagccagcagccgagattcacagtgtattctttgccacatggacaccatcctctctatcctgtggctgccttgagaggtgcagtttctaggacttgagagctgcagtttttagaagaagcagagcccaatgcccccacctcaggtagaagccccaccttttaattccttcccattgtatctgcctttcatattaagcatcccacctccccctcatcctgccactacttccactgaactttaggtgagttgaatttaatttaagtgattgaactggatcagaccagaccaaaggcgtggaaaaaaatttggtctgagtattttccttggagcagtgcctcaaaagagattccaggcacttgtgtgccacctatgaagttgtatggatagaacagcggttctcacttgaccactctgtgcctcatttttctcatcttaaagtgagaatagtaggggtaaccaactgcgtaggattgtttgaggttaagtgaatgagtatatgttaagagcttagactagtaactatcatctagtaagtgctcaataaaagtaatattgttgctattagtagtagtactattagtactctcaaaagttagcactggacataagattttcaaatacctaaggagtttattaaagcacagatttctggacctccttcttaaattctgatgttgtaggtctggaggggggtccaggaatctatgttccataagtactacatctgattcggccacacgttcttaagaaattacagatataagacctaaggaactgtatatgacatagtaagaccaggtcaaaaattatctccaatttggggagttgtgggattattttttctttgtgagaaaaattgatgtgcatttattaaatgtttaaatagaaacgaaccataatcatagttgaaaatgttggaaataatagtccttgatcaagaaaaaggcaaaacttacagtttatcatggaattagacattataaagtgatggtgctatcaacttgtaaagcctcaaattaaatttgctttttttctcaaacaggtttgagattttttttttttttttttcgagacaaagtcttgctctgtcacccaggctagagtgcagtgatgcgatcatagctcactgcagccttgaccttctgagtagctgggaatacaggcatatgccaccatgcctggctaatttttgtatttcttttgcagagacagggttttgccatgctgcccaggctgttctccaactcctgggctcaagcaatctgcctgcctcagcgtcccaaagtgctggaattacaggtgtgagccactgcacccagccgggtttgagattttataaaaatatttttatgtattcacttagattatttaaactttgcttgataatattatgacacgtcagggggtgactaaatgtgtttttaaagtgttatgtatttttttaattgtgataggaacacttaacatgagctctaccctctcaacaaatcttaaagtgcacaatacagtattgttggctgggcacggtggctcacgcctgtaattccagcgctttgggaggccgaggcgggcggatcacaaggttaggaattagagaccagcctggccaacatggtgaaaccccgtctctacttaaaatacaaaaaaattagctgggcgtggtggcacgcgcctgtgatcccagctactcaggaggctgaggcaggagaatcgctcgaaccgaggaggcagaggctgcagtgagccgagattgagccactggactccagcctgggagacaaagcgagactccgcctcaaaaaaaaaacaaagtgcacaatacagtattgttaatgatagacacaatgttgtacagcagatcactagaacttattcatcttgcaaatgtaatgtagtgtgtgtgtatatgtgtgttttatggtttcttagtttttttggttttgcattttgtttgggtttgggtggtggttttttgttgttttactattttttattgcatgcatgcagtgcaattcatttctataggctagtctggaaacctaatcactatttataacattatttttctgggaaaatatgatcccagttacaacattgacatttctttagagatagaaagcattcagaagatggagactgcccacatatattttacagggatttgggcaaacttttgtggacgagccacaaatcaccatttccctaaaatgttaatataatgttttaaatagagcagcattttactagtctacttatactatttatttaatctctgatttagtagtgctttcttaattaatacatcatttaaaaaattgtccctgctctatcttcacattgcttttgttaggcatttttatgtatgatgtggcccaaatatttataagtcataaaaatttatcttgcattagtataagcaaatctgactataatctgaagaatgtttatagtcagtatttgacttctcaactagcattggtgtacagagtaggtgaagaaaaaaaaaagaataaaaccgaccacgaaaatccccacctgttttagagaagttaggaaataaaagtgttcacaacagccgaggtcatctttaacttttcacttttcaaagcagactgttgactatgaaacactttatttgaggtagaaattaatattttaattgtatttctaaaataattaaatgtatgttcttcagaaagctgaactttggatcatttaggtttgtggaattttagaaatatatttagtttctttcttttttttttttttttttttttttggagacggaatctcgctctgtcgcccaggctggagtgcaatggtgtgatctcggcccactgcaaccttcacctctcaggttcaagcaattctcctgcctcagcctcccgagtagttggggttacaggcgcccaccactatgcccggcaaattttttttgtatttttagtagagacggggttttgccatgttggtcaggctgttcttgaactcctgacctcaggtgatccgcccaccttggcctcccaaagttctggcattataggcatgagccatcgctcccagcgtatatttgctttcttttcagtgtcttctccactctgaattggcagagtcaaaagaaaaaaagtttatgtccttgacttcctgctgaaggataccagcactgattctgttaatgaacagccctagtaaaacaaccataagcctttgtgagaacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtttggaaaataaaaatagatccataatctcatcaccctaacacagtagtttccatttttatatatcgttttctagtcactctccatttgcatataaatttttttatagttgtaatcaaaatgtgtcttttttaacctaccgttatataataagcatatttccatgtttctacttgatctttacaaatataacttctaatgactgcaatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaattagtgaagaaaatttgagtggaaagagaaaataaggctttaaaaaattgttctcttaggctccctggcatttaaccctaagagccattagcagaggcatgactttctctgtgtgggcagatgactatggggaaaaacattgatccggcaggcatttttgcattttctacattacttaaagaaaaattacttgtgtattcttaattaagtagtctaattaattagttctgttcttgaaatcgtttctatttgtgcctgtgtcattttgacatttctaaagggaattggcagtgctgttaatataaaagaaaacttcttattaactttttgtccatattgatttttatggtgagtttggaaaaggatattcagagatactcttccgttaagtttcataaatctgtaataaatatatgttgcagccttgtcattttgctttatatttttcaataaccttttaggttatagttgacagacttttagaacaatttgcttcatttttattaccatcaatactgttcttctatgtattaataacatttgaataaaatgaaaagtttttcaaaataattgttttgcctgccataaaaatccactcataatttttaacttaaaagaatttaacattttgtaaatcttgtgtcatgtttgtattattgtatatcttgtttattttttaggtattggaagaaatttcatgttaccctgagaataacgacgcaaaggaactaaagcgtattttaacacaacctcatttcatggtaagtaataattaaacttccatagaactgaaacctcactttcaaaagaagtttttaaactaccctcataaaatgtagccagcttcatctcatgcatttttatccatatcatatgagactattaagattacaataccaggtaataccaaatattttaagactgttttgtttactttgtgtcacaactgtaaagatactcttggtgaagtggcttttcagggactgtactcatcagacaagggattttctttcttatggggtagtcctttagtcactggaactgtttatgttacttaaaccacaaagaactaaaattagagacagttttcaataataaggaatcgtctgaatctaggtgatatattggaagaattacatctcttttgacaatgcaaaactgctgcactttcttggttcatttctactatatggaaaatggggataacacctgtatttagccaaatataaagctaaatagctaaacaaagctcaaagctcaaaatagataagatactttgctgtggaaaaaggtccatgcttatctacctaactgcaatacaaaaacacaattacagatggaaattcatgttgaatataccattttaaaagcattagccacatcagtttatgtgaaaaatatgtgaaaagtggaaaatttacctcactgccctttgggagaaaatctgacttaaaagccttgttcttataactactattacagatgatactttgaatttttatttatttatttacttttgagatggagtctcaccctgtcacccagggtggagtgcagtggcgcgatctcagctcactgcaatctccgccttccaggttcaagcaattctcctgcctaagcctcccgagtagctgggattgcaggcgtgcaccacgacacctggataatttttgtatttttagtagagacgaggtttcactatgttggccaggctggtctagaactcctgaccttacctcctgcctcagcctctcaaagtgctgggattacaggcatgagccaccatgcctggccacaggtgacacttttaaaataatagtaacagtataatatgtgtatcaaagcaattacctgtgagttattatatatatgctgttttatgatagtgtttctttttttctttttcttttttttttttttttgagacggagtttcgcactgtcgcccaggctggagtgcagtggcgcaatctcggctcactgcaagctcagcctcccgggctcacgccattctcctgcctcagcctcctgagcagctaggactacaggtgcccgccaccacgcctggctaatttttttgtatttttagtagagacggggtttcactgtgttaaccaggatagtcttgatctcctgacctcgtgatctgcccgcctcagcctcccaaagtgctgggattacaggcgtaagccaccgtgcctggccctttatgatagtgtttctaaacttttaaccaagttattgaaataaagtttttttcctaaaagtaactacctggaaagaagcaattaccatattcatccttcctaactctcccacccaagcattaaaggctgaattcaagtataatccttgagagtatttgactttattctatggtaacagcactgtccagtgaaatacaattaggatacaggttctaatgcctgtagatgagtgcatttttacaacctaggtgtataaacacagaacttcgttcaaatctcacctcttttatcaaggtatcttgtaacctctctacccttctcttgaactttctcttctctaactcttttccacttgtttgtattcacctgcataacattctaatgcttgctggcctgccagagcaggtctcttcccagtgaatgagccagggcaatttttctttgtccttccatatcccagcccagttttgttgttctcattgagcttatctcatttagtcattgtgattatctctatttcacagagcaggagaataaagaaactatatgctttattaataatcctcaaatgtgatgaatcacaaatatctgcagttaaattaccgttaatattaccttgttcactgtttcatgcatatgtgctgtgtttccccagattataattcattcccttttagacagcatgtcttctatagcaggggtctccaacccctgggccactgaccagtacccatccgtggcctgttaggaaccaggccacacaacaggaggtgagcagcaggccagccagcattaccacctgtgtccccctcctgtcagatcagcctaggcattaggtcctcataggagtgggaaccctattgtgaactgcgcatgcgagggatctaggttgcatactccttatgagaatctaatgcctgataatctgaggtggaacggtttcatcccaaaactattccccgacctctatcccccacccccacccaccctgccatccgtggaaaaattgtcttccacaaaatgggtccctggtgccaaaaaggttggggaccactgttctatattataaaagtggttaaagatgtgaattcagatgacctggggttgaactccatccttgccaccgtaactttatgaactctgactctgagtcaacctcgtggagtcagaataagaattaagtagctgatatatctactgtgcgtagcacaatgcttgacatatgcttagtgcctaatagatgttatctgatacctattattagttgctccatagtatctatcatgtatagggcacatagtaagttatcagtaaaacattgaatagattaggaacctgcccgtttgcagataggttaggctctccttggctgactgctctgtgcagtgttccatagctagaaacagatatataataaattttggaccaggcacagtggctcacgcctgtaatcccagcattttggaaggccaaggcaggaggattgcttgaacccaggagtcaaagaccagcaacattgggagaccccatctctacaaaaaattaaaaataaactagccagacatggtggcacatgcctgtagtcccagctacttaggaggctgaggtgggaggatcacatgagcctgggaggtcaaggctgaagtgagccatgatggcaccactgcacttcagcctgggcaacagagcgagaccctgtctcaaaaagtaaaaaatgccaggaactgtggctcacgcttataatcccagcactttgggaggctgaggaatgagagtcatttgaggtcaggagttcaagaccagcctggccaacatggtgaaaccccatctctactaaaaatacaaaaaaaaaaaaaaaatagcctggcgtggtagcacacacctgtagtcccagctacttgagaggctgaggcacaagaatcacctgaacccaggagacagaggtttcagtgaggcgagatcacgcctctgcactccagcctgggtgagagtgagactctgtctcaaaaaaaaaataaaaaatgaatttggacagacatgtctttctataaattgctaagtaaactcagctcaattcagagaatgatatagggccgtatgagaccaatagatctttcagatttgaagtaagctaaataaattaacatatacccaaataggagccttttttttcatcaaaatcattacggctcatatagcccattgtatgacagcttatctgtcttctaagtctcgatatgttttgcttttctgaagtcagagagaagttaatatgtgcattgctattagtaaacattttcagaaataataagtaatttttataatttattgaatacctagctaggtgcttaaaagacattttcattcatttatcaaataagtaaatgcctactgtatgccaggcacactatgccaggcactaaggacctagtaatgaataagacaaacaagatccctgccctcatggaacttccactctagtggaggtggggtgggaggacaggtaggagaggtagaggtagacaatgagcaagtaagctaacaagataatttcatatggcaataataactatgaagaaatgaaaggataatggtgcagagattatagtaaagtgggagctgctttagataggggaaagcccctctgaggagtagacatttgggctgagactcctttgaggaagagcaaatgcaaaggcccagagacaggaaagagctttgtagattcaaggagcagaagtcctttgtggctgagatacagttaacaagggagagagtggtacttcctgtaccaagagaggtcagcagaggccagaccaatttatttatttttttaatatataaaataaggccaggcatggtggctcacgcctgtaatcccagcattctgggaggccaaggtggacggatcacgaggtcaggagttcgagaccagcctggccaacatggtgaaacctgtctctactaaaaacacaaaaattagccaggcatggtggtgggcgcctgtagtcccagctactcaggaggctgaggcaggagaatctcttgaacgcaggaggcagaggttgcagtgagttgggatcgcaccactgcactccagcctgggagacagagcgagactccatctaaaaataaaataaaaaatataaataaataaaagccttccaggccattgtaaggagtctgcagttttctcctgattgcagtaggatgacactaagtgatggcacgcaggaaaatatctaatctgtgccttgctggagctgatgtgtagagaacggactgtaggggggataagagtttagggagaccaattggaaggctgttgtgagaggttgtagaggcttggagaaaggtgaggatggtagaacatgggcagatggggtttctgtgttggagatggttacatacaagaggacttgctgatggttgggatgtaagctggtgtaattaaacccatttcacaattccgagaggaaattgtgccctaacaaggtaaagagacttgcttaaggtcactcaccaatcagtggcctcaatgaggttcaagccagatcctgctagcgccaaagcctatgctcctaaaagtcagttgatttataatgctaatcagatttctaataaatttaagttgagctcattggtcattcctaaataagcttttgtgtagataatatcttatgtgggaaatataattctgagatatatatatatatatatactatattaaataagcttttaaatgctggggctttctatcttataagcgtttttaaaatcatggcttcaaaatcttggtatttttaaagaaatattaatagctaaggggaaatatgttaatacttacaatttttttattatgccaaggtttgggagttattcttggcatatttataatttcacacttatttgctcagtcatccgaatttttctttgctttctgattattataacatgaggatttaacattgaattacccaacactgaaaatccagatacttgtagatatttacagtaactaaaggaagaggaaataagggtaaatttaaacgactttaaaattctgtgttttttttttttaagagacggggtcttgctctattgcctagataggagtgcagtgacaccttcttagctcactgtagccttcaactcctgggcaaagcaatccttctgcctcagcctcccaagtagctgggactacaggcatgcaccaccatgcctgtctacttttttttattttttgtagagacgggggtctcactttgttgcccagactggtcttgaactcctgagctcaaacagtcctctttccttggcatcccaaagtgctgggattacaagcatgagctaccacacctggcctaaaatctgtatctttagaggtcatcataaaagaatattatctcactgattacttttttagttattccatttgaaaggctgactttttaaaaagaatatttcctttgcttattgcagctgtaaaatatgaaacattaaatagtcagattttttccactctagtctgatgttgttagttgtcttatacatatccttactatagtacaaaaagtgaaagtgtttttttcctattacacgattgttacgtagttaaaactgacagctatttcagcttagtgacaactgctcactcatacgtcttaacatatttgaagaaaaatgttcaaattttggtttccctattttttattttatatactcttttaagcttttaaaaagatagtctgtaagtggccccctttttctgtttggatatgaattagagctttaggttaagtttcgttttgtggtagcaatcatttacagtgccaaattgtggttaatatcgagtatgaccttatttggtgacatcatttaagcatttttcttttagagtccagtttgagtattattttatgattgtgggcttaatccttccttgtaaataatgcattaaatacaaatgtttgcttatataatttaaaagaatgagtagaggcctgtaatcccagcactttgggaggccggggtgagtgaattgcatgagctcaggagttcaagatcagcctgggcaacatgatgaaaccccgtgtctacaaaaaatacaagaatgatctgggtgtggtggcacatgcctgtggtcccagctacttgggaggctgaggtagaaggttcacttgagcccaagaggtcaaggctgcagtgatatgacgaacataattttagcaaatgaaatgttccagtttttatgttactgatttttgctttttgccctaaatcttggtttcttatgtgaccacaattaaatcagaaaaagagggatttgcccacataggacagcctctatacttgggctcaggagtaccagtacaaggtgcagttagggcactggtgaggaagccaaggtccccagggccatcatggagcactactttcaagctatatattgcttagtgccccttggtgctcctcacccaaatcccagtttagaccagccttctgagattgtgaaaatatctgccatttccattagaaactcaactgtgtataatgctcaaagcatattctttactggtaacaaatcagcattatcttctttatgattttaccagattgttaccttttttttttgcctcgtatgcatgcctttaaaattaaatagccaagtcatgacttttttaagccttttaataaaataacttaatttcagatgctatgagttattatttttaaagcaattttaactgcatttcattatctgcagatattaccgcacagatcccaaattaaaatagaaccaaatttatagttagcacataagaaaatataatctttgtataaagctccagacattttgatagctgtagattctctttgaaatagaaatgttcaaatatttatgcttaatagaaagggtttattatgatggcacaaaaagtgtggtgagtagaaggacattcttttttagggaaacaagggacattttattgttgaagttcaccaagctgacaaatagagatgtcagttcaaagaaatcactttctctttgttaataggctttgcaaaaagaagtcataataataattctcaacttattttttatttaaacaagtgctccaaaaaatataatgaacaaaaaaatttaacatatttagagtttgagttccatatcatacgtgatattttggaagattacgtttttaaggtacatctgtgtgtatttttttctttttctaaatcatatgctataaattattttcatcctttgggttatataaaagcgtcattgtaaatgccattgatgaaagatacttgctcaatactccaattattgcactatttctttttaaatttgtttcaattctaagccccagcacaaatttgccaactctatttatagatgattcttttagctaaattacttgaaattgtaccgtctaccttcatttgaacaagttagttgataacacctctgacccagataatcatcaaacacatctcttcattgattcactcatttattcacttacgttttaaaaaatctatttatcatgattgtcacaaaaaaattgagatagttggatgtcgatattacacactttatgttctctttagatgaatgatacctttgagaggaaaagaatgagatatgtttatagaataaatttgtcagccccatgtctacaaagaaaacatttaaaaattagccaggtgtggtggcatgcacctgtggtcccagctacacagaaggctgcaaaggaaggatcgcttgagcccaggagatgaagcctgcagtgagctgagatctcaccactgcactgcaccctgggtgacagagtgagaccctgtctcaaaataaataaataaataaaataaatttctgctgaaatagtaatgttattaataatttttttcttcataaaacactaggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttggagagccctcagcttagacatttctggtcctaatcctcatttagtaatctttgccagttatacaatattatcttgcagcacatggggggcatgcagatcacctcaccccttctggtactatccaggcaactctttggcttaagagcataggctacagcaggttttgggtgtcttgggcaaatcacttcatgtcagtggacctcagttggctcatctctaaaagcatagttgactaaatgaatgatccccaagatcccacctagctctgaaagtctaatattccattcattcattttatatattcattcatttattcaccaaatatttttgaagtccctactaagtgcaaatcactcttattagatgccagtgatctattgtcagataagacactgccccttactagagctcacgttccacagggctggctacattaaacaagtaaatttgtagcttagcacggtttacttaacaagcccagttatgacagagctggagaggagagaaagctgtgttggagaggcaggaaggtgtgatgttcagccaggcaaagcaggcaagaaggtagaagggaccacaagaaggaggcctcagagtgtcttgggatcattaagttctcaagcagtccagtgacagctgcttgattgtttgtgtgaagactcactacatagaaacatagactgaattggcccggtgcagtggctcacacctgtaatcccagcactttgggaggacgaggcgggtggatcacgaggtcaggagttcgagaccagcgtggccaatatggtgaaaccccatctctactaaaaatacaaaaattagccaggtgtggtggtgggtgcctgtaatcctagctactcaggaggctgaggcagaagaatcgcttgaacccgggaggcggaggttgcagtgagccgagatcgcgccactgcactccagcctgggcagcagagtgagactccgtttcaaaaaaaaaagaaaagaaaagaaaagaaaaaagaaacatagactgaataaaagcataaaactacatccctgagttactttttcagaaagcgtaaaatggtcttgagtctcccctaaaagtctccttccaaaagcttttctgtcttcgatgatcctagtgaagatgtatatttcttctccttttgatgggtttccatgaaaacaggaattattttatgtgaaatataaaatatatattttcaataatagagtgtcaatctctaatgcatttaatacaactttatttgctttcttagttgtcttattcaaagcattatgttactgtgcaggatattcctatatgatctgttttgtttttcagaccctctgcaatgtgtccattcctcaagggtgacatactcctgttacacacctctgttttcccatttgtagcatcatactcataatttttttttttattgattggaattcccatagttgcaagtgacaaaaatcaagcttgaactagcttacaaaatagaggaaaggcttatataaacagggaaaggccaggagtataactttcctaatatctcccctcaagctggtaggttcaggagtaggcacctaacccaagctatgccaatgccttccctagaatttgtgaacttgggaacagagagaaagtgaatcagttcctctctacagagaaatgtttgggacctacagaataataaatgttaactacagttggtttgaggtgaacttctcctggccatgggagaccctttttgtctcatttgctactgtacctagcagagtgcctgcctcatagtaaattcacgttaatgttagttgaatgaatacatacatctattagtttcaagggtggaagctgtattgtactatcatttcccttatgaaattagatttgacttacacactaatttacagcatttttccaggaacacttttcttagtaaccatacaagctgattgaatgtacaagttggaaatgaaacttgaatattacaattgaatcttaggactggaaatattttgataaaccagtttttcacattgctcacctaccacttctgaaaactgcaaaataggaacaatgcaaagttatagtttgtggagtggtacaaattaagtttagagtataaagtctcagatatttttatcaagctttctgacagtgttattctctagtgaaaaataaaagacacagtccctacccttaactgtctcaaattcaaggccactttccagcaagggagcctgttaaaaagtacagatttccgggctccattcgaggcctcctgagcttaaatctaaagagtgggtttaagagtcagcattatttaaaatttccctgtgtgattcttaggattaaccagatctagtgcaaaaaatatgtttatgaatgcttgttttttttaatagtggataatcagaaaacaaaaagtaatccactctgtagaatagtattctggcattaaatgtgactatagaactttcatttctgtccaagatagagtaactgggaccagatttatcctctcatttgaaacaacccaacatataaaaaacaaaatatcatgaaagaacagttttcaagacattagacatcaggcaactaaggacagtgatctcttgtgagacaggaaacaaggtgacccatatgaatgccccaccatgctgccttgagagagtttccaggccacagcacagggaggggaactaaggcagagtaggcagactccctaaattgaggggacagagctgagagtctggggtgaccaaagcaactagagttcataggacagagtactgaagaggagagagctgcacacagacagaacctcagatctgcagaggatctccctcaagtattcagcagagtatcgatcagtgcatgtctaataggaaattccccaacactgagaaactccccaacactctccactttggatggaaaaaaaaaccatccaaaaggattggaaggaacagcgcctgcactacctgttcccaccagtcagactagaaaaatttctaattcatggctcattgtgtagagcgctcagggaagtcttatctctgtaatgagaagtaattagccccaaactgacaactgctccagacctgcctaatggatcatgaacgcaagacccaaaggatcaaactatgtccgagtaactgatctaagtctcagaacaaaacataagaatatttttaggaatacaaaaacatcaactatgcaacaaattcacaatgtctgacatctaatcaaagattactaggcatgtaaaaagaccagaaagtgtgacctataatatggagaataatcaatcaaaaatgacatagaactgacagataatagaattagcaggaaaatacactatgggattaatggcagattagacatttcagaagagattagtgaacttgaagacagagcaataaaaactatcaaaaatgaaacacagcaagaaaaagaatttttaaagatgaaaagagcatcactgagccgtgggacaacttcagtcagcctaatacatggttaattggagttcatgaagaagagaggaaaagaaagaagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaaaaaaagaaaaaagaaattttacacacagaggaacaaacataaggatgacatcaatgtcttatcggaagcagtacaaacaagaacagtgtcataaagtactaaaaacaaacatttctcaacttagaattctaaaccaagcagaagtatctttcaagaacaagaaggcaaaataaaaatgtcttcagacataccaaaactgaaagaattcagcagacccacactataagacccacagtatatttaggacattcttcaggcagaaggaaaacgataacagattgaaatctgaatctacaaaaagggaataaagagcactggaaatgatagctatatgggtaaatctataagttctttttcttattacttcaatctcttataattggcaatttaaacaaaaataacaatgtgttttagagtttatagtatatggaaaaataaaatgtatgacaacagtagcacaaaggtcaggaagaaagacatagaagtactatatactattgtaaggctcttatatgatgtaggggggataagggttatatgtgaagtggtataatatcacttgaaggtacactgacaagttaaagatagatgctataaaccctaatgcaaccactaaaacaacaaaatgaagagttgtgagagaaaacacaggagagaaaacagaataaaaaataatacaaagaaaggcagaaaaagataacagaacaggtggaacaaatagaagtcaaatagcaagaatatatatttataccagactgtatcaatcatcatgttctgcttgtaaaacatgcacttcatacacaaagaatagtttcaaagtaaaaaggtagaagccaggtttggtggtgcatgcctgtagttccagctacttgggaggctgaggcaggaggatcacttgagcccaggagttcgaggatgcagtgggctatgattgcaccactgtgctccgcctgggtgacagtgtgagacttcatctcttaaaaaaaaaaaaaaaagtaagaagatagaaaaagatatactgtgataacattaatcaaaaggtagctggagtagctttattgatatcaaaatatattctcagaccacactgggattaaattagacatgaataacagagagagataaatcgccaagtacttgaaaattaaataacacaattctaagtaacccatgaattaaagaggaaatcaaaagggaaattaagaagtattttgtaatgaattaaaatgaaccacagtatgtcagaatttgcaggatgccactaaagcagtacttagggagaaatatgtaccattaaacacctatattagaaaagaagaaacatctcaaatcaatgacttcagcttataccttaaaagtaactaggacaaaatggagtaaattaaacccaaaatgagtagaagagaagaaataataaagatcaaagtagaaattaatgaaatagaaagcagaaagcaatagagtatcaataaaacagaaaatactttttctttggaaagatcagactgatcaggaaaaatggctatacaatcacggggaaaaaaaacatgaattaccaacatcaggcatgagagaaggggcatcactacagagtctacagatataaaaaggatgataaagaaataaacagatttatgccaataaattcaacaacttagataaaatggaaaaattccctgggagacagaaactactaaagcttatttaagaaggaataaactgaattgccctatactatctgaaaattgaatttgtagttaaaaactattcctcaaagaaaactccaggtcaagatggcttcactggtaaattctgtcaaacatacaatggagaaataataccaattctatacaaactcttttcaaaacattgaaaaaaaaggaatttttcccagctcatcctagaaagccagcattgccctgataccaaaaccagttaagacattacaaagaaagaaaactatagactagtattcctcatgaatgtagatgtaaaaattctaaacaaagtcttagcaaagcaaatccaacaatatatgaaaaggttaatatgttctcacttcagcagcacatatactaaaatataaacagtacagaaaatattatcatggcctctgtataaggatgacatacaaatgcatgaagtgttccagatctttaaaatatatatatgttatgatcaaatggtgattaacccaggaatacagctttacttataatagcccaaaccaggaaacaattcagtgggtgagtggataaactgatatgtccatacaatggaataccactcagcaagaacaaagaacaaactactgatacatgcaacatcatggtggaatctcaaaataattatgctgagtgaaaaaaacaacaaaaaagagttcatactgtatgatttcatttatgtacagtgcaaacaaatctgtagtcagcaaaagttgactgtatcagcctttggtcgacaactatattatcagctttttgattgtcacattagtagttgcttagggatgtggtggggagggtatggagggatgggagaatattaccaacgagcatgaggaaacttttgggaatgatagatatatcactatcctgattgtggccatagtttcatacatatgtcaaacttatcaaattgtacactttaaatatgtgtatgtcaattatatatcaatgaaaactgtttttaaaaataataggcaacattaaaaatggagcaacagggaaaataatcataattagaagatttaaaagcactatcggccaggcatggtgactcacacctgtaatgccagcactttgggaggccaaagcaggtggatcacttgaggtcggcagtttgaaaacagcctggccaacatagtgaaccatctctttccttaccctcgtctctactaaaaatacaaaaattagcttggcatggtggcaggcacctttaatcccagctactcaggaggctgaagcaggagaatcacttgaaccctggaggtggaggtagcagtaagctgtgattgtgccactgcactccagcctgggtgacagagtctcaaaaaaaaaaaaaaaaaaaagaaaaaagaaaagaaaagaaaatagtgtgttaaaagcattatataaaatatatgtatatagcaatcaaaaaatcaaaaatagtatttttgtcatggagcaattttgtgtgcgtggcatactggatggtcttctccattttccatattttctttaattttttttaactggtaattaaaattatctaccgcaaaatcacaaatattaagagaagcactgtcatagtaattctacttttgctgaactttttattttttttttaacagggaatcactttaaaaatgaatgaactaaatcattgtattgttgcaagaattatgcatgggggcatgattcacaggcaaggtaagtttcatatatatttctttctttgccttccttaattttttttccctgtagcctagtgaagaaaatgtttttgtttgttttgtttttgagatggggtctctcactatgttgcccagactggtcttgagctcctaagtgcaagcaatcctcccgtctcagctttccacaggtgcatgccatcacacccagctaagaaagtataaaggatacatataaagaatcttttaaaatcatctttgattttaatcattattggcctccattgtttcttattcatctgcacaggctccagcatgtagataatgaagggagaatatattagagttctgttagccagagcatctctgtattagattactacttacggggaccacgggagataaagcaaataattacactgggcctcacgatgtaggagagacatctgttctagagtaaaagatatatgtaaataaataaccatttaagaagtgttctctcattcatttaggaattagatatgctatttataaattaggacatcatagagttaaataatacaaaaattaaatggtaagagatgtcaaatcgatgattaaattattaatacctgccatggtgagtgcagtcattctgtggagagaattcactaagaactggaatagacaaagaatgatgtgggggttttttttgagacaaggtctggctcagtcacccaggctgtgcaatggcacaatcttggctcactgcaacctctcctcccgggctcaagcaatcctcccacctcagcctcctgagtagctgggaccacaggtgcacaccaccatgcctggctaacttttgatatttttgtagagatgggcttttaccatgttgcccaggctggtctccaattcttgaacccaagcaatctgcctgcctcctcccaaagtgctgggattataggcatgagctaccttgcccagctcgaagaatgattttttaagaaggtgcatcttcagttaactctcaaggatgggcagggtttggatatgtggatttaggctttttctttgaaaggattgagttatatgcactagtatttagaggatgttccaaaaatgattcttctggcagactctctgtctttgagatagggttatttttgtacttaacacctctttccttacccccagagagcgagaagtaacactctaagcattttagtgccttattctcctcttgagaataagaggagatcactgtgtacacaacatgatgtctggcatcattgctgctttcagaggaatccttgtaggcgtagagggtgtacagcactcccacaggaggatatttggttttagattccagtatgtgttttttgtttgctatttttaataatttttatatgttcagtaaagccacaacatcattctttcttttttttttcttttcttttttgttttttattatactttaacttctagggtacatgtgcacaatgtgcaggtttgatacataggtatacatgtgccatgttggtttgctgcacccatcaactcatcatttacattaggtatttctcctaatgctatccctcccccagccccccaccccctgacaggccccagtgtgtgatgttccccgccctgtgtccaagtgatctcattgttcagttcccacctatgagtgagaacatacggtgtttggttttctgtccttgtgatagtttgctgagaatgatggtttccagcttcatccatgtccctgcaaaggacatgaactcatccttttttatggctgcatagtattccctggtgtatatgtgccacattttcttaatccagtctatcaatgatggacatttgggttggtcccaagtctttgctattgtaaatagtgctgcaataaacatacgtgtgcatgtgtctttatagtagcatgatttataatcctttaggtatatactcagtaatgacatggctgggtcaaatggtaattctagttctagatccttgaggaatcgccacactgtcttccacagtggttgaactagtttacagtcccaccaacagtgtaaaagtgttcctatttctccacatcctctccagcacctgttgtttcctgacattttaatgattgccattctaactggtgtgagatggtatctcattgtggttttgatttgcatttctctgatgaccagtgatgatgagcattttttcaggtgtctgttggctgcatggatatcttcttttgagaaatatctgttcaaatcctttgctcactttttgatggggttctttgtttttttcttgtaaatttgtttgagttctttgtagattctggatattagccctttgtcagatgggtagattgcaaaaattctctcccattctgtaggttgcctgttcactctgatggtagtttcttttgccatgcagaagctctttagtttaattagatcccattagtctattttggcttttgttgccattgcttttggtgttttagtcatgaagtccttgcccatgcctatgtcctgaatggtattgcctaggttttcttccagggtttttatggttttaggtctaacatttaagtctttaatccatcttgaattagtttttgtataaggtgtaaggaagggatccagtttcagctttctacatatggctacccagttttcccagcaccatttattaaatagagaatcctttccccatttcatgtttttgtcaggtttgtcaaagatcagatggttgtagatgtgtggcattatttctgaggcctctgttctgttccatttgtctatatctctgttttggtacgagtaccatgctgttttggttactgtagcctcatagtatagtttgaagtcaggtagtgtgatgcctccagctttgttctttttgcttaggattgtcttggcaatgcgggctcttttttgggtccatgtgaactttaaagtagttttttttccaattctgtgaagaaagtcattggtagttttatggggatggcattgaatctataaattactttgggcagtatagccattttcatgatattgattcttcctatccatgagcatggaatattcttccatttgtttgtgtcctcatttatttcgttgagcaatggtttgtagttctccttgaagaggtccttcacatcccttgtaagttggattcttaggtattttattctctttgtagcaattgtgaatgggagttcactcatgatttggctctctatttgtctgttattggtgtataggaatgcttgtgatttttgcacattgattttgtatcctgagactttgctgaagttgcttatcagcttaaggagattttgggctgagacaatggggttttctaaatatatagtcatgtcatctgcaaacagggacagtttgacttcctcatttcctaatcaaataccttttatttctttctcttgcctgattgccctggccagaacttccaacactatgttgaataggagtggtgagagacggcatccttgtcttgtgccagttttcaaagggaatgcttccagtttttgcccattcagtatgatattggctgtgggtttgtcataaatagctcttattattttgagatacgttccatcaatacctagcttattctgagtttttagcatgaagggccattgaattttgttgaaggccttttctgcatctgttgagataatcatgtggtttttgtcgttggttctgtttatatgatggattacgtttattgatttgcgtatgttaaccagccttgcatcccagggatgaagctgacttgatcgtgttggataagttttttgatgagctgctggattcgacgttccagtattttatggaggattttcgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaagaatatatattctgttgattttgggtggagggttctgtagatgtctattaggtccacttgttgcagagctgagttcaggtcctggatgtccttgttaaccttctgtctcattgatctgtctaatattgacagcaggaaacatcattatttctttaacttctctttgttatattactgcactggctaggaccggcagtctttcaaggagtggtatagtagacatcccgtcctattcttgtttttaaacggaatctaaagttagccgggcatggtggcgctcacctatagtcccagctactcaggaagctgaggtgggaggattgcttgagcccaggagttcgaggctgtagtgagctatgatcacgccactgtactcacctgggtgtcggagagagaccttgtctctagaaaaaaatgtttttttaaaaaggaacctttccaatatttcttcattaagaataatgtagatttttagtacatgccttttattagggctaaagaagttcctttatattcttagttgctgagcattttaattgtgaatgggttttgaatttaatcaaatgctctttcagaatctgctgagatgatcatttgtttttttccttttatctgttaatgtggtgaatgtcttttaaagatttcctaatgataaactacccttgcatttctcagataaactcagcttagtcattacatattatcttttttatgtactgcccgactgtctgctaatgttttgtttataagatctcagtatgtgcatttatgagtgagactggcccgtagttaattttcctctcttgtatttctctgattttagtttcaaagttatatctacttcacacaatgacttggagagtattccctcttcagttctccgagagattttatataatattggaatgatttgtgtcttgaaagtttggcaggacttgcctgtaaagtatcacagcctagtgttttggtttttagttttaagaaagttttgtttttgttttttaacaactgcttcaatttctttaacattaaaaggccatccaggctttctatttcttgagtgagttttggtaaattacattttcctaaaaaaaaataagttttaaaatattgcagagagcttcttcatagtattctctcatctttttattctctgccatctttgtcattatgcccctgttcatttctaatattgtttatttgtgcctactctttttttcttgatcaaccttgccagaggtttgttcagaaacccactctgggtttggttcattctcttcattatatgtttattttctgtttcattgttttatgacctaatttttattatctcctttttttttaactttctattggttttggctaactttacaaatttgacacatagttcatttatttccagtcttttttttttttttttttttttttgagacagggtcttgctccatcggccaggctggaatgcagtagcataatcatagctcactgcaacctcgaactcctgggctcaagtaatcctcctgtctcagactcctgagttaggactacaggcaaccacactcagctaatttttttaatactttgtagagatagagtcttgctttattgcccaggttggtctcaaactcctggcctctagtgatcttctcgcctcactcagcctccgaaaacactgaggttatagacatgagccaccatgcccagccttcttttcttttctttttttttttttttttttttttttgagatggagtctcgctctgtcgcccaggctggagtgcaatggtgcaacctctgcttccgggttcaagcgattctcctgcctcagcctcccaagtagcggggattacaggtgcccaccaccacgcacagctaatttttatattttagtagagacggggtttcaccatattggccaggctggtctcaaactcctgacctcatgagctgcccacctcagcctcccaaagtgctgggattacaagtggaagccaccatgcctggcccagccttcttttctaatatgtgcctttaagactaaactctccctctaagtactgtcttaatgtatcccaccagttttgacatgacgcatttttataactcagttctaagtatttttatatttctattatgatatttttcattgacctatattatttataattgtctgttacttttcacacttaacaggattttctgtatatctttttgtaatttacttctaacttaattacattgtggtcagagaatgtagtctgtatgacaccatttctttgaggtttgttgagacttgctttatggcatagcactttaatcgtttttataaatggcccacgtgtacttaagatgaatgtttattctttaattgttgcatgcagaggtatctttttgtaatgaagccaggtcagtgtgtacatttctgcacaatttataaataaggaagcaacattgtaaataacactctaagcattggttcttggtcatttctttctagctgaagtattacaagatgctgaaatgccaaccaaaagattaaattatctttaacagaatttgctgttgtgtagatattatcatgtcacaactcttggaaaattgacaaccttcgtatcatatctggtagataacgatagcagccaacactgtcatggtgcttggtatgtgccaagaacagttctaagccttctgcatttattaaatttgtttagttcttaaaacaatcctatgagatgggtactattttcatctccattttacaaatgtgaaaactgaggtatggagagtttcagtaatttacccaagatcttaaagctagtaagcaaggaagctggaatttgaacccaggcagtctggatccagaagccatacttttaaaccactatacataccacctctctcagaaaaatagatttctgcagccatccatcaaaactgtgccttccacaagtagatatatctgttttgatgaggttactacatgagttaaataattctgctgcaaccaaacttgtacctgcctctgaaatattggccctcaatattcaacttagtttttaaaaattacattgatgcctctggattttgttactatgaaagcatatatcatttcatgtttataatgttatataatttcttaggtacacttcatgttggtgatgaaattcgagaaatcaatggcatcagtgtggctaaccaaacagtggaacaactgcaaaaaatgcttgtaagtaaatgaaagtttttcctttcctaaaattgacttttactttgttagcttgtttttaaatatacaaataaggagtattcttctgtaatcagagaatttctggtaccatatttatgtggacttgaacttatataacattcataaaactgacaactagaaaaatgttgaaatacaatagagtttacaaacattttgcctgtctttagcagtgtgggctttaacactctccttttatcctttatctcctgtttcttaccaagcagatgattaaagaaaaccttttcagtgtttgtacatgtgaactagtttctcactgacctcaactctcctgacatcagcagtgtcagaaacctctttcctgttgagctgagtcatagccagctgtcgtggatttctctacagcatagaagggaggaaagccacggtagaccaggccatttttgaccatacatatccaaaatctgtattcaaattaggctttggattttttaaaaaggcaaaatgacagcctttgcctatgttcattgtcatagcaagcagacagaggtgtttggggcctctgatcccttttcccactgcagtgtagtagcacccaggttatgaatacctattaagtatgaaataagcttcacagactcaccaaacatttttttttcttttttttgagacggagttttgctcttgttgcccaggctggagtgcaatggcgtgatctcagctcactgcaacctctgccccccgagttcaagggattctcctgcctcagcctcccaagtagctgggattacaggcatgcgctaccacaccctgctaatgtttgcatttttagtagagacggggtttctccatgttggccaggctggtctcgaactcccgacctcaggtgatccaccagccttggcctcccaaagtaccgggatgacaggtgtgagccaccactcccagcccaaaatttttttttaaaaaaaagccaaaattaataagcaaaaagtggctgggtgcggtggctcatgcctgtaatcccagcactttgggaggccaaggtgggtgaatcacctgaagtcgggagtttgagaccagcctggccaacatggtgaaaccccgtctctactaaaaatacaaacattagcaaggcatggtggcgcgtgcctataatcccagctacccgggaggctgaggcaggagaatcactggaacctggaaggcagagtttgcagtgagccgagatggtgccactgcactgcagcctggatgacagagcgagactctgtctcaaaaaaataaataaataaaaaatttttaaaagtaaaaagcatattctatggggtacaccattataatgtggcatactcaatgtaatttttatgtaattacctagtctattgtctaattcaatgtatattcacttttgaaaggcatgtcacttagaaagttttgtattcacatctataaaaaggtgaccattgaagatctgtgagaccattgctgtatgagcaaaaggcaattggctgctgggcttttcccaggaacttactctactgttaactcgagcagtccctgcttcatgactacatttcattttccggctatgtgctctcagatggcttgtgctaattgcccccatgtgttttgagtggcttcttacatggttttgtgaacaattgtttgtaagaaaacttttctttctttcccaccaccccccctccagagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaaacggagtgtctgagggaaaaaaactaaaggccataattgcagtaatatttccaggaagttcattcacttcccttgttaagaaatcacatagatagttcttctttctaaggatctgagaagtgatctatttctgttgagatacagttgttcatacaattgtgacaggtctctagatggaagttaagtctgcaatgaattgataattgacttcactagagggaaataggcttttgcaaccttttgtaaaactgtttaaatttagaatggtatgtgatctgtaaacaagtaagttttctagagtaatacagccccaaagtttctttcttaaaataggcttatcctgtagaaattatagttcttccaacctatattattcagttttgtgttggttgttaaatgagattcaaaaatctattctttttgtattggaaatataaatgggcataaatgatatcatcctttggtcattgcacgttcagctcgagtgttatttattgaagcttgttctttcatgtgcatcttccgagagtatgtgcatcaatatgaagtacacacttcctaaagtttatttttaagactgacaggtaacttattggatttgtacttaggagaacctgagagagaattgtaatacttctagtctctagtgatggtgtaaatttcataagaaaaatcagaggcttcatattttttaaaagcctattgaagatacatattaaaatgtatagttttgtcaagtatatttttggtgagccatggcaattgaggtgtccgttgtaacgggtcttgagctcctcttggtggctttttatggaacttcaattaatagtatatttcaaaagaaaatgcagaattgcttctgttccaggattcagagtattgaaatttgttacctagaacacaaactttgctgggaaacaaagaatgtcacacttaacattctatgtaaataattttaatattccagagttacagatgtccttatatcatttctcatctgttgaagaaatttagtaaatacaattgacttttgtctttttggctaactaaccagaaggtactgttagttattaatacaacataagtttctctttttttttttaaatggtcgaactagtttggggtggaaccagtatcatagatgtaaattctatgttcttgagtaagaagaacccctcttaccttctttgcctttgaatagtagaaaaaataatgatacttctctcctagctccacctccagcctttttggccctcctgttccctggcagaattcaagcttgtggttggactcttcccagctagggcaatacttcaaaaaaaaaaaaagaaggctctctggccacctgcatctgcatcccccaggtccttggttaaagagtagacccctgcccctcaccctggctctactgacttgagtctctgcgggtggcacctggagatcagtcttgctcactaacatatgagaatgctcttctaagggatctcattacctttaaggctgacaggttctagaaatgctcttaagtcatctggggaaaaaaaatgtcttttaaaaagacatgcacatttctaaggcttaaaagaactctacagaagcaaaaattaaaaagtacttatttccttcctctccttgttcttatcgttaaagttgatttggacactaagggaatggagcctggaaaatattttgagtgtatagaatagtagagagaaagcaagcgatagaggagcctggatataggaagagtggctgtggctcctaggatctttgctggaagtgtaatattgttataggcttgagattattgttttaatcaatctgctaaaatagtcttaaaaaaagagttcttctctgatgtatatctcttttacccttactagtaataatatttattctataatagaaagattctgaggtgattgtaacatgtgaaatcttaggtttgtttctcttcagattgggtcagttagtaactcttgacacaggtactaaaaattattaaatacttttcaaacctaatctttaataaaaattaggcagttgggatcttcagcacgataatttatggtaatgtttgtcatcttatacttgatagggttttaatatcaagtcactcttctgggtctcattaaaagaaagaaaaggtatagaatgttagagataggaaagaattgattaatgaatgacacagtcatcacttaaaatatgtgagccttcgaactgcaaaatttttttcatacttctgtgaaatcatgcaagcaagtcagtatggcacctatacagctcaaacctcaaaggaaatggttgtcagactgtggttgttactgttgatgtaaatatctctgtgtttctgtgctggtgttctgtgttaatgaaccttgtgtcttatttcagagagattccccttccacttccagacagtccccagctaatggtcatagcagcactaacaattctgtttcggtaagaactttagctccacacagcaaagtgtgacaattttgttggtgctcacctgccatgagtgttctagttacatgtgttcagtggaaatagtgtcttctgctgatatacaaggctactacagctacaatgcactttactcctggaaaatctttttcaacatttccttctcattaaaaatccccttcaatagttaaatttgaagaaatatagttcaagactgctttggtcattctaaaaatatttctatgccaccccatttgtatgtatgactttgctcaaacctatgcaaaggatgtaaacggaaatttgtttaaacttctaaatattttttaatttgaaaaagataaatgtaagaattttgcagagtaggcatttgggtattcttgggctttgtagttttctattctgagtgatatcagcaacatgttttagtttccgctatctaagtttacgaattggtgtgccctctgttattgtggtacgtgcacatatttttgtgaattataagccttgcctggatatgaaaagcaaaaagaactggcttcaaactgcacttaagccacgctgttatcacatctttaacacaaagtactttatatttgacttgaacttggagttttaaattttttcagaactatccattttggaatatagaaagaattgtttttaacttatttaaacaaatggaagcacttaacaggtgcagactggcaatattttggttgctaatactgctgtttatgacccagttaaaattattgagagttctaataatgcagcagtattcttctttcctgacttttaatttgccctttgagaatatatcaacttttttatcaggtaaaattgtaaataatttagaaattatctcaaatggaatgatattctaagtatatcgtaagagaaattatgaaagaaaattgtctatgactttattttcaactttaaaataggctaccaaaggaattcattcataacagttaacatttaatacttttaagatgatgaaaagccatatagccattgaatttttcaaaatctaaatggttgcagtgactaagttgaaaagggcaacagctccttttatttattttttttttttaataggctgtttcacttgcagtggcttttgtgttgaagatgctgagttgtttcttaagaacacattttctctctgcttaaacttacctgctttcttcagcttgctgctaaatggcctgggtttgactttttgataactcaacatttctgataaatggaataatgtatattatctctttacaacttaaatctagctcatttttttaaccatattgtaacagaacacacaaattactttgtactcttgaaaaataaatgaaaatttttctcctgggttggctttattctacaggacttgccatcaactacccaaccaaaaggacgacaggtgaatagatatcctctatagaaacttctctaaactgagcagctaatagccaatcctttattaaccctttccatcccataatgtttgcattttggaccataacatttgagcattgagagcttgtaccatttcattttaacacattacacatgactaattctctataaagaatttttcctcacatctttgtagctgtaatggttattgtaatttcaacctgataattttatattaatggttaagaattcagcctttgggggtggctgtgggcctgcctctggcatgcaaaagaattttaaaggttataaaattcttagaattctaagactaactaaaaagttattcttaaaatgctgatgaacatttttaagcaaaaattttctgaagttgaaagctttttcttaaatttgtatttgcatgtgtatttctaaaagccatttgcaatgaaaaataagaaaagaatataaattatcttagcttcacatcctgatatacctgtgttagttcaaacatgaaaagttaagtgctgcctaacactggcaagtaactttcaaattgccagcactttagaggtatagattttaaatgcaaatgcagagacttgtaattttataggctggattgctgaaaataaacagaaaaatcacacagtggttccaaagtcttcaggttggttttacagtgacttaaacattaatattcaattttaatttcaagagatagaatttttatgggatttttatcttgaaatatggtattaaaaataatcagatttagtgttaagatatgtataaattagtacctgatagaattcacccataattttgtcttaagactgtataattgatggaacattgggtatgaattaccttatcttaaagcatttaaaaaataaaataattcataaaatgctgccatataataaacccttgaatgctaatctatttcctaagtaaactcacatatcataaaactcagagccttgaactatgcatgtcttgaagctctgtgctgatttcaagtgttacattgggggaagctagggttcaaattcatttttattctctcagaagagtaaaatacaaacctaaaacctaaattagaaaaaaatgaagctttttttaacttttaaaaaattgtttgagttacacttaactttatcagcaatgtgtagacacactgccagttgtcatataagcattctacagcaagataccaacccagagttcttgctaattttatatcgtgtgctgctttagggttaaaacctatcctgactgctagtatttatggcttaaaggctgccacgcagtcatgacaacgtatccataatgccagcatcaccaatgcaggtttaaaaaagagcgagcatacttttctataattagaggcctattctgttacagtaaaagcataaattaagtctttatttttattaaacaagtatttcaagtgttccttccaaataaaaacagcaaagttttgaagctatactcatcaaagattactagtacattgtttctagcggtagaagttttttgtgtcgtatttccatgcatcgtttttgctttcaccatctgatgtcctgtttgtattgtaactgttggtgtgtggttatgacattagagctaacttctctttcacatcactatggcatcctttcttacgaactcctgttttatagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggtatgtttttatgcgtgttttgctttgcttggttataaaaacaaagccctgaccatccattttccaattttatattattttagagtgtaaaacctgtttgatatattccttcctttacgagccaaacaaaatttaaattagtcatccaagaattctatatcttcagtatctagtgagatcctagttgcagagtcagggcttcattttacacaaaaagaaaggaaggtctggaaagagattggatgagcagccctgagccaagtcatggtctcacagcagagccctccactcctatatgctgttataattgttttagaatggcattaaaaaaatgtacgttctccttgcccttctacatgctttcatgcccatcccattcccaccaccagcaaaaaatgtaggtgcagtgcttcagtgtcactcagagtatttgaagataaaatgtatttcactgttagaaggaggtagtcagaagctttgttctttaccttgccagtcctttaaaaataccttttctgctagaaagtttaagccctaaaagcaggctaaagttaggggttttaggcactgtttttaactgagagaaaaggagtcacagatcactgtatattttgataaaatctatttctgctattattgttaccgtttccttagttgaactgtcttttggaaaatattgatggttttacctttgttggtacttgggcaatataccagattatttctagcacaaaagagataatgtctgagttttgtttcatgtggcaaaaaataacagccattaagcatcctgccagttcctcctaaaatacttgaacccagctaaaagagaccaaagacattgagtccatagaaatttctacctgcttttatctatttttctcactagttaagagatttctcagttaatctcttttgcttgatcgcctctttcagctatcccatgtttccccaaaaaatagtattaaatttagaatgttggagctgatgaggacttcagatgccatcattttatacataaggaaacgtgggcccaaatggagaagcagcagccttccatctggcattgtctttcagtctgatcttcgagaaacagttcaagcataagcaggaggaaagcaatctttaagtcgttgccgtgatgatgccattatattcttactgatatttacattttacagaatgtcttctttaatgttaccatatattatgggcatttattgaaaataattgtgtagattccagacctcttctgcctagtcagatcatctatataaatgtttcaccaatttctagaactctgagtcctctggaggaatcctgagtgatggcagtgcaaaaagcagatttgcttcctatttcctgtaatggtggatgagattatttggataaatcctcctgatgaaaaaaaatgaaaagtgccgcagaaaatatgtttttcaaatgaccttgaaagcactgaatagctgaaaaggtatcaggggccaggcatggtggctcacacctgtaatcctagcactctgggacgccgaggtgggcagatcacttgaggtcaggagttcgaagctagcctgaccaacatggtaaaaccctgtctctacttgaaataaaaaaaaaaaaaaaaattagccaggtgtgatggcaggcacctataatcccagctacttgggaggctgaggcaggagaattgcttgagcccgagaagtggaagttgcagtgagccgtgatcgcgccactgcactctagcctggacgacagagtgagactctgtgtccgggaaataaaaaaaggtactggggagctcagtgaccaattttttttttttttttttttttttttgagacggagtctcgccctgtggcccaggctgcagtgcaatggcatgatctcaggtcactgcaacctctacctcctgggttcaaacaattctcctgcctcagcctcctgagtagctgggattacaggcacccgccaccacatatttttagtagagacagggtttcaccatgttggccaggctggtcgtgaactcctgacctcgtgatccacccactttggcctcccaaagtgctgggattacaggtgtgagccaccacaccaggcctcagtgaccaatttttatgtgaaagcctttaataagaatgataagtggaatatcagagttaccaagtggcccattttgcaaacagggcatttgtcattactgaacacttctgtgccagagaaccaaggttaagatctaaggccagtacaagttggggaatctgttagaagaccctcctcattgttaggagtgcaagaggcagtccccccaggctaaaaggaaacagataagcatacccttatttcccttcaacaccggaggactatagagaaagctgccttgtcactgagcaaagcaaaagatgaggaaattgggaacaaacttccaaattgtggccaccagtccaccttgaatggatttgcacccaggtacacacagcctggggcagccaggggagctgaagccatgtacttgatttgaagtttcccctttctttactaatagtttcagatgtatggtataaacagaaagtctctgaaggcaaacacttttatcctaacccccactaacttcatcctatccgcccgacataaactttttccagggcagtagccagcaagtcaaaattatcaggcacacaaggaaacaagtaagacccaacagaaatgacagatagtagaaacaaacccaaacctactgcatatattggaattaagagacaaagattttaaaaataagcttacgaagttggttcgtttgtttttgagacaaggtattgtgctctcgcccaggctggagtgcaatggcatgatcatggctcactgcagcctcgacctcctggacccaagcaatccacccacctcagccttcccagtagctgggacaacaggcgtgcaccaccacacccagctaatttttttctttttcttttttttttttttgtagagatgaggtctcactatgttgcccaggctgatctccaactcctaggctcaagtgatccttccaccttagcctcccaaagtgctgggattacaagtgtgagctaccacgcctagcccaggtttttaaaaatcaataataagcttgtaaaatatcttcagagagcagaaaaaaaatgttaatgacatagcagattttaaaaagaaccagaggaacatccagggggaaacatgcagtaacaaaattagaatctcagtggtcacacctattagaatggctaacatttttttgaagtttcatcagtgggtaaatagatcaataaattgtgatatagccatacaatggaatgccactcagcaataaaaaggatcaaactattgatatatgcagcagtatggatgaaacacaagatcattatgctgagtgaaagaagccaggcaaaaaagagaacacgctatatgattccatttacataaacttctggaaaatgcaagatgggggtggagggagggaggaattacagaggggcatgaggaaattctggaggtaatgaatatgtttttctttttttggagacggagtctcgccctgtcacccaggctggagtgcagtggcgcaatctcagctcactgcaacctctgcctccccggttcaagtgatcctcctgcctcagcctcccgagtagctgggattacaggcgcctgccaccacgcctggctaattttttgtgtttttagtagagacagggtttcaccaggttggccaggctggtctcaagctcctgacctcaagtgatctgcctgcctcagcctcccaaagtgctaggattacaggtgtgagccaccgcagcacccagccatttttattttttattttttatttttattcttctaaagtcaaggtccctctctgtctcccaggctggagtgccgtggtgcaatcttggctccttgcagcctggaactcctggattcaagcaatccccctatctcagcctcccaagtagctgggattacaggcgcccgccaccacgcccaactaatttttaaattttcgatagagatgagatctcactatgttggccaggctggtctcgaactcctgacctcaggtgatctgcccgcctcaacctcctaaagtgttgggattacctgtgtgagctaccacacctggctaagaatatgtttttcttgattgtagtgatagtttcatgggatgtttacagatatcaaaactgataaatttgtatactttaaatatgttcaatatattgccaaaaaactgaactgttaaagttgcaaaatatatagagggagaaaaggattctaactgagatgataagaaagaggcccactgggcagtgtgtaccccaagacctgaataggactttgggggtataggaagctattcctggcagaagagaaagatcaattttcctttgcttggaaactgaattggcctctgggatgtcagtgggcatccaatactaacaagaaagatttgaaacaattgtatcagccagacccccaaaactttgatcaaatatattgctaccaagtcacattcttcacattttctagatgagaaatcagttttttcggacccaaatgccttactctaggcacatcaatttagcccttcaatatattttagctcccggactctgtcatccctccccttgccttgcctacaagatcctgatctaagccatcaataaattggtaggcatgtgtttgaaatttccttccaggttgaccttaaccctaacacggtttctgtgcacttactgagctaaaagagctaatgtttatttctgcagtgtctggtaaaaatcaatttcattcctctgtcatcacaccacatgagactatgccacaattttttcctgggaacctgtatttttgttttaagcttaagaacatttattataagatactctctacattgtaacataagcttcacaaggtcacacgattttgtctcttaacctgtcaaaaaattcctcaattctgtttgtttccaaagattctatgccttttagttctgactaatagcacatattgacttgcaccaaaagaatccccaaagcaagcctttatcagcctcctctgtatgccacgtgggtaatatatggagatggactttgatactattactgagagttcgcagtattttccaataaatgtctttcccccaaccaaaaataaatacataaaaacttcagtgaacaagagcgagtaagagatatggaagacagcctctttaagaaaatagaaaataatacttcccaaatcattttatgatgtcaacattaccctgataccaaaattcagtaaaggcagttcaagaaaagaaaactacataccagtatctgtcatgaacacagaagtaaaaatcctcagcaaaatattagcaaattgaatccagtaatatattaaaaagataatatattatgagccagtggaatttgtactgggaatgcatagctggttcagcatttgaaaaccaatcagccgatccactagattaacagactgaagaagaaaatccacatagtcatatcaatagatgcagaaaaagcatttggtaaaattcaaaacccaatcagattaaaagtctcataaactatgaattgaggggaacttaacctgataaaggacatgtatagtaaacctacaactaacattactagaaagggaaaaaatttgcagatgatatgattctgtgtgtagaattcaaaggaatctgtagacaattagaattagtagcaaggtttagaaaggttgctgatataaaatcaatatacaagggactgggcgtggtggctcacgcctgtaatcccagcactttgggaggccgaggcaggcggatcatgaggtcaggagatcgagaccatcctgactaacacggtgaaaccccgtctctactaaaaatacaaaaaaattagccgggcctggtggtgggcgcctgtagtcccagctacttgggaggctgaggcaggagaatggcttggacccgggaggtggagcttgcagtgagccaagatcgcgccactgccctccagcctgggcgacagagcaagactccatctcaaaaaaaaaaaaaatcaatatacgaaaatcaattctatttacaagccacaagcagaaaataaaacttttaaagggtaccatacataacaccacttgcaacaccataatattataaagtgttcttgcacacacacaaaacaaaactggatctgattaggcctctaggttttattacctatttgcaggaaatacaaaggacagagagacatactaaagataccacagggacacagtcagaaaaatccagactctacagaaactaaaggacaaactagtttctacaacaaacaaattgtaagaaaagaaaaaggagggagagggaacctatagattttaaagggatttcagaagaaaactgtactcttggatttgttccaaaataatctatgataaggtggtataaataaagccaggcgcagtggctcacacttgtaatcccagcactttgggaggacgagacgggcggatcacctgaggtcaggagttcgagaccagcctggccaacgtggcaaaaccccatctctactaaaaatacaaaaaaaattagctgagcgtggtggcgggtgcctgtaatcacagctacttggaaggccaagacaggagaatcgctggaacccgggaggcggaggttgcagtgagccgagatcgtgccactgcactccagcctgggcaacagagtgagactctgtctcaaaaataaataaataaataataaaaaaataaaataagctatgactaataattgtcaaagcagggttgtagatagctgggtttcattacactatatccttgtatgtgtttgaaagttttagtgttacaaagtgtttcttaaaataccatttacaaagcctttattaaaaaatgaccaggcgtggtgactcatgcctgtaatccctgcactttgggaggccgaggtgggcggatcacttgaggccaggagttcaagaccagcctggccaacatggcaaaaccccgtctctactaaaaggaaaaaaaaatacaaaaattagctgggtgtagtggcgcacacctgtagtcccagctactcaagaggctgaggcatgagaatatgtcaatcctgaaaggtggaggttgcagtgagccaagattgtgccactgcactacagcctgggcaacagagagagactctgtcttaaaaaataaaataacctaggaataaatctaacaaagatgtcaagacatttacagaataaattataaaatttattgagaccgggtacagtggctcatgcctgtaatcccagtacttttggaggccaaggcaggcggatcacttgagcccagaagtttgagactgtcctgggtaacatagcaaggtccagtctctacaaaaatacaaaaattaggccaggctccgtggctcacacctgtaatctcagcactttgggaggctaaggcaggcggatcacctgaggtcaggagtttgagaccagcctggccaacatggcaaatccccatctctactaaaaatataaaaaattagctgggcgtggtggcaggcacccgtaatcccagctacttgggaggctgaggcagggagaatcacttgaacctgggaggacggaggtttcagtgagctgagatcgcaccattacactccagcctgggcaacagagcgacactctgtctcaagaaaaaaaaaatgggtgacatgcacctgtagtccgctacttaggaagctgaggcggaaggatcacttgcacccaggaggtcaagatgacagtgagccaagattgcaccaccgcattccagcctgggtgacagagtaagacttcgtctcggcgggggtggggggggaattatatctcgagacatttaaaaagatataagtaaatggagagacatactgtgtttaaggactggaagactcaatattgcagggatgtctattcttcctagatagatttcatagataagatgcaatcccaacagttttgaaattgacaagctaagtttaaagtctacatggaaatgcacaaggtcgggaatagccaaaatgctcttgaagaacaaggaaggaggtcttgctctaccagataccaagacttattataaagctatagtaaacaagataataaggtatgggtttagagatgctcaaatagaccagaaaggaatagagaacctgaaaacactctcatacgtaaatggacacttgatgtgtgacagaaatagcactgcacagcaatgaggaatggacaggcttttaaataatgtaggacaattgggtatccattaggaagaaaaaaggaattggacccctcctttacaccataagcaaaaatcagttctaggccgggcgcagtggctcacgcctgtaatcccagcattttgggagaccaaggcaggtggatcacacgaagcaggagttcaagaccagcctggccgacatggtgaaaccccatttctactaaaaaaatacaaaaattagccaggcatggtggcacacacctgtaatcccagctactcaggaggctgaggcatgagaattgcttgaacctgggaagcagaggttacagtgagccgagattgcaccactgcactccagcctgggcatcacaaggagaatctgtctcaaaaacaaaaaaaaaacagcagtactagtacattaatacccaaaatgtaaaagacaaaactataaactttgagaaggtaatattggagaatatcttctgggacaaggaaggatttctttttatttttatttattttttatttctctaaagtcagggtctctgtctcccaggctggagtgcagtggtgtagtcttggctcactgcagcctggaactgctggactcaagtcatcctcctgcttcagccttcctagtagctgggactacaggcacgtaacatcacacccaatcacacccagctaatttttttttgtttgttttttgttttttgtttttttttgtagagatagggtcttgttatgttgctcaggctggtctcaaactcctggcctcaagtgagcctccctccttggcctcccaaagtgttgggaaatcccctgctaaggatttcatttttgttttttttttttttttttttttagacaaggtctcgctcggttgcccaggctagagtgcactggcataatctcaaatcactgcaacctccacctctcaggctcaagtaattatcctgtctcagcatccggagtagctgggactacaggcacatgccaccacacccagctactttttgtattttcagtagagatgggatttcgccctgttgcccaggctcgtgtgaactcctgagctcaagtcatccacccgcctcagcctcccagagtgctgggattacaggcgtgagccatcgcacctggctgaggatttcttaagatatcaaaaatacttcccattaaagaaaagactgataaatttgactaaattaaaactaataagttgtgttcatcaattgataccataaagagagcaaaaaggcaaaccacagagtagaagaagatatctgcaacacgtatattaataactaacaaaagcataatatctagactatataaagaatttctacaaatctatgagaaaaagacaactgaacagaggaacggtcaaaagacttgaacagacacttaacgaaagaggaaattcagtagccattaaacatatgaaaaaatgatcagtcttactaatgagtgaaacgtaaactaaaatgtaaattaaaaacacagtggtattccattattcatccaccatgatggctaaagttaaagacagataataccaagtgttgccaaggaaatggaacaataggaatgttcatacactgctggtaggagtgtaaatcagtacaatgtcattgtaaagcaacctgccatttacaatagcaccatatggcattctgatcgtgattttggactcttatatgtgactcacttggggacccttggttggcccccatgagcaaaatcattaggagagcaaagtcttctgtggcaatattctgaaaggcaagtatttgtttagactgaacctgaaagagcaactttttaatatcatctttatgttaccaatgctggatattatagatcaaaattataatttcctgattgtggttataactgtgaatttaatcagagcacactttttatatcttatcttagaatctccatgtagcagtagtgccatttgttaagcatatactgtgtgcctggtactgtactagggacattatttacattttttgttctaaacctttacaatagccatccaaaaggctccaaaagtttaaagacactgcggatagaatattctggctaagatcatgagctctggtgccagaccttccccactctttcacttattagctgtgtgatttggggcaaattgcttaacctttcattctttcaatcccctcatctgtaaaatggtgatgcaattccctgtgttgttagaaagattaaaggagttaatacatgtaaagttcctaggaaagtgtctaacattaagtgctcagtaccagctaacaagtgacaaagccagaattcaaaccaggcctgtgttgaaacattctactgtatctcatggccacatgtttaggcatctaatctgagttgtcagtatatgttcaaggaataccatgccattttaatataagcctatattttaaaaacatttctaggaaattgtcatgaaaaccaaagaatagcctttgtccaaattttttaaaagattaggatgagtatggttatgctgttttatataaattcttcaaatggatgactcttctattttatcaaccagaattataaattcattttattttatttttctttttgtatgtgctaggcgagtagcttgcattgccatggagaagaccaaacaggagcagcaggccagctgtacttggtttggcaagaaaaagaagcagtacaaagataaatatttggcaaagcacaatgcaggtagggaaaagcacaactgttactgaggctgggttaagcatctccaagacctaaaaagatgtaatattttaattcagtcttcagtgttctctatccaaaaaattctaccatatgagatcttcatcaactttcaaaacctttaagaaacccctacctccaattaatatgttgattatttgctagatattttacagagctatactttataggacaaaaatgttattttgaaatagtatcctctggaatgaaaagaatccaacacgttaagtcctcccctgagaaatgaaagcttgagagtttgctgagtagccaggattcttatctatccttggctgggattggtcttgaacagatctcctcccgcctggctcctgcctggcccttgggcgtggccctgagataaacatctgagggtagaggtgtgctcttatcagagaactgtgccacaaatggttctgtggttggtttgagagagtacaaatgacatggacactaacttggttttgtccatttctgtgagtcgtcttcttccctcatggtatttccaagctaccacaagagcaagaatcttatcttggccttccctttatagtatgtatgtttgcccatatggaagtttgtattcaacttaagtcaaaatgttcacttgtcttgttgaaaactggaattaataccaaaaaggcatgatctgttgttgcaatagaatccccagaagattcacagggtgcaacttaagctaaagaaaatgcatggtgatacacaggagtgctaatacaagaagttattttcaataacttcttaatacaactccttttataaggaactttttctgaggaattgaaagtcctgactggcattaggttagttcccaaggtttcagaaataactccaaaaattagaaatgtggcccaaaaaatcaagtgaatctagtcatgcatacccagattgatggcataatgtttctgacaagtatgaaatgcatttttctctgtaaatgttataacgtactctgaattgttcatttctcaatcagagattaaaagtaaacatttcaaactgctgtataatgtggaatgaatgtgagtggccacatgggttaagtttaaatggctcagttaaataaggaatcattcccttcgcattagttacattgtaccacatttttatttccaaaaacagtgtaatttctggttatgtactactacagagcagtagtttcataatggcttttttggttttatgaagggaagaaataaagcagactagttacacaaaatgtagcaactgttaagcaaatgctcaagtatactatttgaagaaatgcactgcagagccaggcacggtggtggtgcctgtaatcccagctacttaggaggctgaggcaggaagattgcttgagcccaggagttcgaggccagcctgggcaacagcaataccctgtctatacaaaataaaaataaactaaatagaaatgcacagcagtatcagcagaatgttgcttcacacaaaacgtcagtggttattaccaagtctccttagttgcccttacttctgtcagcttctaacagtctaacacaatctaataggctcacaaggagatgtgttgacatataaattgagaaatgtatgcatctcaccttgtaatttgtacagcagtgttaaatgatacatagatatagatgggattgaaattaacttacacctagaaaagcaaagaaatggctggttcaggctgtcagtttatcattagatttatgctgtactaatagaggtcatgtaaacatgagtattcagtttgccagtattctttaattcagctctgaggaaagtaagaaattcattgaaaaactagaattctctaaatgctgtcaaagagtcaatttaatcattaatttaagaattttgccagagaatcagcatccgatctggcagccagtgttttcactttttccactctttcaccaccagggtatcactgatcttcttccattgctcccattctctgattcccgttagatggtgcacagtggtcctgcaaacacacctgtaagcttaataggcagctggagataggaccaggaattagcacacctgagtaaccgtgcaatttgggcaaatcacttcgctcctacgggccttgaaatgagggaattaggttagtcaatcaaggagatcttttctaattctaaagatcagtgggtctcaggttctttcatcactgggcctgacaaatggcgatcattcaatgaagccaagtattcttgtactgtctatctcaggctcttgctctctggtagacattgcctatccaggttgaaagctatcacccttgacatagaaggcaggagcctaataggggtagaacagaattgctttttcctctgtcttttgacatttacctcctatcccaaaccattgacctctcttaagttcttgtcaacttagaatgaagaaaggaggggttgagaggacaggggagcctactgccaccacctgtttggtatcatcagtattttcctaaccagcggccgtctgggcatcagaaccttccttgccatgcttaaggggttgttctacatgtcagtgtgtgtcactgtgtataaggccctcctttgaaagaaagtctgagcttcttagatggtccttgcagagccccttaagtgtctttgtagaactttgtgtttaggcctatttgtgattctctagtcaggatatcattgttaggcttccctcacctgcaaaataatcactgtgagctctctttttagtttctctttttgggagaagattcccagcttttttccttgactttctgaaatacactgcctgcaaagcctagcattcctttctgtcaccatctcttcaggtttcttctgtgtcatcaaccaactcttccattttgttcattagaaagtccagaagaaccatttgcttagtattacctttgctttacaagagatcatagggtcaagtatttaatcagctgttctgcttttagctacgatgaaaggtcatcccaatatacagaagtgtccttataaagaattgctctaaaagagtgagaaacaaatactcttgacttccattggtgaggcagttgctttgagaacttagaaatatcatagcctttcataccaaaccagatgggctcatgggccacagatcaaacaatatctcaaaaggatttttctggcttttttagaagttgatggtaaaatacagtactctgttcttctgttactactcagtaaattaaaataagggctgtatgttttgtttcctgcttcaaatctttgagaattcatcatatattgatggcaagatccaaaccttatcaagttctgacattatttgtatttgtggtacaaatgaaggttgggaattttgtcattatctagaactggtgggaatgataatactagaattatttccatttttgtcgttaggaaattctacatagcttgttaaagtggaattctgttcaaactgtgttacctacaactcccatcataaagtgacagcctattcgctgaatttgacccataagtaaattttgtccctctaactcccacacacacagtgtttaagttttaataagtcatcacgtgtgaaagtcaggatatttaacataaaaatttgggtttcagagttcccttagaagaacaaggaatgcagcaataccaggtccactttctcttttagtaactctgggtggttaatatggcctttgaatggacgctcattctccagcacacactgtccgcaccactccctgtttttgcacctggcccacttcattcaaccacattagctacctgacccctgcgggcattcaagtatgtactccttaacccaatgctaccagtgtgcaatgctcttttgaattggaggtctttatagtatttgaagatcttgatagtgtttccagctgagacaaggattcaatgttaatggcttttttatggaaaaaattcaacctggaaagtagttacataaatacttaaaagaagtgtctggaatgttgagtagtttagcagaaaatcagggtaatatgagcaaactatgctagacagtatttctgaatccttgggaatagatttgattatggtgtgtgtagcttttacagcaaatacattttctgtaacatacagaaggtttctagccatgtatacttggtacaaaaagcattgtggtgtggctggaacaactgaactctagaggcattgagattcctcagcccccaggacttccaaaagtcattttagatcaagttactagtgtaaactttttaaaaatgtaggaagtcttcattaatttggtttcttaaatgttagagccccgaaatactctatttacatacacatatttgaacataggggatttctacagtaccattcataggtgtgcttaaattatgcttaataccacaaattagtactattgactttaaaagctattcttttttttctggaatacaagcaactctaaaggaaacaaaaagtagcccataaactcactgccctgttggcattaaaaataataataggctgtgcgcagcggctcatgcctgtaatcccagcaccttgggaggccgaggtgggcagatcacttgaggccaggagttcgagaccagcctggccaacatggcaaaaccccatctctactaaaaatacaaaaattagctgggtgtggtggcacacgcctgtaatcccagctacttgggaggctgaggcaggagaatcacttgaacccgggaggtccgcggaggctgcagtgagccaagatcccaccactgcactccagcctgggtgaaggagcgagaccctgtctcaataataataataataataataataataataataataataaaagtaataggcacacatggttagaaattacacatggtacaggaaggtacaaagtgaaaagcaaaaggcttccacgtctacactctctgaagaggttttcttgtaactattctcgataaaatgtctatgcatatgctagtatataaaatccgctggcttttatataaggatattgtcgaatttctattaaaatgagtttgtttcttaatgtgatttatttgccttgtgtttagaatattgcatgataaagtttattttatacatattatacttttattttactaatatatgaaaagccatatttcaatgacccctgtacatttttcatgctgtctcactcccaatggcctctgtgcatgtaagtaacctgttgaatgactatgcctctgtgtttttggtggttttcttttattaagtcctttttttaatcagcaagcaacttaaaacctttaaaagctcattctttaagtgctttcctaatattatttgtatctcttattttaaaataccctttttttattgtttctcaaccctatgaccgtgtggcaatttcatttagaccagagtaacctcttcatgctgctcatttatggttaagatattgatgtttaacatatctgtttcatttcattttcataacatgtctgtttgtggttttgatggttgacatctaactcattcttatgtgttttttaaaaaaatgacaagtcttaatttggtaggatcacagttagggctctatagagggataggtgtgtgtatataccattcggaaagcttgtgtcatcatcatcatcttgctcttttgtgagatgcttgcttatttttattaaaatatattaaaacatatctgcttgtcaatgcacttcttctgtaagcatactttttcttgatggaaatatcactcagagggcaataggtctaaaaaataatgccatcagcactcctgcttttatttttgcaactctcatcactccattactactgcagtataactaactagccctaccacagagagcctcatgttcattttaattttgtgagtctgccattctgaacacagaaaacatttcttggtttttagctattgctagaggatatgctttaaagactttcaatcaacctttataaatcaagttatcaaaagaaaacaaatgtgcaaaaacccattaatatacactaacctctattttaatatatcgtgtttctttttttatatattgtgataatggtgctttttgtttgtttgtttctgttctattctattcccaagtatcttattttgcattttaagtgattgggcaaatcactaatgttaagaactaaggtgatattcacagtcatttggccatagtgtttctaggagtagaaggttctcttaataaatgattggctaaagtaatgcagatttcggccgggcacgatggctcacacctgtaatcccaacacttcgggaggccaaggccagtgaatcacctgaggtcaggagttcaagaccagcctggccaacatggtgaaaccccatctcaacaaaaatacaaaaattgtctgggcgtaatggcaggtgcctgtaactcaggaagctgaggcaggagaatcgcttgaacctgggaggcagaggttgcagtgagccgagatcgcgccactgcactccagcctgggtggcacagcgagagtccatctcataaataaataaataaataaataataaagcagcccagattcctttattacatcatcaaatcaattttactgaatttattttaacccctctaaaatccagggtttattcaatattctttaaaaaaagaaatgtcagtatgtaactgacagcatttgggtatgaccatacaaaaaatattacaggaaacacagacatacaattttagccctttgtgagaatttccaaatgtgtgtgagaattggaccatgttgaatttcaacaggaatgggcatctgctcaggaaagttttgtacattgcttgaaattgcttttatcatagtgttaagaggcaggtttcagaaaaatatttgttaaagtatttctcctcagtctgtagtgattagagaactccacttttgcaaaggtttctgagctcagactctgcttcatgattctttccatcctgatccaccatacacaggctgcccatgtaatgggcgacaagttttcaggcccaggaaagcatgtaactctccttacatattcaagactttccattgagtggatatctgggttacagtaaagcttgtgagatgctcattgataagcttgtgcaatagttacagaacttgccttagaatctagcatgccaccttcatcaactctgttgaaagaaagaaccatgaagttaaagaccagctgtccatgcatttctcatccatctctagaaatgatctagctggcccctctcctggttaactttagttgcattcatgctatattcatgttggtcactgtctgtagactttttctttttagtattgctgacttcttagaattggaaaaatatgaacagcatgtggtttcaaattaattcatatgatttgttggatactacatgaaaagatatgtagtatcttttagatttggacattttaatgcatgtgttcagcatctttggatgcccctggttctaaagagcattttcatgggcttaaaaatgaaaatttctccctagatgctatatgacttaaattacatgtaagccatatatcataagttggattcatatttttaagacatggttttaatataactgtagttttgccagtaaaattataatttatgtacatgaaatagtcattctacaaatttacctttcttctaaatctttgcgttttagtgtttgatcaattagatcttgtcacatatgaagaagtagtaaaactgccagcattcaagaggaaaacactagtcttattaggtaagtttgattgtgtaagtgagttgcttattctcactttcaaaacattttgtgaacattattaagagttgtcagttttaacattctttttttctaaatgacataggcgcacatggtgttgggagaagacacataaaaaacactctcatcacaaagcacccagaccggtttgcgtaccctattccacgtaagcaatgtctcaatctcttttcattatatttttcctatcacttttttaactctataatttatgtatttttttctgattacataaggtataactgttcattgtaggaaatttgtaaaatcaaaaaaagaacaaggaggaaaatgagttaacagtaatcccaacccctctttccctataataagtgctataaatattttgttgtatacccttctaggcttctctgttgtatacccttctaggcttgtcttagtacagatatgtgtataaagtgtgtgtgtgtgtgtgtgtgtgtgtgtgtgtgtgtgtgtgttttaaataaaattagttttatccattctgtttgtaacaatttttctaacaatatgtcatacacattacctagatgaattattcttcagaaaaataagttttcatagttgtacagtttctgatatgacaatttttttcccttagttaatatttaaattgttgatttcttaccactttttaaacccaatcaatatgctaacagttgtttctgtaaagattttcaaatctgtaagatttttaattctccttattttccgtatcttattcttaacctcttgccctcttcattttctcaattgtaaaatgaagtaattcaggattgcagagaggatttgagatcatgtgtatgaagcacttagcagatggtggataagtagaagctatctaccactatcatttcattattatcatcattattctaaagtttaaaattttaggccaggcgcggtggctcatgcctgtaattccagcactttgggaggctgaggtgggcgaatcacctgaggtcgggagtttgagaccagcctgaccaacatggagaaaccccgtctctactaaaaatacaaaattagctaggcatagtggtgcatgcctgtaatcccagctactcagcaggctgaagcaggagaatcagttgaatccggaggtggaggttgtggtgagccgagatcgtgccattgcactccagcctgggcaacaagagtgaaactccgtctcaaaaaaaaataaataaaattttaaccccagaagctttctagcagctcagggttggaagagctaaaggaaaattattttttaagagcaacaggagaaaatgtgaagattggctccattctatagggccttcacatgccttcctgaagcaatgtcaataccacttacagttatctgtacacctcagagagccaggaggcttcatgagaaaaccttcatcccaaaaccttgtctgatttacacaagaaaagaaatgtatccaatagtgtctcatttggcactactggggttttctagtaaaacactttgaagtgttcttttaattctccttatgtctagatcatgagtacagcaagcttagctaacatttagcttcttcttaaccacgtaacaactgaacttccatgttattaaatggccagttaactagtttggttttaaaacttacctttgatgatgtcaatcatgactagtctttgaaatatttgaccctgtatgtgtatataacatatatctaactactgagatgactgaagatagtacaacatcaatatgttatgtaagttcttggctgggcgcggtggctcacacctataatcccagcactttgggaggccgagatgggtggatcacatgagaccaggagtttgagaccagcctggccaatgtggtgaaaccccatctctactaaaaatacaaaagttagccgggcatggtggcacacacctgtagtcccagctattagggtggctgaggcatgaaaatcgcttggaacccgggagctggaagttgcagtgagctgagatcttgctactgcactccagcctgggcaacagagtgagaccctgtctcaataaataaataaatagtaacgccggttcttcagcttttgatgtgcctagagaaagggcttctcttaaaatgtccacattttgatgaccacgagcactttatgttctaacaaacaggctagcaggaaagggggattccccattagtttaggctcatgtatacagaagagagtagcataaatttgttctttctcaaagaaagaaggaagcaaagaaattgagagagagagggaaaaaaagggaaggaagggagaaaagaaaggggggtagggagagagaatattaaaaccagtgttcctggctcatctagaaaaacatttcctaaagtgtgttttgcaggatactggtcctattagtatccacagaactagagcttattggcatatacttcagttacactcacttaggtgaggggtgggcaagccttttctgtaaaggaccagatagtacacatttgaggctttaaggccatacagtctatcacaagcacttagctctgctgttgtctcatgaaaacaaccataggcaatatgtaaacaaaagcacatggctgtgttccagtaaaactttgtttacaaaaacagacagtaggtggccaggtgcagtggctcacacctgtaatcccagcactttgggagactgaggcgggcagatcacctgaggtcaggagtttgagaccagtctggccaacatggtgaaaccccgtctctgttggaaatacaaaaaatagctgggcatggtggtacacgcctataatcccagctgctcaggaggctgagggcacaagaatctcttgaacccaggaggtggaagttgcagtgagctgagatcgcaccactgcactccagcctgggctacagagtgggactctgtctccaaaataaaaaaataaaaataaaaaaagacagtagaccatgtttggcccataagccagtttgtcacctcctgatttaggtcttccataataattatgggtatgtctggccacagtcattgtgttttcagtgtaacgtgtcttttgctgtatcctaacattctccttttgcaagatgttatagaacatcacttttcaatagaactttctgtgacaatgacagtacttgatgtctgtgcagtccagtacagtggccactaaccatacgtggttattgaatccttgaaatgccactagtgagactgagaaactaaaatttgaattttatttaattttggcttatttaaatttaaccatatgcagttttccatttttttattctccttttttccttctacacaagacccaactgcattaaggcatacagtgagttatattaatcttgggtcatttcacgtcttcctcctgtggtggttcatgaagggataaaatacatctcacctgaacactgaaagtttcaccaaaccagacaattcactggctactatggtgtgatgcacacagataaatatggtttctagaatttagttctgcaaagccactgggggtgagaacaggggatatgagatatacgctaaagaatccacagcttttaggaagagactgggtttgagtaaatctgttgggagtgtagtaagctcatcagctcagccttttaaacctcttgtgccatgcgactttgcagatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggtaatgcccagcctccccgaatgtctgacatcctgcctgcatgccaataagcacagattctgaaatcaaaaatgccatcagaaagtcacaggtcacataataatttcataaaccacagaaaagtatcagtaatggaggcgttgggggttcacagtctagaatgccagctgactaatcgttggactcagtgcacacaccatgtatttaagaagcagagattattctcttaagaggtttattatatgcagaagctcagtaaggttcctgattgtgtctacgcctgccagaaatcctacgatcatctgacctcaggatgaggctctggcactttgttatcacaacagccaccttccctctctgggtacagctcacgctggaccatcagagcctctaccagcacattatgttaatctccagtgagaaactgatcctggggcctgggtctgaaacacagcactagctttatgaaagcaagcatgagtgagcccagatgtcagagacagcagggatggaaacccatggtggctctcagcctctgccatttccttacctgagcacaatgcctgaccctgagcaaaaactaggagagagataaagacttggaagaggactcaaaagagagccagacacagagatgatgaaatggtttctagatatgtcttgcagtaggaattattaaacttgaaaaagagaaagctgaaggctttacatcaaaaatgctgacaagctgttttttcatctctgagtacaaaccaagtagatatgggaggcaaagtatagtaggaaggatttgggagttgtagacatcaaggtgggttataggagaggcttgtgggtgccatgtgactcctgggtctgccatttctaggactgatctgtaccaaatctcctttaacccttagaaatagaaccagtatgctacctgctgaaatagtagaccagcttccctcaagcaggctgtgtttcatcaggaggcttacctggctatcttaggcagggcgaatccctgttcaagggccactgtatgagacttggtcccctaaccatccctaaagcaaggacagaacctatatagccagagtctgtgtgacctgggacctgacagctcagtttctgggctccaggatcctaattcgtggccagtgggttcacccatttccgtttacaacacctgatggggttcttgaacttggaactttggaaaccacaaaaggatctgttcaaggggctagggaggaaagcagcagtagggtgaacactgccgtttacttaacaattaacttggacctatatagaactaaatatatgatgtgtaccacagattgatttttgtttaactactaatccctccttactagggattggaaaaatcttctggccaggggtggctagaggcaaagtctcaatcctggtcctggtcttcgacatcctctccttgggttccacactggtcttcacctgaacgtcgttttctgctggtagtaatgtctctagcagtatgctggctgcagggctcctcagactccctctgcattacctaagtccactttcgagggctttctgccttacctgcctccgctgctgccgccgccaccgccactgctgctgctgccgctgctgctgctgctccacccatagcgtccagctctccctttctccttgcccttgcacagccatgcattgctctgcactgctgagtgggagacacttctctcagcctcctcaggacacccacagcagttacttttacccattgcacttggccccaaagcacctcctcaccccggctgggcactctcctctgctcccctgagtgctggatgagctcacctgcactcttctctcctgcttcctgggtccctgcctctcagaactgtgatctctcagatccacctagccctgagggccggccataggcatcctggctgcctgagtctctttgggccagcggccctggggatagggattgcccaggtcctgctcctcctgttggtctggttgactacactggtcccaggccctcctgcgcaggccagcctcatgccagtcctggtctcacaatgaccattgcataccacagtacagctgagaatgcccgcagtctgcaccgactgggcttcactctcgggcttctctgccctcagcccagtctctcctcagctggacaaggccttcatcctgccttcaggatacccgtgaccatgaacaacttgctttcaggcagagcctcactgctccagggaggctctctccttaggacatttttctccatccccctttcccactccagcttcttagatgacccctctactgtatcttacagacaatttaatccaacaaacttgtattaagcccttattatatgtcaagcacagggtcaggagctaagaatacaattcagaagacaagatggtgaggatgaaattccttcctcattgtacatccaaaactgtccataacagaagggccttgtggcattttttagaatcctctcacttctgccaaactacatgtggaccataggaaaaccacctaacacatgtccagctcttttagtacaggtctaatactttatgccatcttatttcagacaactgaggcccaattgagcacgtctaataatactatatgataagatgttgtggtccaactttaaagctagaggatgatggtaaagacattaaactagaaagaaattaataacctagcttctcataaaatagtaatagattatgttcttatagtgctgtatattttgccaggcgttatgactccttacctaatccttgtaaccctatgagctggagatcagtatctagttttgtagatggagaaaccaaggcttaacataattgtgactcgattaaggctttacagccaattgaaagtgaggtgtgaagttgaactgtgttgatttttaaatttttattcttttacagtaaatccccacttcctttcactgtaccaccctagaagaggtaaccctgggaatccttaagatggttcaccttatccatagtagtacaatgtaaagcctcattttttcttaacattcagaaaaatctgtaattcagtcaaacctaagaaaagctgtagaatttatttctcatgaaaataaagctatggctcagaaaataatctgtgcccctaaagctgaaactgtaatagccccagtgtgtaatcagagcttaatgtgatggttttagattttaactttattctgatgtatccatttgtagcatgaaaaagttaatagtagcagaatatttgtagttttgcttttgcccacagcggaagaggtcatcatcaagaggcagcatacagtcttgttaggaatccatactttaaaacaagagccaggttctgaaccagagactattttgtgaaatcagttatctctcttgagatgggttctggggtcactgcactcttcctaaacccttagatttttgtacaaaatgactcagatgcttgcctctgtgtgccttttaagtttgcaaaccagaatagatatctgcctcttatacacttgggtcaaatgagtttctattccttgaggataataacctgagattaattattggccatagccaagccatagaatcaatttatctccacaaatgttagattaatgttactttgactatctgaatctagcatgctttcagtgatctttctagagcgtgctctttctctccctgtccatatctgtccctgtttctctctctctctctacacacacacacactctctctctctctctgtctctctctctgcctctccccctctctctcactctctgtctctctctctgtccccgtctctctctccgaatcccagagagattcggagagaaatatttgcccatgaacattaaaaaatgtgtgcctcatcctgagtcagaaaggaagagggtttagagttcatctttaagtcacctattaactgcctgagagaggggaatccttgtgagcaattccatttcctgtccctgaagtaactctgaacctcagccaggctaccacagcaccaaaagtggcacccacttgagacccgtaagtagtgcagagtatggcccaaagaccttcaagaacaagcgaggaaatgtgtggtgagtctgctgaaaatatgaggctgactagacaggaaaatctcaatcaggatttgaggcatcttagaatttttgaaagtacaataataaagtatagaaatagaaaaagctacaaaaaggaggagaaagcaaatatgctaaccacagggctactttagttactgtgataaacattaaatttggctctgaacttcctgacaaccagggcaaaaaaaaggaaatcaaggaatataacctgattcgtagacataagaggcatttggcaatgtgaggaacatggccaccattgatggttttatgcagtgagtgcagtctatggatatagaccaagggtgtgaatgcagtgcagagatgggcaatctgcaggaagctaaactaatgttccaagcagtttgttttctgctgttgtaatgtgatagctggaatggaaaacatgataaggactgggtagctggcaggctgggccactgagtgcagaaaaaaaccatttcatgcccagggtgtcattctctacttcatctgtgggttccgttcagcatccaggctgggtggacttccatctagcacttagagtagctttggggatagaagcaaataggattctttcccatctcagttgcccagaagcaggctatgggatgggtatatgtgtgtgaccgggagtaggggtgatgagaaaaccttgtctcagctgaccctgtattcacctgatctatgagcataggaaggaaggaaaaaaggcctaagataatactgacataaaggatatttctaagtgaagatccctgttagcttgcttgagctatatatggactttgtcataatgtttgttcctggcttaagtcttcagccacaaaaggattggcaaagaaattgccagttacctctttcaaaaattaacatatgcaagcttaaagagctttcttaccagaagaatcagagcctaggactttaagagttaaaaaactttgatggataaatacaatgtaccagtctccctcaacccacaagaagatgctgtgtgactaaaattcagaaatataatcctagtgaaagccaaccttgcactaaaaaaagaaagaacctttcatgtcaaatttgtctcttacatgcctgtatacacaaagaggctaagagagtcccttcagccaagagagtagagtgctctgtagatgaacctgccttaaaagacaagataaattctgtgcaaattatatctactatttttacattttaattttttcataagggcagtttatgctgggtgccatattgggcatgagtgagatagctgaacaagacacagtccctcccttcaaggagggtacccgctagtccctggggtcttgggtttcccacgtgatgggtacttcaggagcacatgggagggtctcagagctcacaaaggacttcccaaagaaaagagcatcagtactgagttctgaaggattactcagccaagcaaaagagtgagtggggaaggggaagagaggatgggaggttcaggcagagggagtagtaaatcaaaaggccaggaagccagagagagtctggccctttctggaactgaaagtagttcaggaaggctggtccatggagccaaaggagcagagagaaaggctgaagaggttaagcataggcatgcttgtgagggagagaggtgacattcatgctgaggagtatacattttatcctgaggccaagagggaactgttgaattctgagcaggggagccatgggttttgaatttcagaaagatcattccagtagcagggtagagtatggattggaaagcagcaaaaccagaggcagggcaaccagtctaattactattacaataagctgggcaaaagatggagcaataggaatagcgtgaagcaagcaaatttaaagaccatttagagagcaaaatatgtggggagcaggatagttaaattcttgtgtaagtgacagcaagatatttaccccagcgcatatgaattaatcacatgtcagtcacttgtgaattgggtacctgtatgtgttgggttttgttccttggaagggagtttgtaacctccaagataatcatatcctcctggggaggagctgaaacagtaatcccttagcagaatcaactcccacagcgtctgactgcagcgttgcagtatatctatccaaactagtagctggcatttagaggttttcaatgccttagaagggaactgaaagggatctcagaggcccttctgtcttgagtgcagcattttctcatgggcctatacattgcccacagccacacagtgtctttagcgacaggactaagacacaaagtctagggctcctaactccagccctgggcaaggttcccccttccccaggagtcccagggggcttttctgcagagcaacacacagttacagtggacagatttgctagcaatccttggctagcaatttgaaatttgaaatgtgagggagtggcctccagattagtggtaaaaccagccggcaggtccaagtctccccttaaatgcatttcctgttgattaaaattcaggctaaaactaatagccaggtttaaatgaacattaaccaacataatcagtgttaacttttatgaagaaaaatagattgattcatgagtcataagaaaaatgtccagtttgccaacttttattttctgatggctattgtccatcctttagaaaaaaagtaatataagttatgtataaagttggtaaatttaataataccttgccaaaaatttgagccaagagcttggaattttcagttgtataaaaatttttatagactcatttgaaagttacattagttatttcttcttttaagtcgggattttttttttttttcttaacacaggcactgaaggtcctgagaactgcagagtttgctccttttgttgttttcattgctgcaccaactattactccaggtttaaatgaggtaagaatcaatctgtttttccccaaataagctgtaaggatcaagccttactccccagcacagtcagaagcgtgtcagtctacatttgcagcaaggctgctctgatgaaatgggatgtggaatagaatgctacatgggacagtcttatcagtaagctgacttctaaaatctgaggacaaacaccctcactcccaccaggaccgaggcatcccaggtgtctcacaacctccagggctgccagcctattccctctccggatagggattgtgtggcccctggagtggaacctttgtggaatttctctccaggcccctgaagactaccaaacctagaaatcagctctgtccactgtcaagccagctcaagtcagaaactgccacagacatggtgctcatgagacttggctgctgacttagaaggttttccattgctgagcagatcaaagggtacttaccatgtgtctgctaagtgtagcagtgcctatcttctgtaggttccttagttaaggggagactcttataccaagttatcctgaagaccattgctttcacagcttctagaaatcatcagaggactcttgattgactctgttcagtcaacactgacctaaactcactcaagcttaaaatctaattaaatcatggcttggaaattttccctttgtgtacctttaaggaagattcaggattttgatttacctatgttactcatattttccgtcattatgtttttgtcatttcatctgcaagaggtatattcctttgtaaaattctaccttcccatcttatttaatacataagcatgtttgaaactccacattgtggttagcttttatccttcagttgccatgtatttttcttgaatcatcatctttgctttgtttttgttttgcctgttttcctgcccttttactaattttccatagctgccaaaatggtgcagaaaattgcctgtaagtaccagctaggaggtggtgaaatacagccgtgtttcttttaatagatttagaatgtagacactttgttcccacaaatccttgcttttgctgttagaataaaggcattttgttttcactgagttaaaccctgctcacgtgtgagtcaagcacacagacaagctgttgtcgaggaagagactgacaaatatagcttcgtcttaaaagattcttaagagggagctttatttttctgtaaagagacctacattaaaaatgtgatactttcagccataaattttcttgaatattttcatcagcccagcttgctgagcaaatcataaaccctgctagtggtttttgaagctcaggactatatattcaaatagaatcccgtgtgccagagagtgatgttgtaggaattgttccttttcatcctggtaggaagcactcctgtctttgggtgaatgcacatttgctaaaatggcgttttttgcattgtgttgattatgaagtaaagccacagtgaaaatactatgctttttaagtgcaagccgaactagaaggtgatgattaactggggtcttatctacactgtagtacttaacactaacattcaaagcatgccctgtcctgctttgaaatgccagtaaaagaggacaaaacaggtaggacattcttggttcagagtgccctgagagaaaagattgagttcctgtctgctgtggtgtctgcgcatgcccactgcagtgccaggacagaatcaagcaagtctctttatctcacttctagtcccctttcttgagagctgtacccagagagctgaggcttgcctggacctcccagcagcctcccaggaaaggtctcttgccaataacagaggggctttagagaagaggagaggaggggaggggccctaagccagtactgggtactacggctcctaggtccttgaaggtaccgcatcttttattttctctggagatctgtctctgtcacccagggccccaatttcctggaagaattgctcagtctcttgattttagatttaatacttgtaaaaccctataatgactggcactagtcagacaagtgcttgttcttttgacagcatttattaagcacttactatgtgtaaggcactatgcctaatgctggggcacagcaattacagggcacacaagacaagtttatgccctagctggagacatagccactaatcaaataaagaggtatttcgttatctctatgtatatttaagactcagcccaagagctcacccacctagtgtttggcaggtagggggtggttaatttgactcacaaagttccctagtgtcaaggttgaacttgccctttgggagttcagcatgacaaatatgacttgcgaagatatagaggcagacttctttctggtggctcttaagagacccctgtcttgaaagaactgccactctgtagcagaagctatacttgcatgacaaagctgggaccctaaactccctcctcctgttggatccctcttacaagagttcttaaaatctgtggcaagctgcagcttagggaacatcctttgttgcagcaaacctccctagagttcagtactccctagagttctcttccttctgtttttttcataagagatatgaggacctacgaacagtgacatttgtctagccacttctaatgcagaccaatttggggggattcatcagatgccaggtgctgtttattggggaaacagccttattccagccattatttgtaacactcaaagatcttttgcctctggcatcagctgctattgagtgagggccattatatgtaattgaattcctagaacgtgtggcacctttaagtagaagaggaaaaaatacaacttaatttgtcatccaagggcagggacttgttggtgcaaacacagctgggccctgaggcctggctccagtgagtgtggaggaccaaggggacgggggcaaagagctccagccttgccaccgtagccctctcgccaattgggagagtggcttgaggctagggcggggggcttcctgctggcctgtttgggccaccatagccactgtaacccacacctggcatggccctaccaagcctgactctggggacaggcacagctaggcctgagtgggggtggcatgtttcctgaagagtatctgttttctctggttcgtctgctttgtcatggaccctctgttgcatgttgagcaatcactgtctcctctgtcatggagcggacttggcctcatgctggcatatggcatatcagggtctggccttgactgtttctgacactgggatgaacaaaaatgtgaaaagagaacgaatccaactgatttctctcttctgtttgcttttccctcctctcatgcccacccctacctccatctcatcaccatttaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaataattaaatgcctttgggtccttcatttcattatagatttgttcaggcttccaagctgataatctttacaattgtataatttgttagatgctcattgaacctttgaaggcccaggagtgagtatcagttggcagggtgacaaagtagcctgccagagcacagctggaccacgtctgactcgcacagagccatgcgcccaagggccacgggtgtactggaggccacctgtggtctctccttcctcttgctgtatcccttggcacaggggaatcatctgtccttgttgctttagagacattaaccatctcataactcttccatgaagtcacattcttccaatacaggagattcgggctggggttctcagactctttgccagaggtcagtagaatgtttttcattagcatgtgagggtgtgaagtgcttatattaacctgtgatccttgaaaacataccatcattttttgcttcttgtaggttagatggccttgtcactttgtgccttggcaggatgtgcagggtgtgttctgagctgaacagctcctcttaaaggaccaaacagagaaggcattagtatacttcttttacattgtcaacaccatacccgcctccgccccccaccgcctattattaaatggtggcgatttttttttttctgatgttgttctttgccagtgaccagatgagtctgcaacttactaacaaggtattgagtgaactacttctgtatgggccccacagtggggtgaccaagccaccaaaccagagataagctcaacagtggtctcacactagatagagagagaaaccttcaaagagttgggtagggctgtgttagaactgattcgaatctgatagatgccaaggccagacagtcgttcctggtatggtactgaccacaatttcgggctcttagtgtgaaggtgcgcactctacctcttttctggtgaagcacaaagacaactacaactaacacatgggaaacagaaacttccctccctctagtggaaacccccacgcccccacttgccctttgagcccacatctccagagatgctgatgatgcctgtcttaagccatctgccatatttataaaggtggattaagcagaggaggagaaaagcaatgccaacttaaatgtctgtggccccacaattcacaagcactgtagcactcatcctcagtggctttatacgtcctctgagaagcacacaggcaggcatcattcttgccatcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatctcttgtcaggtgagatgatttaaaatctttgctcagagaggaaaacaaatggttgacctacttcttgctatttgcattcagaaggcatcgtcccagcccatcctattggtggcagaatatctaaagatgtcgcaaagtcccccactgcagtagaaatgcaggaggtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgcttttctttctctctgtgtgtatctatttacatgccttagcacacgccctcccatcctgatccctttgccctgtcgccggaacaaccagaatgctggtgcgctgccggcacagtacaagttgatgaaaccctaatcagttatcttgtgtgacaggggaagaagagaaactccatagtattccttgtagaatatacatacctgtaggatgctgtgtaatgggaaaccatagaattgggcttttgtcatttcaaagttggagaaatgtatgaataaaatgtataaaacatgaaa

SEQ ID NO: 5655 - DNA, 408100 bp, human; identical to SEQ ID NO: 5654

SEQ ID NO: 5656 - DNA, 404198 bp, human
gccgccgccacctccctccgcggcgatcctcgctccatggtcctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgtataattacgctggggaaaagcagggaatcagattaatcacagtgctgattgagaattaaatctgcagttcctcatctaattgtccattccttaaatctattttgaatagtttccttttcattcttgtcaaacagtactccaagtgcacaatcctgctaatttgcttgtgaaggaaatgctggcaatctgaagttgatttcctaacacagcgtgtattctgcggctttagaagttgaggagataagatttaagagcaaatttttgcttaataaggatcgctagagctaacattgaaatatcttacctctttttttttttttttttttttttggaagcggtgctttattgtctattttaaggtccacagttgggaaatgaaaccaagaccttaaagcagttggccctatctcttttaagttgtctgcagtactcaatttcaatttgagtgctaatttgtttccttttctttccatattgaggtattacagtgttgcctcacatggtgaaattgtgggtagagcttgctacacactttactcagacccaattgatgtgaggacatgttactccttgccctattgttacatgaccagccagacttaaaaggaaagtatccaaatgtgtcctgttaaagtgcttgtggaagtgttctagaacagcactgtccaaaagatatattatgagccacatttgtaatttaaaattttctagtagccacatttaataaaaacatacaggtgcaattaattttaataaaatattttatttaaccctgtagatccaaacttaacatttcaacatgtaatcaatatgaaaaaatattaatgaaatattttacatcttttatgctaagtctttgaaatcccaatgtgtattttacactaatagcacatctcaattctgacactaagctacatttctgatgaaaatcagaaatacttaatctgtatttaggtttcataaaatttgcgtttgcaaaagtatattcacatacccaagttgttcccaatatacataaaagttttccaataaccgaatcaagtacctttttctaaatttaaattttaattaattaaaattaaatacaattcaaaattcagtttcccagtcggaccagccacgtttcaggtgcccagtagccacatgtgaatagcacagttctagagagaaaaatgcatcaaaaatctccttggtttcctcattcttaggagcacccagtgaagataaattaggtgtttcccaaaagcctccaaatgactgtatgtgtgggtgaatgatgtttgttgcatcttagttatagctgatgtaaatgaactaacaaagtcataattggaaaatgtgagattaaaatgttaattatattgtgaagatgtaaaatagccatctctgaatcagttttggtaactagttctgattccttaaagtctggaagggtgatgatgtgatctctttggatatcaaaaagaaatggtcagaatcacattaacacagtccatattctgctgatttgtaattgatagaatatttttcaggaaacacccctgggagaaaaaaattcatcttttctgactgtttcagagctgcataaagaggggcagcaagctaattttgaggtgataggtactctatggctaccttaactactatgaactgtgaaatctcattcatatcctacaaaatctgacttggtcagtgccaattataaaatgccattatgtgaaataatgaattcaagctagccttattgttaaagaatgtaataatagtgttcctcaatctgagtaaaggttgaaggtttctctagtaaattgtcttagtatatattgatctggaaattgaaattagcttgagattttcttgcagggaccttgacagcatacatttttaacttataatttgttcacctctgaatttgaacagaaagcccttgaagatattcacatgtactgaaaacctttttattgatttctatccaagttctatggaattttgattttcttttttaccaaattagtatcacaagttgtttttcaccactagatcttaataggttttaatttttactaaggtactttaaaatagatttcacttttcaagactaattgactacccactcactcctctacctacgcaaccacctactcactcacccactgtgtacttggccttacttgatggcataaatgaaagttctcgtttaatttagacccttcagtgtgtttttttcccccttggttgagaaagataacttacagagttaatgaggttttgaaatataagatcattatttggaatatgttttctttccagtggttgcagcctttacccttgttaaagctgtctttgagggaacatgtgcccaatttgttacaaatattggaaggatgccgtttccctttttaaaaattaaaactcttttccctgtgtttctcatttttgaaaatcttgcagaaactcctttgagtgactgttggttctataacattttctatgtaactatcttttaaatgactgaaacaaatctccaataataagaccttatcatagtcccaaaacttcttgtcttagcaaatgtagcgattactggaaaggaagggcgttatgcaaatgaggttaatgactaatttttatgtcatgatcatttactgtatcttttacaattataagtaagtgtacaaccggtaatactacatgaaggaaatttaagacaattcatcgaaattaaaacatagaaaaatgcctactttcttggtacagcagtgtgtatgaaagggaataacaaaatacataccatttttaccttgtgttaggtgaatacttgccctgtttagtagcctgtagcttcagactttcctgctctggtaggacatacactaaaattggaatgatgcagcatgacccttgcttaaggatgacgtgcaactttgtgaggcatgctgtatttgcttactcctcgagagcacttttatttaattacagttacttatttatggatctctctagttcactaataaggagcttcctgagggcagggaatgtttcttacacatctttctccattaacacagtgcgtgcaatgtaactgcctttcattagctgtggaatgaattgagtagttttaataaaatctcattaaaaggcaaaaaagcatgtttgtcaacctcagagcaattattgtccgaagagcctgcattagtttaaagtagtggttctccacctggctgcatattagaatcatccggggagcttttaaaaaagatcaacgccagagccctgtgtcaaagcagtgaagtccgagtttctgggactgggtcctggtcactgacatttttttaaagctctctgtgtgattctaatatgcagctataatgaggaatcattggcttaaaacttagattatgtatgtaatattttgggactggcttttcagaggcttacaattcttacaaagtagaataaattctttttggaaggtattgaagctaaatggctaaaacatggattttatcttctatgcacttgtgtttctcagccttattgtgtaaaaatttagttttagcttgtgtttggctttgatttcttgggccttttaagatccacattgatttatgacactcatctaatgctaacatggcgattgtctgacgtttggaacaacacagaacaaggattgcttcaataacagttgatgatggttttccactataatggcttgatttaatatgaagaaatttatcagtttagtatggattgtgtttgtacatacactctattaaaagagtatggttaagttgcttgtatgctttaaattacatacttgtgattccagtaatgctgttagctggagaattgagttaatgcagcctttatgtaaatactggattaataatacgtaaagtatataattcagcatacagaaaaattcagctttactaatttgtactaattactatgactttcacatgtattgattcatgcagtgatttgggtttctagtaccatagggagaatttcgcattgtgttgaaaaaatgtttcccggaaattttaactagactttgtaggtaaactagtttttaatgttaggaaaagatcaagtgtttgcctgaaggaaccgagaattttccagaaatgagtagatattccagaaataccagtgatcgtgaaagcagtgcatgatcacagtgacagccaagtaacaaggtaaaagaagtgatcagcagctaaattgttggtggcccagaaagaatgcaagccatgggagttaagctgtacttctacagaggaaaatccttttgaactcagggtgtggatgctacagatagcaggcctcaatgggagtggggaagcaatattgattcctgatgatcctaggatcatttggagggagaacagagctactccgttgcttttctgcatgtatacaaccttctctagtctcttcctgtctgctttttacagattgctttagggtgtgttgtttgaagttgtcttcataaatacttcctgtggactcccttaatttttatgtccgtaacacgcttctatgtacttgacatacgcagttcagctctctccattttttccttgtatctgcaacagtttcacctgatgaactacgtctcaagtgtccctaaattgtgtacctggatatttcctttaaactgaaaattctgtctccagctgtagttctactcaataaattgaaggagcagatataccttgcttcttgagattattcttgaattattacattttcttaaacgttttcacattttaaatgtggtaggagcactgcatttaaaggaactttgacataaggttgtttaaaaaacttctataacttaaagcttactttataaagggattgacatttatccctctaatgttaggcattttggatgtattatttaatcatacccattttacagagaacactgagattcagagggggtgatcagtaattcgcctaagatcacacagattccaacgcggttccatggttttaaagtctgttcatttcatgctgcattctgctgctaattcaagttgtgaaaatactgtgttggattttcttaaagacacgtcttcattttcagagtttctatactgcaaattttagttgtttgactttctggttaaatttcttatttcttcagtagaggttccatatactattcattctttcatctgtttcttttttatttttgtctttctctttaatgaaacatcagcatttgttaccaaactaactggtaaatctagcaatggaaatatagactcttggccatctgtccaaaatataatttgttttggaactttctctacttcttttactctccaaattttttcttccatttcccttgccccaacagacaggatagttgattaattacccctaacttgccaaaccagaagtaataaggtttcagaggtagatgtttgttggaagtggggtggagtggtttccaaaggatagttattcctttatcctgtgataaaaatacggagattgttctctctgattctgaaaaccgtgtagtgagctgcagccgctgagtctgtgagcttctagctgtttgccagcactgtacaccttaaataatcaagagactgagttaactattgcagagcaggtaccggaccccagccaacaagctgatgggatgtgctgttctcacattttttggttttattttttagttgcaactgacagtgaagattctagaagcaccaaatatggctctggatttatgctgtgggatttaagatgctacagaacttgctctccttcctttctgtcctggagccactatggtattggttgtagagcccaagtcagtatagagtctctgacttctaccctgggaaaatttcatttccgaagctagtttgttttgaagttaatgtttatttccaacattgagatttaataattttgtgttacttttctttattaattagtttttatacagtaaattataaaagtaatgatgcacgtagtaaattttattttctttttttgagatggagtctcgctctgtctcccaggctggagtgcagtggcacgatcttggctcactacaacctccgcctcctgggttcaagtgattctcttgcctcagcctcccaacaagctgggattacaagcatgcaccaccgcgcctggctaatttgtgtgtgcgtgtgtgtgtgtgtgtgtgtgtgtgttttgagacggagtctcactctgtcgcccaggctggagtgcaatggcgcgatctcggcttactgcaagctccgcctcccaggttcacgccattctcctgcctcagcctcccgagtagctgggactacagacgcccggctaatttttttttttttttttgtatttctagtagagatggggtttcaccatgtaagccaggatggtcttgatctcctgacctcgtgatccacccgccttggcctcccaaagtgctgggattacaggcgtgagccaccgcgtccagcctagttttttatttttagtagagacggggtttcaccaggctggtctcgaactcctgacgtcaggtgatccacctgccttggtctcccaaagtgctgggattacaggcgtgagccactgtgcccagccatacaatttaaaatataggtgatacaaagataagtagtgagtctgtctcaattctcctaccatccatatccccattctctagaggtaaccattgttcagtttcttctccatctttctggaagctttttgtttaaaagtgagatatttgtatactatgctgaaatattgatttttcatgaataatagtatatacttgatgatcttgtcatatccatcaatgtatctgtctgtctctatctcctctttagctgctgcccagtattctgtcatatggattgttactttggctttggattgagtgcaagccaattgtaattttacattgcttgaaatgctgagctggaatttgggtgagaggtatggaatggcagtgaagatttgggagtcatctgtgtggaagtaaaactgagtgaacaagttcttgggggttgactgctctagggctcgtggtttggagtataactcatagagttagaagaatcaggataatgggctgcacagaagtttaaaagaggggggaggatcaataatgtaaaatgccaatatactctgaggactaagaacacatgtggctataacagagaaacaatttaaagcacttatcaaaatgaatattatgtttaatagtcaattcatgatgtgtctgaaaagctaggtctggcttcttttctgtggatactagtaattttatactatctctctgtaaatctatctcagaaccaacatatttagggtaaaaacaaagtagatttctttttcactctaattgtgttttgcagatttctgatgactggcttttaggtaaaatcatttggttttcctaagattatgtccttttcattcccgagcttgtgcatgactgtcaattaaatggaagcctttcatgaagtgacaaagtaagttttagatactttacatttactttaagttcttggtatgtgtcaaaccactgttattgtcttatatctttctactataggaaactgaattctttctagcctcaaggatttttgtccacgttggatgaatgtagtactgtcctcctctttcacatttcttctcccatcacctcctaactaaatttgttcattggctatttttggttgtccacatccattcacaataagaaacgattgcttcgttgtacataagccagttttttggtatctaagtgcgtgctatttcacttcagcttcttgtattctatttattactgggctgttgtacattgttttttctcccaatctttgtgatttcttttaatatactttctttcctttttgctttgtaatcattgttttgagtatttgaatcatttgcaggtaagaatgtggattgttctgtctctcatgtagtttaataatatccaaaatatactatgttcagtctgtatttcaggcttttaacacttaagttagagtattttggtatatttaaatctaggatagaagtacactgtattaccattcaactacatgcagattttaatgttttcttaaattaaaggatgatgatattcattcagttacagaggtctctctctctagtccttccatggtgtgcagattaccattatactactgctatttcatagattctaatttgtgtttttagaaaacatcatcaattcttggccttctttcttacccttggtatgtgatttcccctaaaggtatggaatgcggttgctctgtggcttgttaggcagcccccttctgatctggtaacctttgggcacagtgtggctattttctccttatttataaaaggaatgatagctgcttcacaaaccatttgtgtggattagtgaattgtaaagtgcagcataagtattttttatttctagaatgtctctgagatactcaaattacttttggcagttatgtacgtaagtttcaacaatttccaaatgtgcacattctcagtgctaaacacaggctctattacataaataatatggtgaaatgaacattcttttctaccatgtgtgtaaaattgttagtggtgctaacttttattcattgttcatttatgtattcatttctagctatgaggtcctgggcaagttagttagcctctctgaccctcagtttctttatctgtaaaatgtggttaatggtatatactttgtaaggttgttgtgaggattgaatagcatgatctatgtgaaatgtctaaaggttgttattttaattgccattgtcattattattattttttaaattttattattattatactttaagttttagggtacatgtgcacaacgtgcaggtttgttacaaatgtatacatgtgccatgttggtgtgctgcacccattaactcgtcatttagcattaggtattgctattcaccaaacacttgagttctctggcctcagggagctcaaatgagttattcacacactcatgcacatatcctctgcgtaacttggtaaccaacagacacacatagtaaaatatttggtcagcagttgttgaatgagtgagtacattaactgagaaatccagagactgtgtgaccacctagtaggagaaggaagttggggaaatcattacagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaaagcgctgcgattacaggcatgaaccactgcacccagcctaagaaatatattgaagagtcctttctgtctttttaaaaactgtccaggccgggtgcagtggcttatgcccgtaatcccagcacgttggaaggctgaggtgggtggctcacttgaggtcaggagtttgagaccagcctgactaacgtggtgaagccccgtctctactaaaaatacaaatattagctgggcatggtggtgcgtgcctgtaatcccagctacttgggaggctgaggcaggagaattgcttgaacccaggaggcggaggttgcagcgagccaagattgcaccactgtagtccagctggggcaacaagagcaaaactctgtctcaaaaaaaaaaaaaaaaaaaaaaaacagaaaacaaacaaaaaaactgtccagtgagctgtaatcactgcactccaacccaggcaacagagcaagacactgtcttaaaaaaattcttttaaaaatgtcattgctctcattgttcaactcccacttatgagtaagaacatgcagtgtttggttttctgttcctgtgttagtttgctgagaatgatggtttccagcttcatccatgagaacatataggcacagggaggggaacatcacacaccggggcctgttgggggttggggggcaaggggagggataacattaggagaaatacctaatgtagatgatgggttgatgggtgcagcaaaccaccatggcacatgtatacctatgtaacaaacctgtacgttctgcacatgtatcccagaacttaaagtataataaaaaaagttaaaaaaaaactgtcattgcctcttatgtacatagaaaatacagtattgagttacagattttcataatttgtttccaagtctgttctagattataattccgtagtgttgtgaaaaactcccaagattgttaaaagaaggaattttgtatcacacttcttatgtttgcatttagacaattgacagattaattaattgttcataatgtgaaatttcaagactgaaaaaaggaaaatcccagaatatatatttcagaaacacccatatataggatttatgaatattgtagtgttcctttatgtaacttcccaaaattttattacaacagcaatttctacatcttaacagtgagcaaaatgaggtggaaagattctgaagttgtagtctctgacactactgggcactgaatctaaataacctaaaaccacagaacagtatttcatcttctagttcttattacattgtcaggtgtaagaatgatcatgttgaaattgagtggttggtctgtttagatcacttctatggaaatactgcttagattggtttcagaaatccttggacagtattatttatattgcattatttaggttagaaatttttgctgacttccatctgagttattagttcaaaagcagaatcatcagcctttatatggaatctctgctggtgctcatcttaggcttagtatcttcttaactgggtttttgttagcagtatagtgtggcattaaatttgagactatctttttaataaattttttaaaaattttgtcagttgtagaataattagatacttgtaaaacaagcaagaagctgttttcactgaggactttctttaattacatttcatataaatttaagagaactgttactagaatattaaaatcacaggttaaagtgagaatgtatttcacataatcaacatacataacatttttaacagcatgctaaagatggaaaaaacctttaccaaccatacatattataggcaaagctttaaaaaaaacaaaacattttgctcttatggatgtgaaagtaatctgtgtaaatatgtatttaaatgaaaatatctattcattatcattgcagaaggagtgtgggtatctggagagggagcattctaaacttgctgctctactttttggattatctacattaatatttctcccattgctgagtatttctgttatactgctggatcatcatacttccataatctgtgacccacttgctctaatggtagagtgggctttaaactgccatctgattaaagttcaggtttcttagttagacttgcctgggtggcttcagaattaggcccacaaatatgaatatggacttgaagatcttactagaacaatattttccccgataaagacacatccataaacatggtcctaaaaagatatgtgtaagttggatttgaaaaatgcaatttaagagttactaggaaaaagggattttaaggaaacattttaagtaatttgtgtgatatcaccagttggtttttcttcagtttcttcatcttgtaaaagaaggatagtaatggctatattatctacctcatgagattctcatgcacataaaattacataattcttaagtcttaaactaccttacgtatattattatttcaattttattgaaataaaacactttttttttttgtgatggagtctcactctgtcacccaggctggagtgcaatggtgtgatctctgctcactgcaacctccgcctcctgggttcaagcaattctcctgcctcagcctcccgagtagctgggactacacatgtgcaccaccacgcccggcttagtcttgtatttttagtagagacagggttttgccatgttggccaggctgatctcaaactcctgagctcaggtgatctgcctgcctcggcctcccaaagtgctgggattacaggcatgagccactgtgcctggcccaaactaaaacacttctaatggacttgtactttggctgggcacggtggctcacacctgtaatccctgcactttgggaggccaaggtgggtggatcatttgaggccaggagttcaagaccagcccaggcaacatggtgaaacctcgtctctactaaaaatgtcataaaattagccggccatggtggcgtgtgcctgtaataccagctacttgggaggctgaggcgggagaatagtttgaacccgggaggcatagtttgcagtgagccgagatcatgccattgcactccagcctgggcgatagagcgagactaagaaaaaaaaaaacaaaacaagaacatgggctttgttgacttttctttgattttgtaagaatcatttacctttgtctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaatcttcatttttcccaattcttactgcctttttacttcctcaagagaaaacccaccttgtgactgccaagtttagggattcatgtgagctgtttggaatgtttgtttgtttgtttgtttgacagagtcttgttctgtcgcccaggctggagtgcagtggcacaatctcagctcactgcaacctctgcctctcaggttcaagcaattctccctgcttcagcatcctgagtagctgggattacaggccaccacgcctggctaatttttctaatttttgtattttttagcagagacggggtttcaccatgttggccaggctgatcttgaactcctgacctcaggtgatctgcctccttcagcctcccaaagtgctgggactgtttagtgtgttctaagccaggggtccccaacccttgggccgctgaccagtaccggttcatgacctgttagaaaccaggccgcacaacaggaggtgagcagcaggccagccagcattactgcctgagctctgcctcctgtaagatcagtggcagcattagattctcatagaagcacaaaccctattgtgaactgcacatgcgcgggaactaggttgcatgttccttatgagaatctaatgcctgatgatctgagatggaacagtctcatcccgaaccccctacccccaccccggtccccatcgtccatggaaaaattgtcttccacaaaaccggtccctgatgccaaaaaggttaggtaccactgttctaagccattgaaatagtgccatcccttctggaaaattgttacccttgtcctggagtgctgtagtcactggtatttcaccaggatgttagggtatttcaccaggatgttagtgagcacatagatattgaatatttcgggcaatcttagaatgtttactgggagagttttaaaagttagccttcccacatccctccaagaatagctgtttctctttgtagctggaatgtcatgttgtactcttgattctcctttgtacctgttcttagccattaaggtgattggtggtcaacttcgtataaaatacaactcaattttaccattgttcttattgatgcacatgaatgtttctctttatgcatatcactgagggaagtatagtagcctttgaaagaaaggccttcttgtagtctcccctggctctggtagcaaggtcaggcaaaagtgttgtttttgcagttgtgactccatggttgtgtttttctttacataactgatgttttaagtcaggaaatatgactttgccaaatgatactgagctatattactggtgagtttgtttggttcctgatttatttcagtaaatctgggttgaatagtttagtagtagatgctggggaagatacaggaaatagtgagtttgagactagaaatgattgagttagacatttaatttaggctttcccaatcaacttacttcataccttttgccctgcttactcatcccagaggtgaggaacaatgagaagaggggtcaggcaaaggccatccctcagaatgtggttacttaggtctgtcgccaaaggcaacctatctactggaaaatttgagctttactgtcttctgcagtatagtgttggaaatgcagtattttaaaaactaaattgttatttatagcagtgaataaaatgtgaactctttaaaaaaagagcagtgttactgtcccagctagcacaatagccacccacatgaatcatctgaacaacctcctcatttctgttttatctacctgaaataggggtcagcggtaggtgatgatgaaagcttgggaaatcatgccatgcattaggcaggagaaatgctgtggtgactctttctgtgttgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatattgtagccactagccagatgtggctatttcaagttaattaaaattaaaatttaaaattcactgaacagacatttctccaaaaaagatttataaatgaccaataaatacacggaaaggtgctcaacatcaagtcattatggaagtgcaaatcaagaccaaatgaaataccacttcatgtgcactaggatggttagaatcaaaaagacaataacaagggttggcagggatgtggagaaattggatctctcgtacgttggtgggaatgtagaatgttgcagccaccttgaaaaacacactggcagttcctcaaaaagttaaatatagagtttccatacagcccaacaattccattcctaggtatgtgcccaagagaattaaaaatgtatatttacacagaaacttatacatgaacattcatagcagcatttcataatagccaaaaggtgaaaacaaccccagtgtccattaatggatgaatggataaacaaaatgtggtagttgcacacaatggaatatcattcaactataaaataaattaagataaagacgcatgtgtatgttcatcacagcactattcataatagcaaaggcatgtaattgacctagatgcctgtcaacagtggactggttaaagaaaatgtggtacatatatactgtgggatactatgcagccataaaaaagaataagattatatcctttgcagtaacatagatggagctggaggccattattctgagtgaagtaacacaggaagagaaaaccaaataccacatgttcttacttataagtaagagataaacattgagcccacacagacacaaagaagggaacagtagacactggggcctacttgagggtggagcattaggatcgaaaaattgtaggatactatgctgattacctgggtgacaaaattatctgtacaccaaacccctgtgatatgcaatttacccatgtaatatgtatcccctgaacctaaaataaaagttggaaagaggaaaaaaaaagatcactttgggaagaattgatagcttaaattattgtgtcatccaatgtatgaacaaggtatatctctattatttgggtattgtttaatttctctcagcagtgttttgtagttttaaaagtacaagtcttgtacatcttttgtcacattcttaaatatttcatatattatgctgtggtaaatctgtttttcatttgaatttctgattgattgttgttagtatatagaaatgtaattgattttttgtatgttactcttatgtcctgcaactttgctagattcacttattctagtagaatgatgtatattgcattggatagtctacatagatgatcatatcatctgtgtataaagacttcctttccccaaaaaaagaaataaagtacagatacatggtgcaacatgcattaacttcaaaaacattatgctgagtaaaagatgccaaacacaaaagaccacatattgtatgatttcatttttaagaaatggcctcagtaggtaaatctgttgatatagacactagattagtatttactagggactgggaggaggagagtgtgggcagtgactactaataggtatggggtttcattctgaggttatgaaaattttaatggaatttaggtagttcttagtgatcaaggcacaactttgtgaatatactaaaaaccaccagattgtatacttaaaaagggtgaattttatggtatgaattatatctcaataaatgttatttttaaaaattcagttccttagttactttagccacatttcagttgctcagtagctacatgtggctagtgactgcatggtagacagtgcagatttagaacgtttccatcatcacagaaagttctgttagacagcactgatctaagagtctcaatctgagaccaaaaaataaaggaagaaaaaccagtctaaaaaacacagggagtggagaacagattatgttctgaagaaatgttactttggggtaattttaccctttgttgccctttgactgttctactaggagtcctcaacatgattttcattttattctcaaaacaaatgcctgtggtaggtactgttatactcatgttttataattgaattatatgagttttaagatatttgtgtagtaagggtagagcaaaatttctaacctaggtacataatctctgttacattgtttacctctgtttatggtatttgattttcttaccaaccatccttcactcccactttgttgctagcccactagagctattttcagtaccctaaatgcacagttctttttgtgccatagcagatgctagccctccttcctccttctgccgtctcccaacactagtatgtgcatgtgcacacatttactggccccacttacctgaaagtgtggtgcacatctctcttcctttgtgaagctatctgataccacagttttaggggctactctctcacctggttaaggttacataatgtcgcaagatataagcaagaatgctgacaggattcttgttgtgacactatgacacattgagcccaattcatagctgctgtgttggtgactctaacagggaagtggtcttctagtccaggcccttggctcccatttatacattatctcctttccattcacagccttctttaatccccacccacactgctacagtacctgactgaactttgcctttctttgcctcttcatatgtttttctgcttaagctttttgaacctgatgagatactgccatgtttttatatttttctgctcataaaacccttaatggtaaaaagatacctgattgaattctgaagtgctttcatggctttgcctgattctgaggtcatattttctaactttatgctaacatcagtttactctctggttttatatggagcatgtactcctgtagcttctgaagaaaggtttaatgggaagcaaattttgagactacatgtagtaggctaaatcatggcccaccaaagatgtacacatcctaattactagaacctgtgagtatgttactttacatggtaaaaggatctttgcagatcttattaaatttaggattttgagatgggggattatcccagaatatttggatggacccagtttaatcacaagggtccttataagaggaaggcaggagggtcaaagtaagtaaaaggagacacgacaatggaatcaaccagagtttggagtgatgcactttgaagatggaggaagagggccacaaaccggggaatgcaggcagcttcaagaacatggaaaagcttctcccctgaagccaacatcttgatttgagatttctgacctctgatcagaactgtaagagaataaatttgtgttgtttaaagccactaagtttgtggtagtttattacaacagtagtaggaaattatgaatacaccatgtataaaaatgtcattatgccctttaacttgattgatagtttatgtagacctaatatatatgtacacatactagtctccatggctccatgctgcagtggacccaggacccaggcccaccatccatggactcaggttccaaacccaccccagcagacttggcctccagactcaccctggcggatccgggctccaggatcatccctggttgtctcagactccaggcctgcccctgcagacccagtcttcaggcctaccttcgtgatcccaggcaccaagcctgcgtccttgaatccaggtgccaggctcattctagcaccaggctagtcccttaagactcaggctcaaggcccagtgcagcaccagattgagctttatggacccaggattcacactggcccctgtgaatacaggctttaggcctgccctgcatgcccagctgacaggcttgacaggcttacctgagtggaccctggcactaggctgttccccatgcacaccaggattgagatccaccctagcaaactcaagccgtaggcctgtcctaatggacccaagtttcaggatagcccacctgaaaactccagcagcaagcccccctgccagacagccctccggaatttctggacaggctgactggtaaaaggcttttcctgccaaagccagtctgtgaagactgcaagtgcctacttcttcttctttttttttttttttctgagacagggtctcactctgttgcccaggctggagtatagtggagtgatcacagctcactgcagccttgacctctcaggctcaagcaataccactgcctcagccaatcctactgcctcagcctcctgagtagctgggaccacaggcaagtgccaacaggcctggctaatatttgtattttttgtagagacaaggtttcttcaagttgcccaagctggtcctcaagcaacccacccgccttggcctctgaagtgctgggattacaggcgtgaaccaccatgcccagccaagtgcctgctttgtaaaatgtgcagacactaatgcaaaactgcaaggatcaccgataatcagggaaacatgacatcaccagaggaacaaaatgaagcaccggtaaccagtcataaagaaatggacatctatgaattgactgataaagaattcaaggccaggtgcagtgtctcgcatctctaatcccaccactttgggaggccaaggtgggtggatcacttgaggtcaggagtttgagaccagcctggccaacatggtgaaacctcatctctactaaaaatacaaaaattagccaggtgtcatggcatgcgcctgtaatcccagctactcgggaggctgaggcaggagaattgcttgaacctgggaggcagaggtcacagtgagccgaggtcatgccactgcactccagcctggctgacagagcaagactccatctcaaaaaaaaaaaaaaaaaaaaaaaagatttcaaaataatcaaataatcatcttaaaagaagttcagtgagttaaaagagaatatagatggacaacaaaatcaggaaaataatacacaaacaatatgagaagttcaacaaggaaacctcaaaaaaaaaaaaaaaaagaaccaaacagaaattctagagctgaagaacacagtgtctgaactgaaaaattccacagaaagcttcaatagtagacttgaagtagaagaaaaaattagtgagctcaaagatggtcatttgaaactacccagttagaggaagaaaaagacaactaaatgaaaaagagtgaagacagcctatgggagttatgaggtaccatcaaacaaagcaataaatgcatatgagatttccagatgaagcagagaaagaaaaaggggaagacagcttaaagaaataatgacagaaaatgtcccaaatctggagacatgaatgaacatccagatccatgaagtccaaagaacctccaactagattaaagagatcttcactgagacactttataatcaaattctcaaaagtcaaagataatttcaaaagcatcaagagaaaagcaaaccatcacctacaaggaaacctctataagactatcagtggatttctcagcagaaactttccaggccaggagagaatgggatgatatattcaaagcgctgaaagaaaaaaaaaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataatactagcagattttaataccccactttcaacaatgcacagaaaatcaataaggaaatagcagatttgtactacactgtaggccaaatggatctaagagtcatctgcagaatatcttatccaacagtagcagaatacgatgttcttttcaagtgtgcatggaccagtctctaggatagatgatatgttaggctacaaaacaagtcttaacaaatttaagaagattgaaatcataccaagtgtttttttctgaccacagtggtatgaaactagaaatcaaaagaaaacggaaaattcctaaatatgtggaaagtagacaacacactcctgaacaaccagtggatcaaagaagaaattgtaaggaaaataaaatcttgaggcaaatgaaaatggaaacacaacataccaaaacttatgggatgccatgaaagcagttcgaagagagaagcttataatgataaatagcaatacatgaagaaaaaagaaagatctcaaatagacaacctaactttacaccttgaggaactagaaaaagaacaaactaagctcgaggccaaaaaaggaaggaaataataaagatcaatgcagaaataaatgaaatagagactagaaaaacaatagaagttatcaacagaactgagttggttttttgaaaagtaaaatcaacaaatctttagctagactgagaaaaagagaagactcaaaattataaataaaagagacattgcaacttaaagagatacaaaggtttataagagactactataaacaattatataccaacaaatttgatagcctagaagaaattgacaaattactaaaaatacagcctatcaagactggatcatgaagaaatagaaaatctgaacagacctataatgagaaaggagattgacttagtaatcaaaaacctcccccaaaagaaactcccagaacctatggcatcagtggcaaattctgtcaaacctgtaaagaggaattaatgccagtccattttaaactcttccaaaaaattgaagagggaatacttccaaactcattttatgaagccagcattaccctgatgctaaagctagacaaggacagtacaagaaaagaaaattacagaaaatacaagaaaaaaattcctgatggatatagatgccaaagtcctcaacaaaatactagcaagccgaattcaactgcatattaaaatcatgcatgcttggtacaacagatatatctgaagagactcttttctctatggttggtttcttcttgatcatcactacctcttagtgtacaggaagctcaaaatattactgtgtgaccttaacaaaataaatttacttctctggtctttaggtttttttcaatgggaaaatgggaaggttggctccattagtttctaaagtccctttgagctctgaaatgagtaattttataatttctaagtgtttaattcatcaactacatgactttaccttttttcttcattacctgtcaaattcacttaaaaactattatcacacttcatttgctttttaataaatttctgacagcatgaatgggagaaaaaaagggactatacagcatgatcaaagaagatttatccctggaatgcaaggatggttcaacatatacaaattgataaatcacattaacagaataaagtacaaaaaccatatgatcatctcaatagatgcagaaaatatgtttgacaaaattcaaaatcttttcatgataaaactctcaagaaattaggtgtagaaagaacataccttaacacaataaaggctgtatatgacaggcccacagctaacatcaacactcaatactgaaaagctgaaagccttttttctaagattaggaagacaaggatatccactctcaccacttatagtcgggataatatgggaagtctgtcctagccagagtacacaagaaaaatgcatccaaatcagaaaggaagaaataaaattttcggtttgcagatgacttaaaattatatatcaaaaactcttaaaactccaccaaaaaaacctgttaaaactaataagcaaattcactaaagtggcagatacagagtcaacctacaaaaattaatagtgggggaggagggagtagggatggttaatggtcaccaaaatatagttagatagaatgaataaaatctagtgtttgatagcacaacagggtgattacagtcaacaataatttattgtacatttgaaaataactagaagagtataattggaatatttgtaacacacagaaatgataagtgcttgaggtaatggatatcccatttaccctgatgtgattattgtgcctctatcaaaatatctcacataccctataaatctctacacctacgtacccataaaaattaaaaattaaaaacaatagcatttgtatgcactagcaatgaactgagaaagaaatcaagaaagtctgatctacaatagaatcaaaaatatataattcatttctaagaggtttttttgttctctcttcttgtatatagcttcaagattttgtttcttatatgctatgtctaatgtcctccaagagaaagagagggaaatggaattataattaacattgtcttttccctatattatctgttttctcttattttcttttttcctgttttttagctttggtacttgtctgtctttcatgttagaggtgtttctcaagcatcttcagctgtttgttgctattaaggaaaagtttattggaaactgtgttcatgactgtggcttgttcagtgatggacctcatgtggtgtgattgagggaaacctggctatttatggggagcctatcagttcttttttcttaagccagtcagcttttctaaataggatttctaaattgaatcttttgtgggagggagtttgggagtaataagctcatgtctagggctggatccttaatcattggctgcaaagacttatttaacccttgttttcagtaaggcatcccatttttgttctcagttatggctggtgttcctgagttcaggggctctgattcaacctctccagagagtaacttaagccctctgctatgtggagaaaaggcagttgccagatgctctggttggagtgagagtatgtgaaaatcttacttctcttttttaaacaatttttcagcatccccccaccacttgctttaaaaaaaaggattattttcttcaaatgtgcccataagctgcaattcctgagcttttaccttctgttcttccagggcactcaggagtgaactggcttacttgcctcaatttagattcccccactgcaggtacttggcacaaagaagaaagatacaatcaagtcagttacctcttttccaaatgcttttcattttaaattttgtgggcctatctcctttgctgtcatcatctccccacgctcttcatcttgttggtttatatcttttctaattcttcagtcttttgatttgtagagggagttagataaatgcttgtatctgatcagttatgtttaaacaaaagcgcctccctcccttgacaccttctctttttcttggacttctgtttcttagactgtttccaccattagaataagagcttgtcaagggcaggaaccagggtatttaatagctccagcatttgtataatgcctggagtatagtaggattattaaataaatgaacatacctttattttcaattatagatttctctgacttgagaaataatttcaaataaaacagtgaagtctctcttacagataagttcggaagctctcctctttcctcgattcttgcttatttttatccacagtgcgtctcgtgaaggaaaagaatggatcattctttcttgatttcctcgttggtaaagtatttggctttaagagctattcaaatgaatgtgcaaagtaagagtaagttgggtgtatttctagcactaagttgttgaggttctagaaaggtagttttgtgccttctagataccatgtctgcctttcctaatgagcctggtatgtatactattctgcctagcataactaggagcaataggatagagaagtgggatataccatttcaaagattcactgatgctgcttagaaacaaaaatctaaatgaaaaccaatgtacataaattagataattcacatataccattagaaattccacttaaagtcagtactgctagaaaccttgtcattaccttgctttaaatgctaagcgctttctgattaattctttttcagtttatttacctgggaggtattcgatctaagcaccagcatccctgcccccacttttatctattaatatttacaggtttttccctctttgaagctccctattgaattctgaatgactttgaacttggaattgctctgggtctgcttttcacctcctttctctacctcccaccccaaccttcactaatttgcttttttttttttttttttttttaatatttgggtggtttcttcttgcattctcttttttctatatgctccatgacagcctggactacatttctgttactcactgctgcatccagtgcttagcacatgctgggccttaagtcactgtttattgaaaagaataaatggattactcgttgaaatttttttaattatgaataacaaaaattagtaatctaactatatattatcaatcttttgctgtcttatcttacaggttttctttctggttttcatactggatagtctctattgacctagcttcaagtttgctgatttttttctactgtcaacttaaacttgctgttgagtccttctagtgaattttttgtcaattatagtacttttcaactcctcagtttctattttttttaagaattctttttctttattgatgttctctatttggtaagtcattatcctcatactttaaaaaacttctttaagtatagtttcctttaattctttgaatatatttataatagctaatttaaagtctttactaagtctaacagctgagccccctcaggaagtttctattggctgctttttttcttctgtatgggccatcttttcctgtttctttgaatgtctcataatttttctgttgttgataactgaacattttagataatatattgtagcaactctggattctgatccactcaggtagtggttattgtttttacttttgtttttccattgcttaatgacttgcctggactaattctacagaggctgtctttgctgaaatgtgtggccactgaagtttgtgctaggattttttgttttgttttaaattcttgtttttatttttaagcctggcttcctagggttttccccttggtcatccaatggttggccacaagttttccttaaacactttgagccaataagccttccatcttttgctgaaggaatctctgtgtgggttggggcatacgttgaaagttcaggcagtttaaaagtctgccttggctttcactttctgcttgtgtagggcctcacagtcagccaggagcagtagataattgggaatctttctggtctctcttgaacatgcatacatgcacagagccctccaaatggatacaaccttccagaacccccaagtatgtcagagctttaagctttctatggctgtctcattccccacatctaccttttacatgttggctagtgtcttgcttacctcaaccagtattgcagacttaagcagctgtgattgtttctaatgattgctattgtttttgacagtgcccctggccatggggctttctcttggagctccatatcaagtcagcttccttcagtggaactgtccacaaagctacaaggccagcgaattgtggtagaagcggacccaaattaaaatgtcacagaccctgctggtcttacctaggatcattagtagctgaggtcctcactccgccattccagaagtcctgccccccacctctgccttaggttttcaatgtgtttttatagctgtttatagttttgtggcttttcatttagtataaatattttctcatgttcttgataactcattataactaatttctactggctctcatcatttgaatgtctcataattgatttggtaatttcccctgttgttggacttcagataatcactggtgtaatttgcctttcccaacaggctctaacctgaatgaggcctgggactgctttgtttactacttcatcctcagtgcctgacacagtaattcttgttaaataaaggtcaccccacaattttttaaatgttataaataacactttgaggtggatcgtactgccaaaactgtattcagatttcagattttttttaagaatggagtttcagaaatggaattgcttggtcaaaggatataggcatttctaaacctcttgacataggttgccagattgatttcttaaaaagtcctatcaaaatagaaccttttggccgggtatggtggctcacacctgtaatctcagcacttcgggaggctgaggcaggtggatcacttgagatcaagagttcgagaccatcctggccaacatggcaaaaccctgtctctactaaaaatacaaaaaatttagctgggtgtggtgacgcgtgcctgtagtcccagctatgcgggaggctgaggcaggagaaccacttgaaccccagaggcagaggttgcagagagccaagaccacgccactgcactccagcctaggtgacagccagactctgtctcgaaaagaaaaaaaagagaacctgttttttcagcagcatccttatctgttgcattgtatatttggcgacatcagatgtgctagttgctcaagttttattgaccttattggccaaaaaaaaaaaaaaaaaaattctcgttgaactattttgtgtctttttttgagacagggtctcagtctgtcacccaggctggagtgcagtggtgcaatcacagctcactgcagcctcaacctcctgggctcaaatgatcctcccatctcagcttctcaagtaactgggactacaggtatgtgccagcagacccagctaattttttgtttgtttgttttagagatggggtctcaccatgttgcccagcctggtcttgaactcctgggctcaagcagtcctcccaccttggcctcccaaagtgctgggattacaggcatgagccaccatgcccagctattttgtgtctcttcgataaccaatgaaagtattagttttcctcatactttttaaaaaaaattctttctataaattggccatttgtttttcccccattttgctcttagttgcctaatgtttttcttgctaatttatgtaaactttatatatcaaagatatttatctattattgtcttttatatatttttaaaatttttcattttgttcctgatgagtttggatgtgcagaaactaaaaatcatacagaagaagcctctttgttcgatatgattggatattacaactggtctgctaaagagggaggagtataaaaaaagtctacagatatctcttcaatattttaacttgaagacaaaatatacattaagtagctaatcctttgatattgtgtgacccttttctttgaataagtctaattgattcgaaacctgctctatatttcttttatatatctcatccaaaatgcatcatcaacgatgtccagttttgatttatttaaaatggggtaatgacttaatgagctgtaatctgagtgcaaaatccttttggatattttatagatccttgctccccccgcccccccacccagtcttttgcagttttgtcacccacatttaattcagtatctcctttatctggtctttgaagccagttcttctcttttgtagtcacattcaattgctgtaacatatatgtaacatataattaagaattataggccggatgcagtgcctaacacttgtaatcccagtactttgggaggccgaggtgggcagatcgcttgaggtcaggagttcgagaccagcttgaccaacatggcaaaattccatctctactaaaaattaaaaaaaaatagctgggtgtggtggcacgcacctgtaataccagctacttgggaggctgaggcatgagagtcacttgaacctgggaggcagaggttgcagtgagccaaggttgcatcactgcactccagcctgagtgacagactgagactgtctcaaaaaaaaaaaaaaagaaattatagtaacacctacacaaccaacataaagaggtacacatttaggaacaaatacaaatagctcttggtatgtagacaacttaatttgtggggttcatgggctcatatgtactacacagtaccctgtcagcattgagcagtcagcatgcagcaggcattcattaggtttctacagagggaatggagaatggatcagtctgtgaaatttgttaagtggggtcaattaagagtgcttctaccatggtcaaaatctaatcagtctttttctttgttgtgattgtttccatgcttagaaagtccttcccttcttgagagttatgtgaaaattcacctacatttttctgtctttcttttgattcatacatttaactctttagttcatctgaaatttattttgttttttagtaagaagtaaggatgtaagcatctaaatagattttccaccttcaaataatgtgctgttttttttttccccagcatagccagtgcattcttcaaaggcaaagatcaaaaatgtaatttctagttttcaacaattagaataggggttgaatgggtctgggtcttgggagtggaaggtcagtatggtccttggggttggggaagggcaggcagagcatagagtggaatttaaaacacacacacacatacacacacacacacacacacacgcatgcacattcacatgataaggagaaaaagataactgagaaattggataataacagagctagtaggaagaggatatagtacaatgaaccctctttagaatgcaggccctttccaaaatgaaaatttgaagggtacttgggctctatttgatgaattatagtgaggtaaagtagtttattaagcatttgaataaacctaaatagttaataagctattgtttattaataaaaggtatgccaacaaggaagtaattatgcaaagttctacagagctgtcaaacttgaaagcatgtttttccccaccgattttgccagtctctactgggaaattatttatgatcattccctcagtcttttgaataagtcaacttctctcagtgcaatcattgctttttcctgggccatagcattaggtcaattagtgaaatattaggcataatactctttaaggctatgaatggccttgaagtactgtatgaaaaatatgagattaatattaagaagctgctatgaagcaaatgttaccagtggaaaattttattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatcaaaaaataaaaaaaaaaagatgttggcatggatttggtgaaaagggaacactcttacactgttggtgggaatgtaaattagtacaaccactatggaaaacagtatggtgattccttaacatctaaatagattttccaccctcagataacgtgcctttttttttttttccaggatagcaactgcattcttcaaagggacagatgaaaaatgtcatttctagttctcaacaattggaatagaggttgaatgggtctgggtcttgggagaggaaggtcagaactaaaagtagatctaccgtttgatccagcagtcccactactaggtatctacccaaaggaaaagaagtcattatacgaaaaagatacttgcacacacgtttatagcagcacaatttgcaattgcaaaaatatggaactagcccaaatgcccatcaatcaatgagtggataaagaaaatgtggggtgtgtttgcgtatatatacacacacacatatatatacatacatatatacatatacatgtatatatacatatatatacacatacatgtatatatacatatatacacatacatatacatatatatgtatatatatacatatattcacatacatatacatatatacgtatatatatacatatattcacatacatatacatatatacacacacatatatacacatatatatacatacatatatatataatggaatactactcagccataaaaaggaatgaaataatggcatttgcagcaaccttgatggaattggagactgctattctaagtgaagtaactcaggaatggaaaaccaaacattgtatgttctcataagtgggagctaaggtatgagaatgcaaaggcataagaatgatatattggactttggggactcaagggaaagtgtgggagggggtgaggaataaaacacattgggtacagtgtacactgcttgggtgatgggtgcatcaaaatctcagaaataaaaaaaaaataaatgaatcaccaaccaccaaccaaccaatatgggagatttgtttcagctggagggccttagtttcttaaagtagttttcttctcttgctctggaaagtactaattccaaggcctcttttctcctcccagttgtaggatattggggattcttactagaaagcgtaggcagagcacatgcagccagtgtccccaagttttttagaccatctggagctacctgtggctgctatgtagcctaaaacttcagaaggccttatgatctattggcagatggctaaactgggatccttgtgtcagggttttcttttatgttatttttaaattccagaatagaagagaaaatgaaatggagaaagaagacattgaaggttgtggtgttttctgtgaagttcaagaagtattgacatttctcagaagagtatgactatagatgatattgttactgtttggggttttttgttggtcatggtggtagtgatggatttttttttttaagagtcacgtttcttcacctagaattagctgaggaaaagtggcatctgtattgatggttttaatagatatgattttattggtggtgccttcagagtagtggcttagagtaattagaaagacatcattgctttgtataggtcttaaaaagattgttaaacttttaattcaatgttggctgagcctgctgtgcctgatacattaaaagaaaaaagtcttatgatttactgaaaagagtaaaatggtcctgatttcagttactcccttctactcatgcacactgtgttgcttactgccctttttaaatccaaggtgattcttcaacctcatacattgttttaacatttcactctatgtctaggacatgtctagaatatttaagtgcctttttcttggaaataatagagatgtatcatacccagttttatttgcttaggtagcagataaagacttcagaaatactcaatatttgagtatttgggttggaatttgacactgtgtgtgtgtgtgtgtgtgtgtgtgtgtgtgtgtgtgtgtgtgtggactcaactagcctaaaagaaagataaatgcctcttagaagctagaggggaaaaacctatgaaaacttagtttgggatgtacctatgatgaagaatttgccctctgatttctcttccatgtggctgattttgaaggttgtatagtattttgtttttatgttttgatacagctgttaattcttgaccattttcctcagaaattggcatttccagattggcaaaatctagtatcattgtaggtagctctttacagataaatttgtacgggagagtatgcaatatattttgaaacttctgtttttgtgtgtacaaatctctaaatcagcccagatggtggccattatggattagtaatagcaagaaagaaagctgttaatatcacagcttctaacatatgtctcctgattgtgggtatatatgcctggtgtcaaagataacgctacagcatacctattacggcttttaaaaagttactaaggcatttctatctgtatcagccaactagaaggatggattagacaacatgatatatgtagtgcttttatctctggcaggtagctaagtctttgaaagaagatatatcttctcatctggccagaatgttttgattttaacttgaaatttcctaacaagagttcttatgtgtttattattgcatgttcttatgtgtttatttttaaaactatcctttagcatttaggcacattaatttatagcacctgtagagcaatcagttgcaatatctgcatatatgccttttattttctgtaattgagatctgtattatatttatataatcagtgtgtaagttactctaaaagttatctagtcaagcttgactttaaagatgtctttgtaacttgttctacattgttactgtttccttcagaaagttaagtttccaagcttctttaagttacattctagacgttccgaggggttccaaagtgttgaaaaggaaattgaagtaagctttggaatatgttaataagcttcaactggaaacatgtatggtagcagctgttttaaaggccgctgatagtgagatgttaattgagtactttttaaaatatattacccaaccttctctaagctctgaagcttcaattacatttatcctaggcactaagacttgaatccaaaggggttacttcactgctcttcttgaggttgggggtcctatgttattcactattgtaacagcaacagattataatgattggtaggcaaccaaatgcttgctgatttaattaaacttgcctagttatttttaccttattgtaaattttggtctatagagctgaagagatttctccccttttctttgaattaagaaaaagccacatatgtgtggtaaactccccttcaccataatgaaactactttttcttcattctttgtaaaatattaacccagtagagtaaaaactgaattcttccatgaatggtggtatttcttctatctggcaaattaaagcaatggagaccattagggtataaccctgaactttttgtgctccctccaccctggtccgttatttctttggtataaaatcagaagaatgaaatcttagtagagttctcgtaccactacacaagacaaggtaaccatgctcttgaaatagatttaattttagatgttgagtgttcctaatgggtggcaaattatttatgctaattgtgaggaataaattacttatagatttattaataatttacacatagtaacttaaggttcaaagtttgttaacacttattttatatatgacattcacatcaactgtatgaggtaactagatttttctttttccatctcataaatgaaaaaaacaggttttttgtgaaaatgcaacttgcccaaagttgtagaattagatttttataaacagatctgagttacttaatatgtgtagaaatctttacttgacaaattttcgacattgtaaggtttgtaattttatctcagaatcctagaattctagagctgagagaaacttaagttgatacaaatggaaaataggttctttattgagtgccaggttaatatcaattgtagctgttgagacttggagttgagacatttttattgacttatttccagtttattggcagagagtgccctaattgattaaccatgcctgaagtagacatggggcaacatatagatgacaaatatgtggcagtcagactcagtaacttgatatagcattttgaaagtacctaatatagctttttacagattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaattaacagcgggaactgcggccactgattgggaagcctaaatacaatgagggtaattggatcccaggatggcaaggaccagtagcacttaattgccaaaggaagggcaggtatggttactgaaatggacagcagagtcaaagcaacaattagaatgaactgactagtacagggtgatttcttttgctccaagcaggcccctggctgttctctggagattctttattgtccattcttctccatggccctatctgaaatgctctttggggagcacatttttcttggggactacacagctttcatagctaacatattactgttgagggtttggagccatgaattattttagagatttaatagctattggctgctgcagggcagttttggggtttccatgacaatatcgtttcgtcaaaaaatgtcgatatttttcttcttgtttttagtaagctccacgggggagaagccacatctagacatagtttcttagcctgaaaattcttctacttactggcctctgtgctctgcccttttctttcagcttttgagttaatagccagctgcctcgaggtaggcaacacccttaatctgatttttgctggctagttttctttcctgtcctgaagggaactcttaaaacagcttggggttgtggtttcatctcctgctaagacagccacttctctgagttactgcttataatcacctcagtttgagagtacaggagctgttgatgtttatagtcctccaaagcttcaaattatgtgactttcagtcgatttaaattgaaggctgcaggcacagaatggctggctcaagttctatttggtctctcctaggactgggctcaaaagctgcaagaggaaaccatcatacatccatatcccgaaaatgtcctacatttccataaactgtagcctcatttggcatatggtattaccaaatgttttgccactacctaacaagagtaaccagctttaagagtcactgtgaattggttagagactgatgggattagttaagactaattttccttaaagtcttttcttttccttgatataggtatattccaagtgttgatgggcagcttggggtttatttactttttagacttataaattgggagaaattaggactaagggaaatgattttttctaaggacatgaacatttataaaagacaaggaaaaagtatgacggaagaaatatgtggatgtaattgccaagaaaggagttcatcagtgatgggtaaatggtcaagaaaaaatggacagtgtgatctctgtgtgatcctgttaatatatattgtgccagccattttcctatttcagccaccaagtgatgcagtttacccagggtctgggttccagtcctcattgagaggaaccatggttaagaagaaagtgaacttacaaccaggagtttatatgttctcccacatttacccttcggatggtatctaatcattttctcctctaaatgaaatgtattacattctcttgtggctgatttctctagtacttatcttatatattcttaaacttacctttatgtaaatgtgctcaatcaattttagtaagacttaaacttcctgagctctaccttttaacagcatcctagactgagagttagtctcaaaagtcaagttctacaaaagaatcctttatgctgtttaacttaatatgttgtagtgttgtgacttctctacctttcagtgtttcttgattaggattcttcaaggtatttcttttgtttttaatcttaaaaaaattaacatgtcaaataagagaataaatagtacctggcctttattagaatcttattttccataatgttttaaatattttcatatcctatgagatatgaagggaagagttatcaaacaataaacttttgaacaccaactatcagccttttactacaccatgaggcttaataatagtaaatagtagttggtttttattgagtgcttattaaataccaggcacagtggtaaacattttatcttatatatattcattttatcctgacaacaatcccaagagataggtggtgttatcttcgctttatggatatatgtaaaccaaggctcagagagttgtaagccacttgcccagggttaccaggctattgagtggtaaagctaggagtctaaggaagttcaactccaaagtccgaactgtgtagctaccttgctataattgtagatggtccctgccatttgggaacttggtttaacagaggaagtaaacacggaaataataaattgaatgatttccctttcttagtttggccatagttgttatgatcatttcataataatcatttctataaatgtaagttggcacatatgaagcacctttggtatgatgtcagaatatcatttttgaagtagtgaactaaaatggcatatcaagtgacccaaaatgtcatgaagctttttggaaacattcactctacgaaatttattgaacaattattatggtccagggtcttctgggcccagagggtacagttgtgaataatatagaagctgtcctttctgtcatggaacttgcaagttagagagggagagacaggttaaataattctacaaacaattgtttaaaattcaatggtggtgagtgctgtgaaggaagccatggaagtgctgcaacagtataaaaagggaactgaacctacttcaagagtaagaatcaagggagtgattcaccttgagtagagctgtctttcaaactccataacatactttaatattttatcagtgagtcttgtaattcttgatcgttattctttctactagtatactgcagtcttgtgctttgtgagcaccaaggggaagagagcttaacttggtctgaggggaaatgaaaacaattcttagatacttaagctaaatcttgaagggacagtagagaggaattagaccaggggaagtatattctaggcagaggaaacagtttgtacaaagtttacacaaaggcattgggggcagatgagaacataatcctttaaagataattatggttagtatagctggatgcggtgtgtgtctagatggtattgagagatgaggctggaaagatagatagaaaatgtgaaatatttatgtaaccaaatctggtttctgtagagttggtctattaacttttccccatatttcagaggatctaagagatatgagattttcttttctcccccatattttaattgttagcattgttaaataaagtgtaaggattggcctaaatagatgtatagtgagatatcttatagttttaaaatgtatgtaatgcagtaattttaagggttgcagtcagatacccaaagcaaggcaattaattagtgaaatacatttggatctcctggctagactgaggcttgagtgttgtagaaatacatattactgcatgtgtataagattgggtctgcctgaagagaaggtttaagtgtggtgttccaggtatattccaatggtgaggcagaatattttgttaatgatcaaaggagaaataagagatcaagtgggaggaaattattaacagtgaaagcaacatgggcagtttgatgtagagcactgagaactatgtaggagacacatggcttgcatctgagctggcctctaccactgaccataggcaagtctctgggtattttggaatctgaatccaaacttcctattgaagtataacatggcatacagaagagtatataaattataagtatgtagcttgatgagcttttacaaactgaacacattcctgtaacagcacccaagtcaagaaactagaatgttaccagaagccctctttgtgctacctgtacttccatttgtttaatctttaaaataggggtaataatgtcttcttcacttttagaagtgctgagaaaatgacaacttgagaagtgccttgatctctctcagtgttgttatacaagtgaaatgagatgctaggaagtaggaccagcttccaaaattgtagaagtacatagagcttacttatagtattattagtaaacctattaaattggggatgcataaggagataactctgaaaaccacaaagcaaaggacaaaacagttgtctaaaatgaatcataaggatgcatgggcatagtatatgtgatgtcttttgttcttataaggtgtcattcttgggattcaggagagcaacttgtgtatttttacctgttcaaaaaatgtgaaactattctcattatttgaggatgctggagaaatggtagcttcctgaaataaaagtaagttctgttttaaaaatagccataagtcttgaattcaccaaatatttctgtttgggtttcaggaggtctgatgctgagtctctttttgttaatctgaatgcttacgaatacttttagaatgggaagtcctccttcatgttcttaatgccattagctaaattgatttttttcaaagtaacaaagtcatcataaatgaaattacatacattagtccccacttatccaaggttttgctttccatggtttgttacgtgtggtcaacagtagttcataaatattacagtagttcaaaaataaagtattttgagaggggggagccacatttttgtaacttattatagtatattgttgtaattattctattttattattagttgttagtctcttactgcacctaatttataaaataaactttgtcataggtatgtatgtatgtatcagaaaaatcatagtatatatgggatttggtgctatccacagtttcaggcatccactgggggtcttggcatgtatcccacgtggataagggtaggggactgctgtactcttgtagtactttttgaaaaagtttcaattttgtttagtgtaataacagattgatgcataccatttcttacacgacactagctgtagtcaccacaataatctgcatttttctatcaggcctatttgctttccaattctccatcatctccctgtacaggtatcttattagatccccttaagatctattctgtcctttacctgtatacagtgaactaagacttttaatttctataaggtaagatcattttattagcatatttttgtctttgatatataaaattatctctgctgagctcaaaagtttagtaaattttttgattgataatttaagaaagtctttaacataggcagtacagttataagggatagacaaatagagcagctttatttataataaacatttggctcttttgcaggatttccagattttaagatacactgaacccagtttatagccttttatccctcacgcccccgacctttccctcccaccagtccccaaagtccattgtatcattcttagaaacattctaagaacttcatgttacagttctgaaaactgttacatttacacttgttgtatttctgaagactttgttacatgtgagttacaggtgaatgaatttgagggaaaaactgacaaaactcagcttgaaaaggaacccacagtgatttctctacaagggtattttttgaatttgtgaataatttattggcagcttgctttgcaaaaaatacacaaaaacctatggaaataaaattttaaaaaaaaagtcaggaaagactgcaaaaaccatgaccttgcacaaaggccattgcaaccgtatacaaaaaaaagaacacttctgttgaggacatctgcccagccttggactggcatcacccttattattgatccttgaagccaaggacaatgacctaaaaacaattatgtaatcttcctcattttatctttgaaaacctttgtcttcctttacttccctaaatacacacatagtttactgtggcacacatattttcattgcaatgccctattcccaaataaataccattttctgtttttttttttttaagaatattttgtgctattatgtgattgatgttggttagtgctattagtgaagaagttggtgctttaaaattgaagcaccagagtctacttatttcgcttaaaacacgtgctaatttttaaaacatatcttcacacctcatgaaaataagaggcattgtgtttaaaatgtatttttttttgtttctttcccattaaaaatttaattgtggtaaaattatataacataaaatttgccattttcaccatttataggtgtacaatttagcggcattcattgcatttacaatgttgtgtagccatcaccactatgtctatacctttgtgctatattaccctacgtagatattatgggaagaaggaaaaattcttcccataatatctacaatggtatagaattgttaaatgatttcttaagatagttttattattttagatctggattaagaaaatcctttggtaaatgttatagttggatctgattggccagaattcaaaccagcaagtaccttattcaatagctgcttttgtaggcacaggtattccagtaccacagggtaatgagtatttcaaacaaaagagggttagagatatgtctaatgtttattgccataccctcaccctctgggctttgatctttctggtggtcttaagttactactatagatttcttccttgctcataatatctatttggcaatgggactgaaatctggtaacttctattgggaacaaaccattcctctccactgtggaaatggctgttgtctcataagtattctccctcctgctcccgactgttaatactaaatctttgggtaaataaagttactcatctgtacaaagagattggagaccagtctaattcccctatttgaaggaagccccagagagttggaactaatagttaagtgatgcatttagaattagaacacacctgttccaatctccaatcagggaagttgattgtcttgtggtggttgaagaaacagagagggacggggtcagcagaaaaacctatgaataaacctccagtgccttatggtttttcctgaagtcagaatttagagcttgacaaaatgaaagtatttatctagttctaacccactctattaaaaatgaggaaactggcgcagagtgactgtaacttaaaaatatataaccagttagttgcaaagctagaactggacacccgtatgtcttgacttttgccctagtgccaaatatatgagagtgtgactctggccctgcctctaatagtttatttgcctacaagatatttagtggaattgtcagtgccacattactgtagaattatttcaaaagaaatatttttgatattctggttttgtatccccttctaaccaattaggaacaagatatttttagtgccagttaatagtgcagtctttcagcagaaaggaatctaaatcaatatgcagtgttaaattcactttaataaatgtgaaaattgtttttaaagtaaccattgattataaagagagatgctttctatacattttggtgggtacatatacagtatttttctcatataagtgaatacttactatatactattttttaaaagcctaaagtcctacagaacataaacatataaggcaactgaaatctgtacaccttctcaatatataaaataagtgaatatttgcttctaatgaaagagataaagattagataacttcaacaggggaccttggcatatgtctgataatagatatgagacagggatagcatattgattaaaaaagtcatggactttggatctggaatttttaggacccggattctcactgaaccagttacttgatctggggctatagccaagttatttaacttctctgaaactcgatttccttatctgtaaaatggggataaatatgctaccttagagagttatgagaattaagtgagttaataccagtacctcttagaaaaatgactggcatatagtaagtactcaatagctgtaataataataataatataccaatacatactaatactaataaagtatctgttactaataattttatcattgctactgttgctcttgttggaagattatggtaaaggtgacatgtgaacagataatccttttatgcttctatggtaagtataggactttttacctgtggatgcttttgactacttggatttaaatacaaatattttaatcataattaaacaactattaatgaaattttttgttaagaaaatatttcccagtccagatggttccactaagccagctccttgatcagttttctgtaccatgcagttaaactattttttccattttcatgtttatgttcctgaaagtatattcattgggattacttttttctgtttaaatactaaaaccaggctttttaaagtatcaaattgtattaatcatggtttccactattttaagtcttcttttgtactggtattgaagtacattttttttttcttcatcattatacactaatgtactaaccaatatagcttttttaaagaagcattgttacacctccctgattatgcttcatttaaaatgcagtcccctacagtcctctccaccaatccccacccccaacctttatattgttcttaacatcactttcttcaataactctggagtgagggagcataaacagtaggttatgggtgaaagtgaaatggccccatagtgctgtttctgatgactagaagagtagcatggctgagtcttgcagtacaccaagatgttctgcatgagaggataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgctaactggactgatcactacaactgtctttattttctgatgattataatgcattttatctactagagttgaggttttagctgagtgatcactttcaaaaagaatgattagtcttgatcaatagtgtattacctatagatgagacttttagcataatgcaatttccttagctggtgttgagatccatttcatctgttcaggaaatgaaagcaggagatatatagtactttggattgtttgtattgcagattagctaaatatttgtgggaaatcagaggtctaaaacatgcttaaaattctagtctgatatctggataaagaaaatgcagtacatatacaccatagaatactatgcagccataaaaaggaacaagatcatgtcatttgcagggtcatgggtggaagccattatcctcagcaaactaatacacgaacagaagaccaaacactgcatgttcttacatataagtgggagctaaacaatgagaacatatgcacatggaggggaacaacacacactcgggcctgtagcaggggagggagagcattaggaaaagtagctaatgcatgctggacttaatacctaggtgatgggttgataggtgcaacaaaccaccatggcacacgtttacctatgtagctaacctgcacgtcctacacatgtaccccagaacttaaaatttttaaaaaaaaatctagtctgttatatggtagtaacagactattagattggtgcaaaagcaattgtggtttttgccattaaaagtaatagcaaaaactggctgggcatggtggctcacgcctgtaatcccagcaattttggaggccaaggtgggcagattgtctgagctcaggagttcgaaaccagcctgggcaacatgctgaaaccccgtctctactaaaatacaaaaaattagctgggcgtggtggtgtgcgcctatagacccagccactcaggaggctgaggcaggaagaattgcttgaacccaggaggcggaggttgcagtgagccgagatcgtgccactgcactccagccttggcaacagagcgagactctgtctccaaaaaaaaaaaaaaaaaaaaaggaacaacaaaaactgcaattacttttgcactaacctaatacaatctcattaagcacagtaactctgcattgtgtattgtagaagcaccagaattttcttacaaatgaaatgataatggctttttgatgtgttccctagaaagaattgtggtccatcatcttttcagtagatatactttttgttatttagtgctttaggtgttatttgctaatattacagccaaaataaaataggaatgtgcagtggaactcatttcttctctgttatagctggctctttgaaagttgtttgaggaaactctaattacctacagccctgcaatgaattgcacaacagatgtactgttttaaagtcttgattcttgcatgcatttttcaccttttacttcagttttagtctttgatttggaacacttaatgttaagcagtataaatgtgtctttctaggtgacataattggattctctctctctctctcttttttttttttttttttttttttgtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgaaattttgcattttaggtaatattcaaatgacatcatttcagtccttttgtttgttattacttctgacaaaagcacttttctgtaagcttttcatttattttactcttcagctatgaagtatttgattatatgaggacacaggaagaaataaggagtagcccatggccccagctaatgtgttagacatcttatacaggattagtgctagattagttccatgaggtgatttgaactgtcaaggtcatcaaaaacaaggtaagtctgagaaactgtcacagccaagaggagctgaaggagaatgatgactaaatgtaatctggtatgctggatgggatcctggagcagaaaaagggcatttaggtaaaaactaaggaaatccaaataaagaatggacttgagttaatgctgatgtatcaatattggtccattaattattacaagtgtaccattctaatggaagatgttagtaataggggaactggattcagggtatatggaagtctctgtactatctttgtaatttttttgataatccaaaactattctgaaaaataaagtttattcttttaaaagaacagcatcataagaggtgatctttctgtttagatgacctcttggtagtaaggtataagataactgtttaataaaagcacaaggagcataggtaggggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatactttcctggacttttgtagtgctattgttttagtttgttctatttctttttaaggttaccttctgtttatggcaagtgatactgtttcctgttaatgaaagtggtataataaaaaaaaattacctaagtaaagagagtcaacttaaaggagatttcctgaagaaagagattcagattatgagaagaaattggtatgagagagattctccattgctggcttgaagatggaaagggttgtggcacaaactgagtggcccctggctgatagccaacaaggaaatggaccttcagtcctacagctgccaacaacttgaatgaggttggaagtggattcttccctacaacctgtagataagagcccagcccaagtaacttcttgatttcagcattgtgagaccctacgcaaacaacctagctgagacacctggactcctgacctacagaaactgttagataataaatgtgtgttttaagccggtaaatttgtagtgatttgttgtgcaacagtaaaaaactaatacagcctataggctttgttcttactgctcttcaaacagagaccatgccctcctccaccaccaccaccagttcccctaacactgtgtctcagttcttttagtggttacccttaaaatagcaacatgtattatatacttaccaagtataatattagtcagtctcattagccttatctcagccaatgcaaggatcttaggacattttaactttattccttcctgatttacatgttaatgtctatcatatattttaattctttctgtacttgaaaactcagcaagacattattattacttacatagtcagtttacttaggttcattcacatatttatgttttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggtacatcatcattctgttgtcttctgatttctattgtccactgtcaaactgtcacttctttggagatactctgtccttttattacctctggttattttcaggtttttgctttgtctttatttttctgtagtgtgtctaggtataaatttcttttgtttatcctgccatgattcagtggaatcttgaatttgtagatagacacatctgatgaaaattctataaaaagatcctatgaaaaattctcagccatttcctcatagattttctctaactcattctctctttcctctcctgctgggaccccagttgacatacattaaatcttctcattattttatctaagtttcttaccctaattctgtgtttttcacctttttgtttttctccatggtgtattctggatcatttattttgacctatatttctcttcattaattttattcagctttcagttcctctgaaacccatccattgagttttaaattttggcttttttttttttttttttttttttgagacagagtcttacttcatcacccaggctggaatgcagtggcgtgatctcggctcactgcaacctctgcctcccgggttcaagcaattcctgtacctcagcctcctgagtaactgggagtacaggcgcgcgccactgcacccagctaatttttatattttcagtagaggcatggattcaccatgttggccaggctggtctcgaactcctgacttcaagttatcaacctaccttggcctcccagatcgctgggattgcaggcgtgagtcactgctcccagcctgtattttttgtttgtttcaatacctcatgtattttgtcttttatttttgctaattctaagatacggtatcttttcttgagagcatctgcctaccaggtttaggggataggacagctcatggccaggactgctttaatccaactttaagatttaaaattccatggaccaccagataaaagagagccaggctccaagtccatgcgaggccaggtttgttttgggttcacctccaccctaggcgtagcctttcagaacaaaacagaataaggtggaggttggtttatcaaatggactgtaggtattcactcactcattcattcctatgaggccctatgagtcctatggggcagttgcttcccaggggtggagaattaccctccaggcaaaagtagttttatgtgattgaactcactactgtgagttccctttttctcctagatcatcaactggcaaaatttaagtaccttataagatatttgatactttcaaaaaatgatggagaggggaaggttttattttgtttttcagtaggaaggctagtgtaggttatctatttcatgatcattggaagcagaactttctctggcttcttccttgtttctttgttttggtagtgaaagggtacccttttggtatggcagacatgatactttttaggggagaagtaatgaagaagtacttgtacaatagcagatgagccccagaagaagtctcctgttgttcgtatgcgccagacacaaccctttatgccttgttatttcctgtactgctgagaaccctctaaagtagctattatctccatttcacagtataaataaagtagccccagagagattgaataactggcctctcattatagttagtaatgagtaatgggcacatccaggatgcagccccaggtcttttgagctatcaagcccttgctctgtttatgttgtggtggctttgattcaaagaggaaaaagttaaagtctatcaggggctaaagtgcattctctcaaggggactttcccataattatggggtgtttgcagctggagtgtctgtacgtccaggttgcctgggcttgccaaaaggaagttgtaagttcattgtaaaatattaatgtgcagggattcttggttaatagaataaattattttttctttaaaaagttcaatggtctctcagtggagctgcctaaaaaaattcatgttaaaacatcttgttcttttacatgatctcaagccatctgtttgcatctatgatagatattcttcatgcttcattccctatttcttccctactggttgatataaagtaaaggattccattaaaggacagggcatagtaattgcatatgtcttgatttttaatgaattgataaacagtcattggccaaaatgtttctaattttatgatctcatcctgtgtctatttactggtttaaatttgtgctcaaaattgtcagtcttcagtccagcattaattaggaaccatgaagttttctttgtcatctgagtcttaattgagtttatatacctctaacttcacaaaaaggtgatcatgtggataatataagtagtttatttccatttaatgatattttctggtggtaagctattatagtgattgagtgtcatatttcatcttgccagatcatacaaactgaaatttttaagcaaactattaaaacatccaaaccaacaaaaagcttgaatgaattctgagctaatcattgtcacagctgattttgtaaacctttaggttgaaaagctttctgaattttaggagctatgtttggttcagttctctgctattacaaaatactattttgtaaaatgcctcaagtttataaggcctattttaaatcattaaagtatttaagaacagatgttattacatggtaaaagttaaaaagtctgctttctgagtcttagttatggtatcactggaaggattttgaattagcaatcaatgtctctagtaaaacaattatttttgaagatgtgtttaaaaaatagttaacatgttatatgattttacagcttttgtttacctttcagtaattggcattgacaaattaacatttttatttgtattagataagtgaaaatctcccccaaggtatcagagagctatagcttcaaattaacttaaatgtaactatgctaatgtaagtgtctggaagatggcacccatgtttgtgcatcctaaaatggatttatctatttgtccatccagtagcatttactgggtcttcattagcacagtgtcaggcacagttctatatgttagagactcaggatggataagagaaaattcctgccttcagagaactagtttagtcaactggtaggtcctttattaagagctgaccttcagttatgcataaccgtgtttgtgtagaatactgtaacccctaactttcctatttgtgtaatatggaaggccaagtgatgaaattgttattaaaaacaccaattcccaaacagtgtgccatgattttaatatgctaaatagactgtggcaatgttagatttcctttttgactcaggaagactgtgagggtgagtgagtgagtgagtgaggatgtatatgtgtgtgcatgaggagacaacagagcagaacccctagtctagtatgctttggttagttggtattcatcaaaccccaaaagattgagaaacatcgttgtttgagaccctaaaattctaaggtagagtgaggaatcatggaagactacattatggacctgatgagtttaatgcctgccatttttaactgagtatgttgatcataaaagaactgtagcttgtactctcattttaaatagactggactccttctgtaatagggattgtcaacaacaacaataaaaagaatggactcctaatgctagccagaataaaataggttgaaaatgcacagatttccatttccagaacaaaaaggcgtagacttacttttcactgccccttccttcctctataaatataactaaatgtcctggaaattattcaactgacagcaataaagggattctgaaagttgggaagaaagcagagtagcttggaacctcaggactagaagtttgaggacaatgagtataagttcactgggttttcttttaatctcccattttctcctagactgggtgctggagagacctacaacccagaatcaccagtgggcaaagaaagcagaacaaaaagcctgctttctctggctagaagaccaggaaagggaaagcccaacaaagacctaagtgggagtgctcatccccactgtttcacagtgggtcccggtgggcactctgatctgtccccattatggccccagttgctgcgggagcagcaaagcccctggccctcccacccactgctctacaactggggccatgacgggtggtttgttctgccaactacggtgaagaccagaccatttcagcccctgtggtctgctctgtagacagcagcagcaacagcaaagcccaggctatactgcctctgctcccaactggccccagcaggtggtctcttctgtagggagcagtaagcagctgcagccgcagcgaagccatgtgtcttcctgccctccacctcatggcttaaggagacccaggccccagtaggtgaccccctccccctcaaggtttcccagcaatagcaagtggccctgggaagtaccttttatccctgcagatggcatcagcagggattgagtgggagtcccaacatcaccagaagaatgaagcacaccaaaatagcattgtgagggctcagaaaactaaactgtcattggaactgaagcccacaaaagtagtctagaacctacacactaaacctaagcagggtgaccaccctgctaaaatagaagatcctgtcatcaagtcttctaacaataagcaaaacatccagggtacaattgaaaaccacttgtcatagcaagcaccacaaaatatctaggatacaatatgaatgaaaaaagacatcaactgatgccaatacccagttgaatcagatatgggaatttgataaggtttttaattcagctgtcatgcaatttatccaacagtcagttgcaaattttcttgaaacaaatgaaaagatagaagatctcaggaaagtagagccaagagcatttcctaatgaactggaatgtcagagaaaaaaaaagggtcaagaatggtgccataatttttggctaagctatcagaaggaaatacggagttgccttcaactgagatagcaagaggagagattagaaagctcagttcactcagatgttttgggggatctgattgccctttctcttgtcttccatgctctcttgtgtgccttattgattagcaggagtcattacggagactgagaggttggtccatccatgggaaactcgttaaaagtgagcattactaacttgcatactcacatgcagggagtttggtttcttacctaacttgaaaaattccccaagtgtttagatgtttgattttactatgtcgcctaaacagttacatccactatactcttattttcaaattttttcccctaaagcaattattttccagatcatctactttatgtctttagacctagaaactgattactacaattatgattcaaaacctattttctgctgccctgcactgagctgagtaattgggtgtaaatggttatttcgtttgcatgctttgcctttgtgttaagtgttttttggttaaaagaccagaggttgcattattgcctgctgaatatgcttatattaacaattgtaaaaaagtaaattacttttgggagtattaatgaataggcacttaaattgcatagttaaatcttttccatcctttactaagcaaacaattggattaccccccataagaatttaattgacaatttccatgccacatttgggtagggaatatttcttacagacaaaagttgtttgaaatcagaaggttcttagccatttcaatttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaagaggagtgttcctgtttagggcagaccctgctaggccttcctgtttgttatctccacaagatattgtaccttaagagcttgcctttagcactttttctttttcctttctgggcttcttacagtctttctatggggatgtttccagcagccccttggggaggggtttggggatatattcatgttttctggggctctgtcctctgtatcctgaagtgctgtcattagcagcaatggcttcaattacctctcattcactcatgctacctagggagtatagaggttaagaatttagatttcaaagttccatatgtttaggctccagtcctagctctaacatccactaactgtttgaccacagacaacctcttagcctcagtttcctaatctataaaatgaggctgatattatattagctatgatgacaaataaattatgataaataacaagaatctatgtaaacttcttagcagcatgcttgctgctgacatgttatattataaatgacagttgttgatgtcttcattatcatgacccgttccttgaactttatactcctatctatatgccctctataaatctctgcctggatattccatggaaaccaatattttccaaacatagccatgtgcttcgtttctttctcagccttctatcagttctttctcttgtaattcctttctcatttggtggtatcattcacccagtaactgttgccagaaatttgtaagttttcttacaactcaaccccaaccaccatctagctaatcattcactgtgttatcttgtgaatttattttcttaagtatctctctgtcgcctttactttatcacctcttgcttgggctaatgcaataacttcctgagtggctcccacccactccacaacgtctctcactctctgtcatagtgatctttggtccccttttccttttccagccacttctcaccctccagtttttcatgctagcagtaccaaatagcttgaagtgcccagcacacacttttttttttttttttttttttttctgagacagagccttgctctgttgcccaggctggagtgcagtggcatgatctctgctcactgcaacctccgccttctgggttcaagcagttcccctgccttagcctcccaagtagccgggattacaggcatgcaccaccatgcctggctaatttttgtatttttagtagagacagggtttcaccatgttggccaggctggtctcgaactcctggcctcaagtaatctgcccgccttggcctctcaaagtgctggagttacaggcatgagccactgcaccctgccagggcccaaaacaccatgccctgtgttttgacttggctgtaggccattgcacaggctattacttacctctggaatcctctcctttccctgcttagcccaacaaactcctattcattgtttcaagccctccaggatgtccgtgtgtcatagaggccttctctcagtaccatgctatccacagatttttaaaactcatagtgttatactatttctatactttataactttacactaacattatatataacgtatgtatacatacataatgtatatatgtatgtgtataatgtatatatacatatgtatacatacatatatagtatatatagtatatatacatataatgtatatatactatatattatatattatactatatatactgtatgtatattatactatatattatatgtatatattgtatgtatatatacatatatacaatatatacattatatatacatatatacatgtaatatatatacattatatatgtgtatatatacatgtaatatatatacattatatatgtgtatatatacacgcacacacatatgtcaacagcagcctactagattggaagttccctgaggacaagaattgctttattaatctttttcttgtttattctttatattctttgtcttattttcattggggaaatgaggtaaataagataaaatgtgcaaatgtcaatagaatttttaaaatcttagtgctttaatatttatttttgatttagctaagattgcctaaagtgtgtaaccaagtcagaattctcacttttgtaaggtttatcttcatatgttttcttgcttgtttctttccatgcatgtctaatctccttcttcacatttcttatgttataaaaatcttttttcttctctattaatagttcttgatatatcctccatcaagtgtgagctaacaaagacctagaatcgatgtccctctacattggctctaaccccagcccttctcacacacgcatgcacacgcacacacgcacacaaacacacacacacaccaatcaaattttccagaacctttgctttgagcagaaattgccttatgtgactggcagtcctctcataaaagtagtaaatgatgagtgtattatagttagactcagaccagaagatggtgtgctacatgaaatctaaagtgaagtctactaaacttcactgaagtatcaaggtgtgacagaggtactaattatgtcaatataagtactgagttagtaaatgctagtcttaactctgaattgttcagctttgacaggtgagctagatttgttccattagcttattggagattcattgctagctgtttcaaataaacctcccccttctattttcaaggaatgatctgaatcatactcctttgtcaagtctttaattgttaacatttaggcaacagttcctgagacttttattttaataattttccactccgtgtgtgttttttgcggtagcaatgagtaggaaaacttttttttctttggtttaatcactgtacctaaagcaactcagcttggtgaatgtatgtaagcatatgtgttggagctggggatgggtaccagaagtgttaaaaagtgtcaggacagcatctctgttcccttactgctatcacattgattaccgcgataatcattgtcacagctgattttgtaaacctttaggttgaaaagctttcacaaagctatcacaaagcacaggaagacaaggaaaggatttattgatgaaattatatgcataagctcttctttagtggcaatgactacactaaatagtgttgaaatagggaacagaccatcgttatctttaatcggtagagtttttatataaatttatatatgtctataattttcaagattttattcttactgctaatgttgtcatttatagttattttattttagctttgtttcctttttgcctacccaccatctatgtccctcaattcttaacgtcagaactgtataaaaagtagtaggaagacacagatttagaaaatgggtagagaaatatctagaagcaccatgatttctcaaaattttatgtacttacataaaattgcgttacttaataaatgtatcaatggcttattcatttctagtttgtcatttttcttatatcattcaccagatattttttgagggcctaatgtgtactgggtactcattaagtttatattttaatatgaatacacacacataaatataacattacatattataagtatatatgaaataatataaatacatgtatgtgtgtatatatgtgaatacacacagtttattctcattattcatggtagttgtgttctataaagttaccatgaatgctgaatgaaccaatactgaaccattgctcctaggggaagtacaaggttgggttccttcaaacctctggtcacaacattttcatcaaccgatcaatacataaccttgttttatgtgtgcttctgtttaaagatactgcatgtaatatatactgttgattcattaacattgaactcacagccaacattgttataactcatgcctgaaggaagcttccctaactcacgtattttccccataaggcacatcacagccttcttgtgcttaggaacactagacagtcccttcagcactatgcttggtgaccatattaaacagcaaaatcaccaagaaaaagcgcaaaatgcaaaaaaatgctctaaatagactttgaaaagatgacttgttgatggcatgagagctgaaacaagaaggcagagcatcatcttgtttgccctcagctggcatcatgcacattgggtgattcaaatttttcaccattacatgcgtgcctgtaaacgactgaaagtgccatgactgttgatttgggggttataagtgaattttaccaagtaggcgaatttacagacatgcactctgcaatgtaatgaggatcagctgtatatcaactttgtgtgtgtgtgttgtgtatatatgtgtgtaaaaatttgttcttggccttcactttccccatctttgtcttttcttttttaaatcattcacggttttcctacgtatcttgtggtacattgcacaattcattataaatgtaatggggcttctaggcctgttgttatggacagaaatttcattgcgtttattaaaggtttcctgagacatgatgtgtttttgtttatagacctctcatagggtgaaaatttaacatgtaactccaaagtttatatgtagcaactcaaagtattattttaaatttattacaattagatataaaattacaactgacaattcatattgactttattatgtttgagatgcagtgtttttttgaagtgccttcaaaagccctttgtgctcctccccaatcacaaccccctccccctcaaaccactatcctgccttttatattaatctttttaaattctctttatagctttaccccctatgtttgtatctctaaggagtatattgtttaatcttttagaactgagtagcaaacacaaacttagctgggtaaagaaaggacaatattactactattgtatgaagacttaggagaagagaagctgaacaagctcttgttcatagtctggcttcagatgttctgagagtggttaggagcccattctgggaagtcggttggcaaggtcatgcacaaataaatcccgagacaaggggctcttcacaggcaggacatttccgctgtagtgcaggatagggggaggtactgagcacccagcaggaatttggtggggggcactggctgccctgcatttcctgctcttcagctccctgatgcctgcctcccattctcaggaataggtcaaagcaggcactgctgtagggtgaaattaagagtcctctgctagtctaggcagcagagaaggacagaaatctcctcagccaattgtcaggaaaagaaaaacagaagaatctggatgcagctcacctacctattctgttttcaggttaaaaaggtggcccgtggcagtggaaaactgatggctctcagtctggattggttgtcctctgtgcctgaggcacagctgtcagcctgagatttcccttccttgcattcctggggattcccttcatctctcttctgtgttggatctcctatttgctgtctccaggcatgctttttattggtctattcttgttttagcaaacacgtcctacaataatttcttcagaaagtgtgcatggcaagtaatttattgaccttttttgtctgaaaatgtccttatggttaatgatggtctggctggatgttgaattcaagattagaaatcattttccttcatgattatgatggtgttgctctattgtcttctagcgttggcattgagagatccaaagctattctgggtgaattgtgtcatccttcctcgctgcacatctttacccccacttctggaaacctgacaatctccttgtccacagtgattttaaatttcacagcagtgtgtgtatggacatgggtcatttattttgctgagtacttggtgggtccttttaatttgagctccttatgatttaaattctgggaagttttcttggattattcccttaatttcttccccttcattttctttgttatttatgctctgcttttcccaaattatcggccaacgcttctattgataaatttctctgtgtgtttttcaagggctcttttgttttctgaaagttctggtttttgtttcacaattgtgatatctttctgaggatattaatggtaatttgaagtcttattgtgtagtgtgtttcctctaagttgctctttttgtttgtttttggttctatcttccaaattagagactcttcagatgtcttaggagccttggttgttgtatacttatgattagaaatagagcaatgattctcaactgggggcaatttgaaccttccgtaccccaggaggatatttggcaatatctggaggactttttggtggttaaagctgcagggggtgctatgctactagtatctagtaagtagaggctagggatgttgctgaacatcctacaatgcataggacatccctgcacaacaaaaaattatctagctcaaaatgttaatagtgctgatattggaaaccctataatagagggcctcaaagctgattaagagagctccgaaggtgcaggtggaacgtgttgactttgggttttgctggaggatgatctagttgagtagtttggagaacctcttcattatctttaggtcttttcttctgagctagtcagatattcaatagaaaagtctttcatctcctgccttaagggtaaagatctggcttccaatattccccctgttagtcaaaaagggactcgggctgtctgcgttcagtgtatatgtgaccacataatacccttgcttttcatataatacccacttcctcaacagccttgtgtttccagttgtgagaccctacagtttggttttttttttttttttttgagacggagtcttgctctgtcacccaggctggagtgcagtggtgcgatcttggctcactgcaagttccgcctcccgggttcataccattctcctgcctcagcctcctgagtagctgggactacaggcgcccgccaccaagcccagctactttttttcagagaccctatgttttatttactctttccagataattaacctgttgggatgagggagcggcagttatccatggtatggagtacaggagaccacctagggctctaactgcttctctaacacatttcattcaaaccttgttactttaactctaccctctcttcacttccagttccagagttatctggaacccattcatgagtttcttggggattctacagtatagatgggtttggttctgaactttccttattatctctttgcagttcagcttttccaggtctgccaagtcaattaccactctccatctgctttcttggattccaaatttaattattactattatctcctctcttgtactcccaatcctttttaaaaacccctttggtatcattgtagtggagtttggatagggaaataaattagatacattgtgctcaatctatcccatgatcctggaaaccaacatgctgtattctagcataatttcatttaattctagtcttattttggtatatttacctttgttatcagaattatttcctagacttaggttttcttcacataaatgaaaactagaggatattagtctgtgtctgcatagggacataattgaattcttttcaaaaccttaggggatattgtagtgatatattcacttctaacatattctggtttaatttacctttttgcttaaaaacatagactgctgtaagcagccatctgcctcaagtagaaccttgttttaccatcccaatcaatattcagaatttgtaaagagttgaataaagaatatatatttcattaaatctgaaatgctgtcaattatctttttccatttttaatacggtcataattagtggaaatatgagaaagatagttgtttatgatgacggcttataactatctctaccagtattttcccccacataaatattcaagaattgactgtaccttagatttaaaattttaagggtgatttcaaacatcaataaaatgtacaggccagactgaaacctatacctcctgaatttttgctgttccctaaactgtcatccaagcataagtaataagtgtaatatagtaggtgtgttacactactttatcactcctccctttttaagatgggaaaccaagccaaattttaaattttttatcagtttctgctgagtttccagttaatgggttaaatcgcaaaaacctcaaaacgtattttagtatctttttagggtgttaaatttggtttaccattgttaaccccctggatgtcattgacggacagacccttaaaatgctttacttgtaacctgtcttcaggtcttcagtagttcatagatataattattttctttgcctcgtactataaaattaaagaattggggatttgatttgatttttattcacagatttttaaaagtttgtgttttgttgtctaagtattctcttttctccctagctctattaattttattgttactaaaagaaaaggggggagaagatatgctttcttcctcacctttgttcaagcaggaaaaagtaaagaattgactcgattgaccatgaacaatcaaccccacatacagatgttgggaagtttccaaaaagatacagtgaattgaagcagactattcaaatgtatcataaatagagtcccaagggtttatgtgtggacaaaaaccaattacatgaagcatttcctgaaattgcttgctattgtcaggataagtaatcagaagtaagacatccaggttgagaatgaaaacgtttgtccctcagtttgtaatattgtcttctcacagaggaaaatctttgaacagttttgagggattatcaaaaggatcctctttctgtagagttttgaaagatatattattaccatttcttttcctcccaggttagcttttttaggttgcttgaaaagagagatttgaagctgtggtatagttgatgtcctcatgatgtcatcttggataaatgtttaagtctaagattaaatttagtagttcgtcctgtagttgaaagaagaaaaactttaaggccagcagtatcacaagtgtagtactgtaaatgaagaacttttctctatctgctaattgagcacatgcatctaggtgtactgtttgtacctgtaataagcgaatgaaggtggtttttttgtttgtttgccttctccccaggagggggaaaatacacgcatgtatacatgtacacatgtatttaatgaccaccatattaaccttcaaataaaccaatcacattgctattgcattctgtattttatagtcaattcacacacacacaaatctatatttggattatcttaactgagttcagatatttcttttataactggtaaccacagggaaccgtgtgtgtgtgtgtgtgtgtgtgtgtgtgtgtgtgtgtgtgtgtgtgtgcgcgcgcccgcgcgcgcgcgcatgttccctggaccagggtatgggcatctttaaatcatctcagctgattcaactgtgaggtctgggtcagcaaatagctagaccagtggctgtgctcatagaaattacttcctttcctctagtaatttcaaacaattctaatttgaagtttgaggaaaattaaggatttctctgtgatttcaggtgaaactggagagggttggagaccaaaccacgcaggcctttctctttgtaaagtgtttgttcaagtcttttgcccagattttattggagtgtgttttttttcttattgtatttacaagttacttatatattttggttcttgacttggactgtatattgcaaatactttctctctctctggtgttttaaacagggatatcatatcagattttcattttttaaatatcattacaagaatgaatgggagaaacaagtttttcagtggttctagtagaagatggtaggatgtgggacatggagagaagaggacaggttcaagagatatttgagataaactcagtaggatttgttagtgatgattaggtaaatggtgggtaagatgagagggaagtgtcaagaatggcttgggtttctggttcataagaataccaccattactatggacttcacttattttgtttaagatgttgataatctatatagaattgtacagtcattatttgccttgagcataagactactatttagaatttttaaaaaattactgcaaattgcaaatttattggtcatttttatggttttggtaatcttttaaaattatctcatgaattatagaaaaatatgttggaagttatattacttaaattttattttgaaaactgtgttcaatttggagtctaaagtagaatggcaaacattatctatattatatagataatgaaacagtaagacattaatgggaaataggaacttaagagaatcaatgaattaaaattgactttttgttttataggggtcccttcagtgttgtacgacgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattgttataaataattaaaataaatattaatagcttctttttcaacccaaaattatcaataccagagttttgacttatctcattgttgtaccaaattctaaatctccccaggctaaagacattctttcgggaaacaattacttaccttctcattggctgaggttgtttattgacagatttcttcagccagatctcttgagctacagactcagaatgccaagctgaacctgtctcttgtcacttggtcagggagtcaaattccaaatttacaaaaggggaaagtacttagtatatagttcatatacctggtattaagtcctgtcttcatttaatataatatatgggagtctgttgctgaagttatagctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccctagccttatgggacctatgttttaatagtctccaaccattgtttataacatggtttttattaggaaaacaatgtgtaataaattcgaagtaaatcatttacaaattaattttttttgagatggggtctctctcttgcccaggccagagtgcagtggtgcaatcatggctcattgcagcctcgacctccttgggctcaggttatcctcccacctcagccgcctgaatagctgggactacaggcatgcgccaccacacacagctaattttttgtattttttgtagagatgaggttttgccatattgttcaggctgatctcaaactcctgagctcaagtgatctacccacctcggcctcccaaagtgttgggattacaggcatgagcctccactcccagcccacaaatttacttttgaaatgaaatgtgttgatttgttgcagaccacctgtacgttttaatattttaaattctcattgctctaatgaagatgagatattataattggtgaggctaaagatgagacatttcataacagatgagatatttttgaatatctgttctctacttttgccatcaaaatcataatttttattttatagggcttcttaacttgcaggttgccgactattcaataatcccttgaaatagtaagcagaattatgtttatttttttagagagtccatagctcttattagattcctaaaaaggcatattattcctaaatgatttagaatttctcctttcacatgtatgaaaaaatgaaattcatgcttatgaacatgagatgaataagaagtttctactaaatcaaaactggatgaatttatattaggatatgacttctgattgggggattttttatacttacatatacagcttccattaatgaatttcctagattattatcttgaacttttaattaatatactttttgtctcttactctactgagccactaatttagagtttttgtcttaaaaatagatatcaaaattaattcagacaaattataataaggaaactaaaggaaagtaagatgtatagaattggaaactaaattatcaaagttctgagttcttgataggactcaattctttatggtttattataaaagtccaaaattaactgtttttatttgggagtattataaattgtgttctagaaagagtatattttgggctccagtttgcttagtcttcaagaatgtctcattctaaagtcccagatagtaggtgatatcagtgaaattgaagaagtaaggaccttgacagttctcacttttcatttaaaaaaaagagaaaactgacagaaatgtcagaatcaactttttcagggctctggaaattgaccaaaggcttacagctatccaggaataatttattcaagaaaactgactgattcttagtaacaacagtgaacttcatagcattgtataataatttgtcccattcacatccccctttcttccagttctgtagtaaccttgaaaacaaacagttcacaatcacgatgaaaaccagcaacttgacagccatcaaaggaggctgaatggggatggagctcctctaaggccgcattcccataatattgtcatttttttacttgtctggtagttccctggaagacttgtcttagtacatttgtgtttctataaaggaatacctgagagtgggtaatttatgaagaaaagaggtttatttggctcatggttctacaggctgtacaagaagcatgacaccagcatctgcttctggtgagggcttcaggaaacttccagtcctggtggaaggggaaggggaaccagtgtgtacagagatcacctggcaagagaggaagcaagagagagatgggaggtactaggttgtttttaacaaccagttctcatgataactaacagagtgagaactcacttgttactgccaggatggcaccaaggcattcatgagggatccacccccctgactcagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggggataccatcaagcataccaacatatgcataatgagaatttcaaaaggaatggagagaaaggagtagaaagaatatttgaagaaataatagtccaaaacttcttaaatttgatgaaaacataaatctacacaaccaataagttcagcaaactccaagtaggataaatgcaaaaacaaaccataatcaagttgtcaaaagctacagacaaggggagtatcttgaaaatagcaagggagaactgaatcatcacatacaagggatctataaaaatattaacagcagatttctttcaaaaaccaaggatactgaaaggcaacaggataacattcaaagtgctgaaagaaaaataatatctaccaagaattctttatccagcaaaaccatacttcaaacatgtaggataaatgaagatattgtcagataaagaaaaacggatagaatttgtcactagcttccttgtcctacaaggaatactaaacgtagttatttatgctaaaaggaaaacttatttttttaatttttaatgtttatgggtacatagtaggtatatatatttataggtcacatgaaatattttgatacaggcatgcaatcacatcaggataaatgaggtattcatcacttcaaacatttaacctttgtgttacaaacaatccagttatattctttcagttattttaaaatgtacaattaaattattaaattatttttgactgtagtcatcctgttgtgctagcaaatactaggtcttattcattctttctattttttgtacccattaaccatccctactttccccaacccctactagccccccgcccccccaactaccctttccagcctctggtaaccactcttctacctgtatcctcctgacttcaattattttaatatttagctcctacaaataagttaaaacatgcaatgtttgtcttcttgtgcctggctcatctcatttaacataatgacctccagtcctatccatgttgttgcaaatgacaggatctcattcttccttatgactgaatagtaccccattgtgtatatgtaccacattttctttatctattcatctgttgatggacacttaggttgattccaagtcttggctattgtgaatagtgctgcagtaaacatgggagtgcagatacctcttcaatattctgatttcctttcttttgggtatatacctaggagtgggattgctggattgtatgatggctctatttttagttttttgaggaacctccaaactgttctccatagtagttgtactaatttacattctcaccaacagcgtacgagggttaccttttctctacatccttgccagcatttgtcactgcctaacttttagataaaagccattctaagcatagtaaaaggaagtgtagtaaaaggaatgacaagaaatcaaagtagaacaccataaaatatctatttaacacaaaaggaggcagtattggaggaatacaggaaaaaaaagacagatagaaaaccagtagtaaaattagaaacataaattgtaccttgtcagtaataatattaaatataaatgaattaaacactccaattacaaggcagagattggcaacatggatgaaaaacaggtgagatggtatctcatgtcgttttttgctgtctggaagagacatacttcagatttaaaaaatacatataagttgaaagtaaatgagtagaaaatgatatactatgcaaatagtaaccaaaagagctctgaagtggctattactaatatcagatgaaatagactttaataattaaatcagaaatttaatagtcaaacaaattgttactaaagaaggacattttataacaatagcagcattaatccatcaagaagatttagcaattataaacacatatgcacctaagaacaaagctccaaaatacatgaaacagaaaaaggcagaattggagggagaaatagagaattcagcaataataattggagacttcaatacctgacttaataatggattcaacaactaaacagaagatcattaaagaaagagaaggtagatttgggcaacactagaaaccaactagacctaacagacatctgtagaacactccactcaacaacaggagactatacattcttttcaagtacacatagaacattatctaggatagactgtgcattagcccatcaaatatgtctccatcaattttaaaatatctgaaatcatacaaagtatcttctctggccacaatggaatggaatcagaaatcaataacggaagcaaatttgggaaattcacaaagatgtggaaattaacatagtagccagtgggtcaaagaagaaattacaagaatactttaaaaatactctgagatgaatgaaaacaaaaatataacttaccaatatttatgagatgcagcaaaagcagtgattagggggaagtttattattgtaaatgcctatattgaaaagtaagaaagagctcaaatcaataatttaacctttcactttaagaaactggaaaagaaaactaaacttgacaggcagaaataaggaagtaataaggattataggagacatagagactagaaaaacaatggaagaagtcaataaaaccaaaagttgtttctttgaaaaggtaaaaataaaattgagtaggctttaaactgaccaataaaaagagacaactcaaagtaataaaatccataataaaggaagggacattactactgaccttataaaaatgaaaaggattataagagaatatgctgaaaaattgtatgccacttaattagatagcctagattaaatgagctaattcctagaaagaggcaaactaccaaaactgactcaagaagaaatagaagatctaagtaaacctgtaataagaaatagactgatatgtactcaaaattttcccataaagaaaagcccaggcccagatagcttaatggtgaattctactacatgtttatagaattcatataattccttcacacatatttctgaaaaataagagagggaacacttctcaactttttgtataaggcctgcaataccctgataccaaaaccagacaaagatattgtaagaaaggaccaatatcccttatgaatgtaaacacacacattctcaagaaaatactatcaaactgagtttagcaatttaaaaaatgttctgtagttcttcagaaagttaaatctaaggttatatgacccagccattttactcctagacatatgcctaagagaaatgaaacatatatccagataaaatcttgtatatgaatgttcatagcagcattattcataatagctggaagatagaacccaaatgtctaccaactgatgaatttataaactaaatatggtatatccatacaatggaatgattttttcaaccataaaaaggaatgacatactgatataagctacaacatgaatgaatcttgaatatattgtgctaagtgaaagaagcaagtcacacgagattacatatgttctattcatgtgaaatttccagaataggcaaatctatcagaaggaagtaaattagtggttgcccagggtatggagaaagatgagatggggagtgtctggtaatgggtatgggatttcttttcgaagtgattaaatgttcaaaatttgaacacagtaatggttgcatgactgtgaatatactaaaatccattaaattgtatactttgtggacaaattgtatgataagttaattgtacctgaataaggattttttaagtaccacgagtaagtagaattataacagaaattcaagcttgtttaaacatttaaaaatcaacgtcatacaccttattaatagaaaaatgaacaacagtccacatgatcatctcagcagacaaaaagcatttaacaaaattcaaccccctttcatgataaaaacactcaacaacctacaaatagaagggaatttctttaaccttttaaaagacatctaggaaaaaccaaagtctaactttatatttaatgttgtaagataatgctttcctccgaagatcaggaataagataagagtatctgttctcaacatgtttattcaacattgtactggaaattttagccaaggcagttatgcaagaaatagaaataaaagcatccagattgaaaaggaagacttaaaatgccctctattggcatataacattatcatgtatatatgaaaatccaaagaaattcacaaaaagacttagatgtaataagtgagcttagcaaggttgcaggatacaagataaatatacaaaaaccaattgtatttgtatacacaagcagtgaaaaatctaaaaatgaagttaagaaagcaattccatttaccacagcatcaaaaagaataaaatacttaggaagatatttaaccaaggaagtgcaaggctaataaatggaaaactatattgttgagaaaaattaaggaagtcctaagtaaatggtaagatctctcgtgtttgcctactagaagacttaatattaaagtgaaaatatttcccaaattgatctatagattcagtgctatctctatcaaaatccctactggcgctttttgcaaaaattgacaaactaatctaaaaatttacatggaaaagcaaggtaccccgagtagccttaacaatcctgaaaaacaatggacaaagttggagtactcacatttttcaacttcagaattttttttttttttttcctggagacagagtttcactcttgtcacccaggctggagtgcaatctcggctcactgcaaccttcgcctcctgggttcaagtgattcttgtgcctcagcctcccaagtatctgggattacaggtgtgtgccaccacacctggctattttttttgtattattagtagagatggggtttcaccatgttggccaggctggtcttaaactcctgacctcagatgatctgcccacctcgcctcccagggtgctgagattatagccatgagccactgcgcctggcccagaattttctataaagctacattaatacacatagtgtaaccctggcataaggatagacatatagattgatgaaattgaattaacaatccagtagtaaatccatatatttacagtcaaataattttcaactgtggtgccaagacagttcaatggagaaagaatagtttcttcaaaacagtggtattgggacaactggaggctgacatgcaaaagtttgaaggtggacctctaccctacaccatatacaaaaattaactcaaagtagatcaaagatctaaatgtatgagttaacaccatgcaattttaaaagaaaacataggcataaatctttgtgaccttggattaagtagtggtttcttcattattacacctaaagcacaagcaaccaaagaaaaaaatagataatgggattcatcataatttaaaatttttatgcttcagtagacactatcaagaaagtaaaaagaggctaggcgtggtggctcatgcccataagctcagtactttggaaggccaaggcatgcagatcacttgaggtcgagttcaagaccagcctggccaacatggcaaaaccctgtctctactaaaaatacaaaaattagccaggggtggtggtgcatgcctgtaatccaagcttcccagctactcaggaggctgagacatgagaatttcctgaactcaagaggcagaggttgcagtgagccaagatcatgccactgcagtccagcctgggtgacagagcgagactgtcccccccacccaaaaaaaaaaaaaaaacaaaaaggaaaaagataatacacagcattgggggaactatttgcaaatcatatatttgataatctagtatctcagatatacaaagaactcttgaaaatcaacaataaacaaaaacagataacctgattaaaatgataatggatttgaatagacatttcttcaaataatatttacaaatggtcaataaacacatgaaaagatattcagtgtcattggcttttaggaaaatggaaatccaaaccataatgagataccacttcacacctactaaaatggctgtagtaaaaaaacaaaacaaaaaacaacagcatgtgttggcaaggatttggagaatttggaaccatcataaattgctattgggaatacaaaatgatgtaaccgctgttgaaaagcttggcagttcctcaaaagttgaacttagagcaccctatgacctagcaattctcatcctaggtatatacccaaaagcattgaaaacatatgtacacacgaaaactggtacatgaatagtcattgcagcattatttgtagcaggcaaatgtggaaacaaaccaaatggtcatcaactgatgaatgggtaaacaaaacgaatattacatacaatagaagatttattgttcaaccttaaaaaggaattaaaggtatgcaaaactggttcaacatttgaaaatcaattaatgtaatccatcacgtcaacaagctaaagaagaaaaattatttgatcatattagtagatggagaaaaggcagttgacaaaatctaacaccctcaacttgataaagaagtctacaaaaaaaaccctacagctaacatcttacttaatggtgagaaactgatgtttttcccctaaaattgggaatgaggccaggatgttcctgttccctactcctgttcaacatcctaccagaaacccttgctaatgcaataagacatgataaggaaatgaaagctatacagattggggggaaagaagtaaacctgtctttgttctgagatgacatgattgtctatgtagaaagtcccaaagaatcaacaacaacaacaaactcctggaacaaataagggattatagcaggttgcaggttacaaggttaacatataaaagtctatcgctttcttacatgccagcaatgtgcaagtggaatttgaaatttaaaatataacacattatattaacaccaaaaaattgaactgcttatgtataagcataacaaaatatatacaagatacatacaaaggaaatttctaaactttgatgaaagaaatcaaaaaagatctaaataaatagatactccacgtttgtggataagaagactcaatgttgttaagaatcagttcttaccaacttgatctgtagattcagtgcaatcccaagcataatttcaggaagttactttgtggatattgacaaattgatctaaagtttatatggaaaggcaaaagattcagaatagacaccatattattgaagaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaaaaaaaagactcctagaactagtgagtgcgtttgtcaaggatatgagataaacatacgaaaaatcagttatttctctatactcgcaaagaacacctggaaaccacagttaaaaacatagtaccatttgcagttgcttaaaataaaatgaaatgcttaggtataaatcccacaaaacatatacaaaccttgtatggtgaaaactacagaactctgatgaaagaagttaaagatctaaataaatgaagagatgtactctgttcagggattggaagactcaacatagtaaatatataatttctccccaaatctatctctagatttgacccaatttcaattaaaatcctaggaagattttttatggatatagaaggcttatcctaaaatatttctggaaaggaaaaagaataagaatagctaaaacaattttgaaaaactatgataaagtgggaggaatcattctacccactatatagatttatatagctataggaattaatatagagtagtactggcagagagatagacacgtagcttgatggaacagattagattacccataagtacccccacacaagtacagccaaatagtttttgagaaagattcaaactcaattcaatgaagaaagagtaatttttttctacaaatggtggtggagcaattggacatccataggccaaaaatgaacctcaatttaaacctcatgccctataaaaaattaactcaaaatagatcatagatttaaatataaaacataaagctacatagcttttttttttgagacagagtctcgctctgtcgcccaggctggagttcagtggcgcgatcttggctcactggaacctcccatcccgggttcaagtgattcttgtgcctcagcctcctgagtagctagctgggactacaggcacacaccaccatgcccggctaattatttgcatttttagtagagacggggtttcaccatgttggccaggctggtctcaaactcctgacctcaggtgatccacctgccttggcctcccaaagtgctgggattactggcatgagccaccatgcccagccaagatacatacttttgaaagaaaatgtaccctaatatcattaggacatggagggagatgaagaattcttagacatgacactaaatgcacaattcgtagatgaaaaaagaaaaacaaaaaacctcaacagtaaaaaataaaacaaatagtccaattggatagtggttaaaagacatgaacatttttcccaaaaagggttatacaggttctaaacaattacatgaaaatatgttcaacatcattatccattagggaaatgcaaattaaagccacaataagatatcgctccacacttaatagaacagctacaataaaaaggtgaggccaggggcagtggttcaaacctgtaattccaccactttcacaggctgaagcgggaggattgcttgagcccaggagttcaagaccagtctgtgcaacatagggagaccctgtctcttaaaaaaaataagtaacaatatgacaataccatattctggcaaggatgcagagaactggatctttcatatatctggtgtgaatataaagtggtacagtcactccagaaaagagttaggcagcttctttaaaatactaaaacatacatttgccatacaacccagcaagtgtactcctgggaaatgtacatcctaaggaaatgaaaacttatgttcacagtaagacctgtaatcaagtttttatagcagctatactcgtcatagctaaaatttggaaagtaccaaaatatcctacaatgggttaatggttaaacgaattgtgatacatctataccatggaatcctactgagcaataaaaatgaaaaatctactgatgcatgcaactacttggatagatctcaagaaattctacttcgttaaaaaaatctcttaattgtcgtgtactgtatgatttcctttatataagtttcaaagtgataaaattatagaactggagaacagattagtgattgtcaggtgtgggacactgcaaagtttaggtgaggattgtgagatgggtgagtgggtgtgactagaaagggttagcacttggggtttttgtgggggattattatgtagcagttctgtatctctgttttggtggtgactacttgaatttacacatggcgataaaattgaatagctgtgcacatagacacatgagtgcatgtaaaactattgaaatcgaaataaagtctgttggttgtatcaatagtcagtttcctggttttgatattgtactactgttatatgctactatgggggaaaatgggttaaaggtacacaaaatctctgtactacttttgcaactttctgttaatgtacaattattttaaaattttaaaaaattgtaaggtttcccttatgaactgtatgctcttccatgaaagagataattagcccacaaatatttaggagtataggtaaaagcattttaactacaggttttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaatgagagtcaattttaaatacgtctgtttcttaatgattaattttgctgtattatgacaagcatttctggataactatttacaatgagatacaaatattacaaatgtaaagtttatacttgtcttgctaatcagatcctgctattctgtgaaaaactgctgatgaatctctaaacctaagacaatttatagtgattatgcttgagatcaactgcatgggaaaagaaaacttacttctttcatcttgttttttgccttttaaaaaatagtgtagattacctacttctgaaagtatgtggctatttgttaactaaaatgactcatacttgttcaatataattctaggtgtaaacatggcttgatattacatgtaacatgttggccataatccccaatatcaacgttttatttgtaaatgtctcttaacctgaatttctcatcttatatgacttcagtatgtagatgaggaggctcatgtttatataatagagctctcaaagttcattggctcatatattcaatttttcttagtatcatcttaatgttacattcgggaaatatagcaatatgaaaaaaatgtgagatgagtttctctactcattttttattctgaaataaagcagcttttaaaaaatgtttttccaggccaggtacagtggccaggcatggtggctcatgcctgtaatcccagcactttgggaggccaaggtgagtggatcacctgaggtcaggtgttcaagaccagcctggccaacatggtgaaaccctgtctttactaaaaatatttatttttaatgtttttcctctactataagtggaatttgtgtttcacaagttaaaaatgatttttatcattgttttctctttttctatacaaatagctacctattttctttcaaatctgcattttgctagcttttacattatgtgacgtagagaattccttaggaagctgtgggaatagaaaatagataaagacaggaatttggtgggttgacataacccttgatatatgggctacagtagctggaaaattcagtctgtacactaggtacaagatgaattttggagtatacttgctaattaaaatttgagtctgaagaattagatgggggtgttcttagatgtattgaataagttactgttatcccatctatatgaataacctttggaaataacctaagaagtgtcttttgttaagtttgctctgtaagaaatttgtattacacaattaaataatacatgtcagatagaaaatataataaattctaacttagcagacagtttattcaaaagaattatcgcaagggggagaaactattgcaatagggagtggggtctattttaatagaacactctcaccataagatctatgagtatctcaagggttaggcaaaaaatatttttcttttatgggaggaataaacaagactagaaagaacttggtgggaggaagtgggaaggcctgggggaaggagagaagcgtaaccagtttgattaacaggcaacttcaaattgggtacaagagctcctaattgttcacaaaaacttctatacaatatcaatcacgaatagttttaagggaaccacttttcaaattcttacttctatatatactcttcgtaaagttgatatgcttaagaaaatgtctgtaatggacatagaagttctcctttcttatatcccctttcacaaatttttcttctctcattttactattgtccttcctcctacccatccagaatcttaattgtggtgcgttacaagatctgttgtaatatgtatcaaaatctccagggcgccaaacaaaaggacagtttgaaaattggcatcagtgttgagaaagtgaatgactctgaaagaccaataacatactttttcaagttagatctattcttgctttgctttcaacaaaattgatggatgaccttatcaatttgtaagttgatggattattaagagtaatttttgtggctcactcctgtaatcccaacacttggggaggcagaggtgggcagatcacctgagcctaagagttcaagaccaccctgggcacaacatggcaaaaccccatctctacaaaaaatacaaaaaattagctgggcatggtggcatgtgcctgtagtcccaactacctgggaggctgaggtgggaggatcgcctgagcccaggaagtcgaggctgcagtgagctgtgattgtgccactgcactccagcctgggcgacagagtaagatcctgcctcaaaaaaaagcataatttttattaagtcattataattcatggtgtataactcaaaaagagattgctttaacagaactccatctattcccgtatacttggtttttttcaaataggtttattgagatataattcacacaccataaaacactcctttaagttgtataattcagtggattttagtatattcagagttgtgcaactgtcattgctacctattttcagaacattttcatctcccccaaaagaaaccctataccttttcatagacacccactattttcccccctcccagcctctggcaattaccagtctactttctatttctatggatttgccttttttggacattttgtataaatggaaccatagaatatgtgttgcatctggcttctttcgccttacatattttcaaggttcatccatgtagtagcaggtatcagtactttattccttcttatgactgaatagtattccattgtgtagatatatatcgattcattagttgatgtacatttgggttgtatcagttttttagctgttatatataatcttgatatgaatattcatgtgtagttaagcctcgttattcaaggattctttatttaaaaattcacctacttgataatatttataacccccaaactcatactcttggcgtcacgcacagacaggtgcaaagtgacaacaagtttgaatcattcaacatgcacattcccagctaaggtcggacaacgcaacactcttctatcttgttgtttgggctctcataccataaatgagttcccttttctatgtctacttaattccatattttttcacatttttgtgttttttgctggtgattttgcttcttaaagtggccccaaagcatagtgttgagtgctgtctagtattcctaagtgtgagaaggctgtgatgtgccttacagagaaaataaatgtattagacaagtgtcattcaggcatgagttatagggctgttggccatgggttcagtgttaataaatcaacaatatatatgaaataacatgtctttaaactgaaatacacatgtgataaggttatatattgatctgtggacaaatatggtgcaaccagagattcacagtaacctgtattttccctaaggaacagtgtttctgtgtttcctcagtcagtgtttgtgttgactttatagaatataagtactgcaaataatgaagatcgactgtatatggtttcatgtaaacatacgttttcagttctcttgggtgtatacccaggaatagaattgctaggtcatatgataacattgcttgttttgtgaacaaggtttctcagcgttcacatctataaaagtgaaaataggaatagaatttgtgttgagccctgtcttattctaccacatgcaagaaaatgagatccttgttggactggtgtggaactggccccatgacacacaggaatgtcaccttttgtgacacttccatagacataacttccaaggacccctgaagagacatgcccaagtggaagaaatcaccacattcaggaaagtccaaagctgttcaattgtaattttcctagagtagattgttttctttgttattataccagctttccaccatctgtctcactttcctctttcccagttcctagatggccgctttatgggattgaatctagagagtttaagccttacatagaaagttgatgagcctacaagtgggttaaagcttagtgtttttttttttaggtttcgtgttttttaaaaaagcattttcatatgaactgttgcttttttatttatttatttatttatttattttgagacggagtcttactctgtcacccaagctggagtgcagtggcacgatctcagctcgctgcaacctatgtctcctgggttcaagcgattctcctgcctcagcctcccaagtagctgggattacaggcgtgcaccacaatgcccagctaatttttttgtatttttagtagagacagggtttcaccatcttggccaagctggtcttgaactcctgacctcaggtgatcagcccgcctcggcctcccaaagtgctgggattacaggcatgagccaccacgcccagctgaactgttgctttataatatctcaattgtttacttcttcaatagcatgaataatttactatataattaaaagattttagtgatagtacatcaaaaagagtagtatctgcaaacagaagcagttttgtgcttgtttgtagtaaagactctatctataactgagtcagtaagcatattctcctttttaattactgccatgtactaatcaaacactatttaaaatgccaggcatgttgctaggtgctgttcatatctgttgtcttatcttcagagaaaccctgcaaaaaaatactttatctacattttgcaactgaagattaaagaagttaaataacttttggattgatgcacaggaagtggtagagccaggtgaatccaagttggtctgtcttttggactgcaaaagctgtatttttcccacatctgaagctgttagccctcaccctttatatcctagtgcccagctactttatgtgtcctgcacccctaaacccaaaagcggtatgtgtgtgaagtgaaggtagagagttttgtttttctggatttgttttttcacagctttactctgaccacctagaaccatgcctggcacaatataggtaatacttattgagtgaatgaaggaatgccacgtaagttttgtgaatttactgaggagtctcgggatggtgcaataagagaacagtgtgacagttgataaacaaaggaaggtttctgctttttggcaaagattacatctgtaaaaggtaaataggctgagtaacactttcatggtcaggactacaaagctgggctataaaaacacattattctaatccatgtttatctatcacttcttttgtttttttttttttttttttggcagagtctcgctctgtcgcccaggctggagtgcagtggcgcgatctcggctcactgcaagctccgcctcctgggttcacgccatactcctgcctcagcctcctgagtagctgggactacaggcacccgccaccacgcccggctaattttttgtatttttagtagagacggggtttcaccgagttagccaggatggtctcgatctactgacttcatgatccgcccaccttggcctcccaaagtgctgggattacaggcgtgagccaccgcacccggccatctatcacttcttacctggctggcacgctagtttatccaaactactttattgtacacgcttgttgtacagcttgctattaatataatgaggtcatataattagttatggtagtagatggtgacccttctcaaactatgaggaagatgtttaggtatcctcaaagtaaattctgcagtgatcccagagacagattaggaagtctcagagatggacaaaagacttgaaaggtatttcagaggctgggcacagtggctcatatctttaattccaacactttgggaggccgaggcaggaggatcatttgcgtccaggagttcaagaccagcctgggcaacatagtgagacccgatctctacaaaaaataaaaaaattagccaggcatggtgatgtgtgcctgtagtcctagctgcttgggagggtaaggtgggaggattgcttgagcctgggaggctgaggctgcagtgagccgtgattgcaccactgcactcagcctgggcaacagagtgagaccctgtctcaaaacaaaacaaaaaaaaagatatttcagaaaaaaaatgtatccacatgagcagtaaacaaggcacaactccattagtcatcagagaaatgcaaattaaaaccagataccactgcattcctaacaggatggctaaaaaatgaaaatgacagttgtaaagtggcagtgagaatgaagagccaccagaactcttactgctaatagggatgcaaattagtttaaccactttgataaactgtttgggaatatctaccaaagctgacatatatatatatatatatatatatatatatatatatatatatatatatatatatatatatcttgtgacctagcatttgcatccctgggtatatacccaacagcaatgtcttaacatatgttcacccccacccccccaaaaaaaaaaaaaacaaaaacatgtacaagaattcttttagcagaattcttcataatagccctaaattagaaacaacccaaatgtccaacagtggcggaatgacataaataaataccactgtattcatacagtggagcacaacaaagcaatgagaatggatggaactttgttacacaaaaaacacagatgaatctcacaagcataatgataagtgaaagaagccgggcttaaaaaactaccaactctatgattccatttatataaagtacaaaaacagtgtaactaatatatgaagtttgaggtcaaagtagtggttaccggtgggggaaggtagtgaatgggaggggacatgatgggagctacggaggtgctggtcatgttctgtttcttgatctggatgctggttgagttcactgaaaattcatcaagctgtacatttatgatatttgtaggaaggataggtatacattgtccgaagggaaagagtggagcagttttattttgtcagctcatgtggtctggcataaagatctgtctgggctatttaaatatttatattttgcataatggggatctgacttgttcacaaaagtattcattcagtcttggggagaaaagggtgatgacatacctgttctgtgccaaatgctaagtactgggatatgtaaaaatagaaagaaaacatagatatctttaaatctaataatccagacataagattctcttcctcagtagtaaatgctaaagagacagagtgactccatgtacaggtgaatctgctttgttatccttattggttactttaaaaataatgacagaaggcattggtgcaaaatgtatctaaagttacaacgtaagtgccatttctaaagcgtttgggagaaaattccactagtctatttgaactggccttgtgttgtctgtggtgtttggctttctcttgggtagcttaaatttcctccccatcagtatagtagattttatctattttgtttactcttcagaaataactgccaggggatttttaagactactgattgaggaatgattgccaaattacccatttttaagtgtaaagtcagtaagcaatgccaggtttctgaggagcttcaccaatttgtctctataatgtgtagtatttttttaacagttttaatatatgaatgaaaatactaccaagtttctcctggatccccacttttgttcattcagtgattttttttactgagctttggaaatgaaccttttgtctttttagtatgatcctctcccctcatgtcgtttgaaaatacccatctcttgcacgagactaagaacaatgctgtcctgttgagttcttataaaatccaaagaaaatttaagtactaagtggatgatagttaaagggtttacagcttttcttacagatccatcaaagtgggaaaatcatgagaagagttggagtcagacatgccagacattccaaatctgtcctgtacaatgtgaccttaagtagttccataaacctcagctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaagtaaatgcattacattgtatttttaaaacattttttgccttaataaactgctagcatttcagttaagaggagttaataacagtttcaccaatgcacattgaaaacgatgggttccattaaatagtcaataattattaaaattaagccaagaataatgaaagggatacaattacactaaagtgatatttatgtcttataaagatttctcttaaatgaaaattgacaattattagactagccatacacaaaatctggtattttaaaactaatcttggctgggcgtggtggctcacacctgtaatcccagcactttgggaagtcgaggtgggcagatcacttgaggtcaggagttcgagaccagcccggccaaccaacatggtgaagccctgtctttaccaacaaatacaaaacttagccaggcatggtggcatggacctgtagtcccagctactcaggaggctaaggtgtgagaattgcttgaacccaggaggcagaattgcagtgagccaagatggcaccactgcactccagcctgggcagcagagtgagaccctgtctcaaaaacaaaacaaaacaaaacaaaaaactaaaccaagggccaaagcagtatggtgacagggaaatattttatattttcccttagagacttcagagtgctgactcaccccttccacctaccatgtgaggacgcagtgataacacaccattgattaatgtctaagaatatattgaggaaaatactctatcaggctaacagggaaactggcacagttttgtttccactatattttattggttagagaagtcacagagccacctggttggaaggagaaaggatgtagatcccacctctggatgggagagatgacaaaaaaatttctggccatctttaatctgccacatcaattaattttaaacttaaactttgttgccttaatgtttgagtgagattgtagtagttgatgctactccattccgaggcagtactaaaatcctaccagaggatccaatgtcctcattaagtcccaattcaggatacatatgacagcagtgaataatttgtcactgtgaataggagactaaaataaggacataccatgttgcacaattacagactatttgaaatccagtctggcactgtttgttaaaacagaattttaatatttttgtaatcaaaagatagggaaattatttcaggcaggctgtttttataatttcgttttggcattcttctcttaagaatgaataataatataaggaaacaggtagtgattgccttttgaactataaagtgcttttcatttttagtaagaggttttatgtctataaaattatctgaaaagacaggtcatctgctaaccagtggtagagtatccactgcaaggctcaggactcctgaaacacatcataaaattgtcatgtaaggaaattcttggagctgagtgcagagctagtttgatttcatcataataggcagatattgatggattaactttgagtatttcatgaaataaaacatactttgctgtttttggtttataatacattttaaaacgtttgagtctgaaacaaaaattgtgaagctgatatttgtctttcctttcattctatatgtgaccagtttaatttttgtgattcggggcaatcaaagtatttgctgggtatctagagtgaatattttatcactttagataatctaatctaaaagcccagtaataacagttttggttatttttttcacaggtggggtagtatatcaaacagggtccagttaggagacagaaaccaaacagtaatttaatgtgtttcttttgactttttaaaaatttttgttggtacagagtaggagtatatatttatggggtacgtgagatgttttgatataggcatgcaatgtgtattaatcacatcctgtaaaatggggtatctgttccctcaagcatttatcctttatgttacaaaaaacccaaaaatactcttgcagttatttttaagtgtaccattaaattattatctgctgtagtcaccctgttgtaatatcgaatactaggtctttttcaatagtaatttaatttgaacatgcaaagtttagtataaggaattattgccaaggggttggggtaattggctagtaaaagttagagaactgtgaaaaatacaggcataaggaacagctgctattccaacggctgagatagaatgctcaaggaagaggtttggccttcctcctggcagcactaagatctgaaccttgttgaagaaaatatggccatgactcaccggatcacagtgaggttcactgagacaccatgctagtgggactcattggaaatctgccctctggagtccaggggaagccatccttagggacagaactctgaacatgcagcaagctcactgaggggctgctggaggaagccagtaacaaggagagtaccttgccagcagcgctctgctgtaaaggcacctgaagggggttccaagagaagctgcacatggaaagatgcatgctgctggccactgtgcactgcagataaactgcacacactgcaggagcctgatgagaaaaacactggaactgggacaacagaaccctttctcctccagtgcccctccagtgcccttagtggacaaagcttaatgttgtgccagttggaaaaatattcacagtcaatctccagtagtgcagagcaggcaatgaagtgtggatttggagctgacagacaatagattgataagtggcatgaggagtggagagattgtgtatatgacagtgagtatagttttgatgacatgtatcaagcaacctcattcattatacttggcaatgattttatttcattttgcttttttttccccctcctttaaggagattcattcaatacaacttagtggtatagggcttaaggaaggaaatgcccacgtttttgcttcatatgactagttggatagtggtgctacttattttattcaaatggatactatcaaagggtcagggagaataaatgagtttttgacatcttgcatctcagtaacttttgaaatataaatgttgatcagttaaatattttagtctaaaatttaggaccacaatctgaacaaaagagaaaagatttgaaaatcttcatcgttttggtaatagacgaaacttcggaaatacctgtgattgcttaaagaaagtatattaagaggccacaatgaaaaaaaatgatcatgaggaaccatttttggtcatgaaaaatggtcatgaggaatgatcctgacgaacacctaaatttaaagaaaggatggaaagagacagaggaaaccaggagggggaaagagaagtacaagaattattatcagagaatgctgtcatagacgctgagatcaaaaagattttctgtgttgtcaaatgctataaagaagccaaatgagggaacaactgtaatgtctatggaatttggcaacatggaaaccagtgtgaactttggccagagcaatttcggtattgcactggggacaaaaacaagattgtagtaggcagaggaaggaatggggagtgaggaagcagggaaaataaatataggataattttcaaatggctagactgagaagaggagagagaaacagtcatagatgcaggggcatgtggaggcaggggtagcgattaaaatgggaaggattccagtatctttttttttttttccttttttgccagaagagagagctaagaggaaagaaaagggtgcactgatggactgagatcttcgataggcagcaggtggagggtgggcccctcttccatcaagaccaaaagaaagtcaaggtactgatagagctaggcctgcaggcaggagaaggaaccagaggatgtccctcagctgatggcctgattttcagcaggtgggaggcagagccacctgctgagagtaggcatggtggtagagagtagagagataagagagttagtaatagcaggttaagagagataagagacattgctaggctgcctcaaggcccctccccccacccccgctgaggctaaatgcaaggaatttgtagcagcgcttatcaacatgcagatatgatttctctcagcaacactaagtagcctacaattgaggaaaggaaaattgtatgggtagattgtgctagagtgagaagtattacacacagcagacatgatggacaaaggaatcaagagagatgaaagtaatagtaatagcaagagaaaagaccatggagctggatggggaggaagattttagaggtgcatcaaacatattctagttggtcagtctcctcaccagtcacaatagttttcacgacatcaccgtaagagggacaatagtatggtaagtaagaaaaggaagttaatttcaggagacttgggttcaaataatgatcctgccatttatttattttgaccttgtgaaagttacctaacttctaagcaagcctgcatttttctttctttcttttttctttttttttttttttttttttttttgagacggagtctcactctgtcgcccaggctggagtgcagtggcgccatctccactcactgcaacctccgcctcccaggttcaagcgattctcctgcctcagcctcccaagtagctgggactacaggtgcacaccaccacgcccagctaatcttttgtgttttagtagagacggggtttcaccatgttgcccagtctggtcttgaactcttgagctcaggcagtccgcccgcctcggcctcccaaagtgctaggattatagatgtgagccaccacgcctggccacctgaatttttacacatagtaaatgctcaacaaatatttaatatgaagtgatatttcaagaaataagaaggtgcaatacaacacattagagatgccattctggcacaaagaaacaagtcagtgcctgctctaattttaatttaatgttacaatagccagttttgattagaatattttgcttcaccacatggtgctcaaggtactgtggctgcataacaaattaccccaaaacttagtgtcataaagcaactatttaatatactcacagcttctggggctctgcagtttagacagggcaaatctggggtgtgagtcagaagactcgagggctagggcaggaatcttctaaaggctcactaactcacatctggccattgatgctggctgttgactgagagactttacctgggaactttggcttacacttcatgtgacttctctctgtgaaaaggcttcctcatagcatggcagctgagttccaagggcaaatattgagagagacatccttttgctcagaataatggtattgagattcatccccatgtctgttgtattagtactttttaaattggttagtaatgttccatttcatgcatatagcaaagtttttaaatccattttcttgttcttagaaatatatgttgtttccactttggggctgagtaaagccgctttgaatgtttgaatgtaaatcttttgagttggacatattgtcacttctctcacataaatgcaagagtgcagttgctaggtcattaagaaactgccaaactattttccatagtggttgcactattttatgttattaccagtaatgtatgagagttacagcttttccacatccttgccaatacttggtattgccatcctttttaattttagccattctggtgggtatgtcatgatatttcttgtggttttcatttgcatttaccttatgactaaaaatgttgcacttattggccattcatatatctttgttgaagtatatcttcagatcttacaccgatgtctatttttcattgaggtgtgtgtcttttgtattaagttgtaggagttctttgtatattctggatacacttccttggtcaaatatacatattgcaaatatgttttcccagtttgtaactttcccttttatattcttaatggaatctttaaaagagtagaagtttttcattttgatgaagtccagtttacagtttttttccttcatggttcctgatttttgtgacctaagaaaatttcacctacgtcaaatttgtgaaaattttctttatattttcttgtataattgtagttttggctacgtttatgatgcactttagcataagagttgtatatcgtatgaagtgtaagggttgagattcatgggtagccattcgctccagcactatttgttgaaataaccctattgagttattttagcacctttatcaaaaataatgtgttggtctattttctgcactttctattctgatctgtatgtctatccttatatcagattcacactgtctagattattctatattaagtcttaaaatccagtagccaaaatcctacaattaggattttgtgtttaggctattctagctacttaaattttcataaacaatttagagtaaatttgtgaatttctgcaatgaagcatgagattttgattggtgttacttttaatctatatattaatttggggagaatggaaatcttaaccatattgagtcctccaatccatgaacactactccatttatgtagatttttttacattctcccagaaaatatctttgtagttttaagagtagatattttattcatatttcattacatttattgttagggcctcatgtttttgatgctatggtgaatagtattatgttaaaatttttaatttaatgattattgatagtatatagaaatacagttgattcttgtatattgatctcatatttggcaaccttgctaaatttacttattctagtggcttaaaaaaatccttaagattttctatttgaacaattgtgttattttatttctgtccattctgtatcccttttatttctttttcttacctttatgccctagctaggacattcaattcagtgatcttatattgatctcatatttggcaaccttgctaatttcacttattctagtggctttaaaaaaaatccttaagattttctatttgaacaattgtgttattttatttctttccattctgtatgacttttgtttcttcttaccttgatgccctagctaggacatacaattcaataatcttagggagcaaaccagtctcttaccattaggtattgtctgcaggtttttcttaaatgccctttattagattcaagaatttgttttatcgtcctaatttgttgaatttttattatggataagtgttgaatttcttagaatgctttttttctgagttgagtttttgtatagttctcctttattctgttacttacattgattgaattttgaatgctaaagtaaccttgcattcctgggataaaccctacttggtcatggtttattaaattttttatatacccatgtggtaaaaatactaatattttacaagatttttgcatcagtggttatgatggttattgctttctagttttctttttaaagtttctactggcttaggtatcagtagagtcaggtttactggtctcatataattagctcattattttctcaaaatgtttgtattggattgctattactttttcttagtgtattgtggaattcaccagtgtcactatctcctgggcttgggattttctttgtggggttattttaaattatacatgtaatttctgtaataaatttagggctattcagattttctattttttcttgtgatagtacttgtaatttgagtatttcaaggaatttgtcagtttcattttatttgttggatatattggtatatctttattatatttcttataattttcttgtctgacatatctgtactgatgtctcccctttcattgctgatattgataacttttgtcttctctcattttccttgatcattaaaatctttccaatggaatctttcaaagagcagaagttcttaatattgacaaactccagtttatcatttttagctagaggtttattattttcattgatcatacattgaacaagcttttggtatcattaactttattgtttgttcattttctgggtaatttctatcactgttttaataaagtccaatttgtcgacgtattgttttatgaattgtacttttggtgctccttctaagaaatctttgcctaatccaaggttggaaagcttttctccttttttttaatagaaatttaatagttttaggttttacatttaggtctttggtccattttgagttaatttttagatattttctgaagtctggatacaagttgtctttttttttggtcttgtcttttttttccatatatatagttgttccagcatcatttgttgaaaagattatcttttctccattgaatttccccttgcaattttgttaaaatttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtcttacaaaactcagaacacattgagctctctagtccaaaaattcagaatgctccaaaacctgaaactttttgagtgcctatatgacatcacaactggaatattccatagctaatacctaaatccaaaacacttctggtcccaaggactttggataagagatattcaacctgtagttctaatagcttttttgtagactctctctgattttctccatggatgattatatgtcagttatgtcatcttgaatacaatcagcattaattacatcttcctttccaatctggattcctcttgtttggttttctggccttattgcactgactggctagatgtctcctccagtataatgttgaatagaagtcatgacagcaaatgttttcttattccttagagaaaaaacattagattgtttaccattaagtattaatattagctgtaggtttttgtggatgacctttttgaggttgaagaagtttctttctattccaagtttgctgagaattttcagtaggaatggatgttggattttgtcaaatgctttttctgcatttattgagatgacctttttagtttattgacatcatgaattatattgattaattttgtagtgatcaaccaacctgtattctaaaaactgcatattggcctctagttttcttttgttataatagtctttaactggttttgatatcaaggtaatgctgagctcatagagtgaattagaaagtgttccttttcaattttgggggaaaggtttgtgtagatgtggtattatttcttcatgtttggtagagttcatcttggcctgaagttttctttgaaggacgatttttaactaaaaattctattttttatagttataggaatattcagtttatttcgtcttaagtgaggtttggttgtttctttcatgaaatttgtctgttttacctaagtgggtaaatttattggcatggagttgtttgtaacattcattattcttagtatatctgtaaaacctttagtgatgttacctttctttatccttaacattattagttcatgtgttttctctctttttttttttctgagcagcctggctagaggtttatcaattcattgatctatttcaagaacccattttttgtttcatttatgttttctgttgatttactttttcctattctatttatttcaactttggtctttatgttttcctttcatgggcttattttgctttaattttctcatcttctagtttattaagttggagactaagatcaagttagttaatagtattgttcaacttttctatatcctcattcattttctgcctacttgttttatcaattataattttggatttgtctgttcatatacttttatcacttttgtcttttatgtattttgaagttctgttattagatacttatacatttaggattattatgtcctcttgatgagttgactgtgttattatcatgaactgatcttttttctttgttcttcctttatgcagtgtatccttttttctgaattaaaaaattttgtttttttagctgggcacagtggctcatgcctttaatcccagcagtttgggaggacgaggtgggtggatcacttgagctcaagactagcctgggcaacatggcaaaaccctgtctctacaaaaatacaaaaataagccaggcatggtggtgtgtacctgtaatcccagctacctgggaagttgaggtgggaggatcatttgagtgtgggaggcggaggttgcagtgagccgagattacaccactgcactccatactgggcaacagtgccagatcctgtctcaaaaaaaaactttgtttttatcactggttttatgcaatttgttgataatctgccttagtgcctttttttatttgtattttaatttgcttgagattctttgagcttcttatatctatgggcttatagtttacataacatttgaaaattttttgggctttatttctttagggtatttttcttctccatttgtctcttctctcctttgaagggctccagttacatgtatgttagacccctttatattgtcccacatgtcattaagcttctgtattttaattttatacttttcatgcattgtctaatctgtttagttcatccagtgactttttcatttgagataatatatttttttaattctagaagctccattttgttcctatttatttttttgtatttcttttctcattatgtccatgctttcttttaaatctttgagcatattcataagctattttgaaattcctgccttgtaatgcctacatagctatcatttataggtctatttgtattgactagtttttcttttggttatattttacaatttgctgctttcttcattagactatatctagaatagccattattttagtgccaaatttagctccactacttaggtgtgaattatccttagcatttcagtgaggtctctctactgtgtctggttagaactgcagtatctccctgctctttttgaccagcctcatggagtttcaagttatgcaaggacaaattattattaaagtattgttgggactttttttatacctcagtcccttcttttcagtaccctctcctgaacattccatctccctcatcctccccaaaccataatctctgttttctctactcagtgacactgcatgcactgctttgcttcccctccctgtgctgcatactggaaattgcttccaggaagaagccaggctctcatttggtactcattccattcatttccctttccataggaatcacaatcttttactgcctattgtctcagtgcctgataatatttgtttcatacatcttattcaattttctagttcagtgggtaaagaaagtcctattccaattaaatttgcatgattagaagctctttttttcccttcaaaatctttatttgcatttctttttttttattattatactttaagttctagggtacatgtgcacaacgtgcaggtttgtaacatatgtatacatgtgccatgttggtgtgctgcacccattaactcgtcatttacattaggtatatctcctaatgctatccctcccccctccctccacccaacgacaggccccggtgtgtgatgttccccaccctgtgtccaagtgttttcattgttgaattcccacctatgagagaacatgcagtgtttggttttttgtccttgcgatagtttgctgagaatgatggtttccagcttcatccatgtccctacaaaggacatgaactcatcattttttatggctgcatagtattccatggtgtatatgtgtcacattttcttaatccagtctatcatggatggacatttgggttggttccaagtctttgctattgtgaatagtgccgcaataaacatacttgtgcatgtgtctttatagcagcatgatgtttaatcctttaggtatatacccagtaatgggatggttgggtcaaatggtatttctagttctagatccttgaggaatcgccacactgacttccacaatggttgaactagtttacactcccaccaacagtgtaaaagtgttcctatttctccacatcctctccagcacctgttgtttgctgacattttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatccttcacccactttttgatggggttgtttgtttttttcttgtaaatttgtttgagttatttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcatttgttgccatggcttttggtgttttggacatgaagtccttgcccatgcctatgtcctgaatggtattgcctaggttttcttctagggtttttatggttttaggtctaatatttaagtctttaatccaccttgaattaatttttatataaggtgtaaggaagggatccagtttcagctttctacatatggctagccagttttcccagcaccatttattaaatagggaatactttccctatttcttgtttttgtcaggtttgtcaaagatcagatggttgtagatgtgtggtattatttctgagggctctgttctgttccattggtctatatctctgttttggtgccagtaccttgctgttttggttactgtagccttgtattatagcttgaagtcaggtagtgtgatgcctccagctttgttctttttgcttaggtttgacttggcaatacgggctcttttttggttccatatgaactttaaagtagttttttccaatttcgtgaagaaagtcattggtagcttgatggggatgccattgaatctataaattaccttgggcagtatggccattttcacgatattgattcttcctatccatgagcatggaatgttcttccatttgtttgtgtcctcttttatttccttgagcagtggtttgtagttctccttgaagaggtccttcacatcctttgtaagttggattcctaggtattttattctctttgaagtaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctaaacatacaatcatgtcatctgcaaacagggacaatttgacttcctcttttcctaattggttaccctttatttctttctcctgcctgattaccctggccagaacttccaacactatgttgaataggtgtggtgagagagggcatccctgtcttgtgccagttttcacagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgatggattacatttattgatttggatatgttgaaccagccttgcatcccagggatgaagcccacttgatcatggtggataagctttttgatgtgctgctggattcggtttgccagcattttattgaggatttttgcatcgatgttcatcagggatattggtctagaattcccttttttttgttgtgcctctgccagcctttggtatcaggatgatgctggcctcataaaatgagttaggaaggatttcctctttttctattgattggaatagtttcagaagaaatggtaccagttcctccttgtacctctggtagaattcggctgtgaatctgtcgggtcctggactttttttggttggtaggctattaattattgcctcaatttcagagcctgttattggtctattcagggattcaacttcttcctggtttagtcttgggagggtgtatgtgtccaggaatttatccatttcttctagattctctagtttatttgcatagaggtgtttatagtattctctgatggtagtttgtatttctgtgggattggtggtgatatcccctttatcattttttattgcgtctatttgattcttctctcttttcttctttattagtcttgctagcagtgtatcaattttgttgatcttttcaaaaaaccagctcctggattcattgattttttgaagggttttttatgtctctatttcctttagttctgctctgatcttagttattttttgccttctgctagcttttgaatgtgtttgctcttacttctctagttcttttaattgtgatattagggtgtcaattttagatctctcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtcattcaggagcaggttgttcagtttccgtgtagttgagcggttttgagtgagtttcttaatcctgaattctagtttgattgcactgtggtctgagagacagtttgttataatttctgttcttttacatttgctgagaagtggtttacttccccttccaactatgtggtcagttttggaataaatgcaatgtggtgctgagaagaatgtatattctgttgatttggggtggagagttctgtagatgtctactaggtccgcttggtgcagagctgagttcaattcctggatatccttgttaactttctgtctcgtttatctgtctaatgttgacagtggggtgttaaagtctcccattattattgtgtgggagtctaagtctctttgtaggtctctaaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgtgtctcctgaatacagcacactgatgggtcttgactctttatccaatttgccagtctgtgtcttttaattggagcgtttagcccatttacatttaaggttaatattgttatgaatgaatgatcctgtcattatgatgttagctggttattttgcttgttagttgctgcaatttcttcctagcatcgatggtctttacaatttggcatgtttttgcagtggctggtatcagtttttcctttctatatttagtgcttccttcaggagctcttgtagggcaggcctggtggtgacaaaatctctcagcatttgcttgtctgcaaaggattttatttctctttcacttatgaagcttagtttggctggatatgaaattccgggttgaaaattcttttctttaagaatgttgaatattggcccccactctcttctggcttgtagagtttctgctgagagatctgctgctagtctgatgggcttccctttgtgggtaacctgacctttctctctggctgcccttagcattttttccttcaactttggtgaatctgacagttatgtatcttggagttgctcttcgcgaggagtatctttgtggtggtctctgtatttcctgaatttgaatgttggcctgccttgctaggttggggaagttctcctggataatatcctgcagagtgttttccaacttggttccactctccccatcactttcaggtacaccaatcagacgtagatttggtcttttcacatagtcccatatttcttgaaggctttgttcgtttctttttactcttttttctctaaacttctcttctcgcttcatttcattcatttgatcttcagtcactgataccctttcttccagttgatcaaatcggctactgaagcttgtgcatttgtcacgtagttctcgtgccatgattttcagctccatcaggtcatttaaggacttttctacattagttattctagttagccattcgtctcatcttttttcaaggtttttagcttctttgcgatgggttcaaacttcctcctttagctcagagaagtttaatcatccgaagccttcttctctcaactcgtcaaagtcattctctgtccagctttgttccgttgctggcaaggagctgcgttcctttggagggggagaggcactctgatttttagaattttcagcttttctgctctgttttttccctatctttgtggttttatctacctttggtctttgatcatggtgacgtacagatggggttttggtgtggatgtcctttctgtttgttagttttccttctaacagtcaggaccctcagctgcaggtctgttggagtttgctggaggtccactccagatcctgtttgcctgagtatcagctgcggaggctgcagaacagcgaatattgctgaacagcaaatgttgctgcctgatcgttcctctggaagcttcgtctcagaggggtacccagccatgtgagatgtcagtctgcccttgccggggggtgcctcccagttaggctacttgggggtcagggacccacttgaggaggcagtctgtccgttctcagatctaaaactccatgctgggagaaccactactgtcttccaggctgtcagtcagggacatttaagtctgcagaggtttctgctgcctttcgtttgtctataccctgcccccagaggtggagtctacagaggcaggaaggcctccttgagctgcggtgggctccacccagtttgagcttcctggccgctttgtttacctacttaagcctcagcaatggcgggcacccctcccccagccttgctgccgccttgcagttcgatctcagactgctgtgctagcaaggagtgaggctccgtgggtgtgggaccctctgagccaggcacaggatataatctcctggtgtgctgtttgctaagaccattggaaaagcacagtatcagggtggagcgcagtatcagggtgagagtgacgcgattttccagatgccatctgtcacagcttcccttggctaggaaagggaattccctgaacccttgcacttcccgggtgaggcgatgtctcgccctgctttggctcacactcggtgggctgcacccactgtcctgcacccactgtccgacaagccccagtgagatgaacccggtacctcagttggaaatgcagaaatcacccgtcttctgcgtcgctcacgctgggagctgtggactggagctgttcctattcagccatcttggaactgcccccctagaagctcttatcgtgagttttaatgtgattttaaagaatcttaattctaatgatattactttcaaatagagacagactattacagagttttatctaacaaagctaacatttatttagcatttcagtgatgtgagacgccttgctaagaggtgtctcagttcccattataatcctattataaaggtgccatgttatgcctattttacagaaaggaggactgcagcttgaaaacagttaagtgacttgttcaagctcacatatcagtcgagtaaatggcaaaacctagattcaaactcaatcttgtcaaactgccaaggccttgcttatcatcaccatgtgctatggtttggatgtccctgccaaaactcatgttgaaatttaattgccgttgtaacagtattgggtgctggatcctttaagaggtgattggcctggcacgatggctcacacctgtaatcctggcactttgggaagccgaggcagatggatcacctgaggtcaggagttcgagaccagcctggacaacatggtgaaacccatctctaccaaaaatacaaaaattaactgggcatggtggcagacacctgtaatcccagctacttgggaggctgaggcaggagaatcgcttgaacctgggagatggaggttgcagtgagctgagatcatgccactgcactccagcctgggtgataagagtgaaactccgtctcaaataaataaataaatacatacatacataaagaagtgattaggtcatgaggaatcctccgtcatgaatggatttatgttgttatcgcgagagtgggctagttattgctggagtgggctcctgataaaagaatgagcttgggcccattttctctctatgtcttgtgcttggttgcccttctgcaatgggacgaaccttaccagatgctcatgccatgctcttgaactcctcagcctccacaacagtgagccagataaacctgttgtttataaatttcccagtctgtgggtttctgttataacagcagaaaacagactatgataccatagtatgctgctttgaagtgggtgagcagctgggacaattaaggaatcagcttcagtactaagtgtctgggatgcaatgctttgggggccattttcaggttttgtacagcagtctttcttgggtcacattttcactgctctttacttcaaatggtcaagtcagacatcttttaagcaacatttatgggtaggttctgatggcatcttccttatatctgcatatgattggaaatctaagagcatttgggaaccttgtcactgaccatctttttttattgtaactctacattaaagtggggtgttttttgttgttgttgttgttgttgtttgagaatgataaggtaccatgggagcagaattacattactggaaaagtggtggctaggtttataaaagcaaaacagtcaatgatgttctcagtctcaaattatttcaaaataaaaagatttttaagaaaaatttacctaaaataattagtctcttttcagtttagccaccagcttcctatattcttagattgttttattttgatttttgggggttttttattgtgatttaattttttataatcatgtaaaacatttacgtggttccaaaggcaaactataaaagaaaatattttcaaagaagtatgttttctatccctgttcccaccctccttcataagtaatcattttcattagctttcagtttatactcattgtctttgctttaaaattgtaaatattgtagctgtgtgtgtttttacatacacatacatacacacacatttccctcttccttggataaaaggtggcatattctacacactattctacatcttcttgttttattaagtcgtagatactctggagttcactcaatagcatggtattaagattgtccttttttctttttaaagctccaggatattccactggatttaaatttttcaaaatctcatttgataaacatttattgtctactgtgtgtgtcatctgtcacgggtagtgcatagcattgtagggcaaacagaaatgaacaacatatagtcttcaccctcaagaaacttacagaattttaaaatacttttacaaatgtgtacctctcacagtagctgatccagtaacaattatttttatttttacccatctcctttttagagaacagagtaaaaatttttttgccatctattgtttctgttatatttaatgtcatttcagtagtatttataagcagtctaggaacacgtcccaacatttaaaatacttagatatatgattgtaaagtgtgaggcagagaagtacatcatatgaatgtatgctatttctaaatacttgctattaattttagtcactctaaagtcagaatataccagacagtccaaattactgtaattataccatccttttaaaaacttggcacctctttattcccaatattactccaaccattatcattataacaggttcctgttctgtacctcactcacatctgtactcttctccaatatttcttatttctttaatgtctgtacctcataagatgctgaacttttctttgaagacttaggcattggggctgtgggggtactagcctagacttattgaaagcagctcacctatggtactttgtcacgggagtgggtatatctgtgctaggtattgtccttcctatctctttgttggctcttaggggcactccgtctctcagggtcctgagtctgactttgcatctttgaatatggtgtctctccttaaagtcatcttggttacaccttgggtttaccttttctttgcctgtcctccagtagtggccctgaagcctatccatgttatcatttggctactcctggctcttccatcctggagctgttaacctagttgctcttgaactctgcatataaggcccccttccctttctctttcccctttccccagttgctctctaggttttctaatttctttcctgacactatgtatggctttagtcaagcgtaacccttgtccctaaatccacaaatataaagctaagacatgttacttgtctagttttcttagagaaggaaacttctcaggtctttgtatgcttcctcatacaattgtaggttgcagtaaggttaaatggctgaaaagcggtgaaggaacatgttcaagaagtttcatatgatttcactacatgaatgtagatgtggtaatctagcacctactgtactacttaaagcatttcctacagtgaaggcttctgagaaaataaatactattcctgaagtagtctcacaaaaaaaccttttttaattcagaaaattgattccaggttcactaagtcagcattttctctcatcaggcattgcaactaatgacattaatgagagccatgccatattttttaaaacaaaggataaaaagggcaaaactgagaattttaaaagggagttgtttccagtagtctgtttgaacattgtaattaaccaagaaataaaacaagaaaaggccattttaattgtgttttttagtactccattaacagtgcatcaagctccttatgaattgagacagtataaaatgagtgcttacgttaaagtaggaaagccatcagtctgcggtacagagcattgtatttattagagtatcccagacctgaatgagtattaccaccattaggtaatgcttaagtgtctattttaacaaaaggcatttttttttgttattatagagaacaaacactaaattgactaaataaatgaagtttaaacaagaaataaaacagctagaatttgcttgcttttgttggtggtgatatgctcttgtagccccagcaaattacatcagcattgttaccctcgacagggagctttataatttgtagcatgtaaaataacccttcccaaaaaagaagagagccaggacctgtgttgaactacttacaaagcaagcatgtccctggtgtcaccttagtagttttagtgagaaagatgggatttctaaggacagtagttcacagttgtgctctctctgttttctgtctttcatgctttaaggtttttttgctctcttattttaatgtgtgtgtctctatgtatgggcatgtaaataaatatgcagatggtggcacctatgtaagaaaatgtttgaacacagccccaatttcagagctcaatatggcatggggaattcttgggagaatgtgacctattgagggttggttggttgtttgtttttaagatggaatctccctctgtcacccaggctggagtgcagtggtgtgatcttggctcactgcagcctccgcctcccgggttcaagcagttatcatgcctcagcttcccgagcagctgggaccacaggcgcccgccaccacacctggctaatttttgtatctttagtagagacagggtttcaccatgttggccaggctggtctcgtactcctgacctcaaatgatccacccacctcagcctcccaaagtgctaggattgtgggcatgagtcaccgcgcctggccaattatcataaatatatgctttttagtggaccatatagaaagttctattctggttctttatatggttgggttttacttttatctaagtaatgtaagcacatggttttaaaagtcaaatcatgctacttctaacaacaaaaaagcagtgtctctcctaatttgttccaactccaccactttaagcatttttgctgtttcttctgtaaccagcaacatatattactatttcttgatttcatagtttcagatatcatcagttattgcctttttgctatgaaagatgtagctgttttatgttgctaccctcccaccccacttcctggtccctacttactttcccttccccatttttataatattcatatttcagttattcatataatatgattgtatttcttgtgtaatttattgttatatctggggtgaatcattgactcatttctttgattgcttagttttttgttgttgttgtttttgagacagtctcgctctgtcacccaggctggagtgcaatggcgtgatcttggctcactgcagcctccacctcctgggttcaagcaattctcctgcctcggcttcccaagtagctgggattgcaagagcgtgccaccacacctggctaattttttttaatatttttagtagagatggcgtttcactatgttggccacgctggtctcaaactcctgacctcatgatgtgcccacctcggcctcccaaggtgctgggattacaagcgtgagccaccgtgcccagcccgattgcttgttattttatgtattattgctaatttatccctaggctgtcccactaaactgtgtaactttcctcggtacattcaaccccattggataatttatcacattcattgtttttcttggtgacagagggccccctgcctgtgagcctttcatctgtttcattgtaagttggttgctgtcctggcctgctgggctcgtcatgagaattccttttgcctttcatctgtgctagagtctttgttccctaggtttcttgtttttttgcttttttggtttttttggcttccttcttcattttgataaagtatgccctctagtaactttctgagaagaggtgcttttttgagatacctgaaaatgtctttatattactctacaatttgatagtttggctgggtgtagaattctaggtgacaattttgaaaatatatagcatatgggtgaaagtttatatgatgcaacgagactacttaggttcatatcacacttaaccagctgtgtgtgacatgggcacatcacataacccttctgtgcttaagttttctcatctaaaaatcaggcataatatcttacctgcccttacagttattgagaggattgattgaataatgtatgtaaagcacttagggcagtgcctggccgtttttctcccaaagctttaatgatattctctttaccccagtgccctaaaattttacaatgatgtgctttactgtgggcctttttaaaagtcgttatactgattgcttagaaatatttttaaatctggaaactcattgttctttagtttagaaattctttaaaatatttcttagataacatccttttctccagtttctttgttcttcttttcaggagttgctgtgattcaaataacataagggcttataaggtagggcttcatctctaaccttttctttcctgttcctctttctttatctttttgctctactttgagagatttcttcaacttgatcttctaacccttctgtttgagtctcgtggtttagctctcattttttattttcaaggacttttttctgaatgtttttcttttaaactattatatagtttcatactcttgtcttcataggtttcatattcttatctatctcaaagtagtatatttttgaaattttctttgccttatacagggaacagtttcctcagaaaaatattaagagggaagtgttaaataggtgcctgggaacactctgtatatgggtaaattcattatcagtgatcagacaaagactaggccattttttgagcgccttatggatatccgttatctgtagatcttttgttcttaagcaggtcagtttgacagaagaatcttctgatcttctgccttgggctaagggtatgtgtattagggggagaaagggtacgtaggggcatttaagtctgactgcagtggttctgagagataaaggctgagggtctttattttaacatgtttaatacatggaactttccagttaatcctcttgtttgagtacagcacttcagtttgacgtgagctaggggtctggtgtccaaagtctccaaaaagtggggtaaggataatttgcttggccaaagatatccaaggtcatactgcatacctataaaggttcagccagtcctcctgttatctgctccaccatgcaaccctgccctcaaagatacctggtgcttcctattgctaaacctttcttagggacattttgacaggcatatcagcgtgcttcttactggctcgccttattgaaagcttgtgttcaggttctacagaaagcttgtgttcaggttctacaaaaagatgtcaagaagggatttgatgtgcaagaaatttattgagagtgaaaatgaatggtagggagctggaggaggctgggacagccatcacaggtcatgcaggtctgaccccgttggaggaaaaagggaagaaaaagaggaggattgggtggggaaattatttgaccaaggtgcagtttcaaggatgttttggcaaggcgtattgggagtccttgagccaaagttgaccatcagagacccatatctcacaggaattagcctgcttaagtattcctgctgctcttagtcaccagctgagagtatttataatagctgctttgaagtcttttctgctaattccaacatctgggctccctcaaaggcagtttctattttctgcttttttttcccctcctttgtaaaggtcacacttttctgcattttgcatgtctcctaacactttgttatagcaactgtggatactgacaccttcctccactccagggttattcttttttagttacttgctggactagttcagtgcaacctctgatgtccctcttcaggacaggtgtggtccttatccatgcatttctctgctacctctattggtgttaaacttaaccaatcgatagctgattgctcccttctttttgacaatgccttgtggtataaattgctccatagtctgatccaattaaaattgggtcccttcatggatgaaattggaaatcatcattctcagtaaactatcgcaaggacaaaaaaccaaacaccgcatgttctcactcataggtgggaattgaacagtgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaagaaaagaaaagaaaaaataaaaataaataaaaataaaataacattgagtcccttgtcagggacaagtttttctagtctttgagacttgctatacccttccctgagcagaatctctgcactatagagtaggagctggggaaaatggggaactcactcctcattggctgttccacccagatcctccctctgaagcagggtttttgtgttgccgggaaggaggaggtatgaactgtgcctccttttgcctctgctgctactcagtgtggatcttccacagctcaaaaccagggagtatgatatctgtcagtgttcaccaggtgctgaaagtactcagaatagttctttcaccctaggaagttgaaggagatgggagctgccactcagctgccaaacacatctctgtagctctcttgacaacacagagctgtgtgggcaggggggactacactgtttaccagcttcctcacctgattcctctgtttttagctggagttcaggggagagaaatggctgctgccatcagcttctgccgcttgctctatataggccttccacagcatggagccgtggaaaatgggatctgccaatgtttactagctgccaaatccaccccgagtagctcttccatctcaaggggcggatctgcccttagctgctgaactccttaaaacagttctttggcaaaacagagctgtggggggacaggtgcagtccctgtgtggtccctatctcgaatgctacagcctcttattgttcttatcgaatttctgtagattctattgaataaatgcttctctatttgttgtaagccctttgatcagtctccagggactttgaatgattgtgatttttgaccagctaaatatatgtctctccaggggagagatatccctgagctcctttatacagccattccagaagtcccacctagtcattgtgggggttttctgggttttttctgagacagagtcttgctctgtctcccaggctggagtgcagtggtgtgatctcagctcactgcaaccggctcactgcctcccgggttcaagcgagtcccctgcctcagcctcctgagtagctgggattacaggcgcacgccaccacacccagctaatttttatacttttagtagagacagggttttaccatgttggccagggtggttttgaactcctggcctcaagtgatctgcccacctcagcctcccaaagtgctgggattacaggcgtgagccactgcacctggctgtcattgtgtttttaatgattctgtcttaatagaaaactagttttacacaaatataatcaagtgacttaaattgaaaggactaagattgaaaactgaattgaaattgaaaattgaattgaaattgaaacctaagatttttttgaaaggtatgattttattacggaaatttgcttgattgagctttattttaatcaagactttgtatttccatttttagaattaattcagagaaatagctaacctataaagttcatcttcagaattgagtcattgtagacctaagaagcaatatagcagagttattaagagcataggttctggggccagactacctaggttccagtctttgctttgcagcttattggttctacctgggttccaatctttgctttgcagcttgttagttctttttatttttatttttgagacagtcttgctctgtcacctaggctggagtgcagtggcatgatctcagctcactgcaccctctgcctcccaggttcaagcaattcttctgcctcagcctcccaagtagctgggattacaggcatgtgctaccacacccagctgatttttatattattagtggagacggggtttcaccatgttgtccaggctagtctcagattcctgacctcaggtgatccacctgccttggcctcccaaagtgctgggattacaggcgtgagccaccgcccctggccgcagcttattagttctgtgaatgagttacttaactgctctctgtctattcatatataacatgagcatcatctgccccttagaattattgcgaggttaaatgggtcaacacatctaaaatagagcctgactcatagtaagtactcagtaaatgttagctgatggttattgttgttagacacattaaaggcaaataatcatctcatctttgtattttattattgagaccaataatattgtctaaagccagagaccttggtgaaacgctgggtgcccagctagctataatatgatctttagttccctctagtggaagaaaattagataggctctttgcataaacatgctgcttttggaattgtgatcatttaacctaataaaattacccctgaataattaaccaaagacaatatccacatacataaatggatttaagaaattgttaaaacttacaatcttaaatattctttccaagtgaaacttttttggggacgtgtaatttataatattaaataatatagtatataaaccatccagtgacataaaaagttaggcatatattacttttgtttaaaacaagtgcattcagtagtagtagtaccttgaagttttccattttaacattcatacccagttatctgcaagtagatggcatttcttggtcattctctgagaagtctttaatcattgtgatatgccacctggagtagatttccttgaagttttggcatttttagtatcctcttccacacagcctatggggtaacagaaagattgctagattgggaatctgagacctgggttcatcttccagttctgctatgaaatatctgtgtgacttcgggcatgtcttactagggcctcattttccttctgagtaaaatttgaggatagagaggagcatgtgatgatgactgtcttgctgtcacttctgtttctaacattctctgattcagtgatacatacactttgatgtgagacaggagatgtataatagatgttgagtctaagttgggtaaatgggtcctgtatgcttgatgttgccttctagcaggattggcaggaatggaaatcaccagcagtggaatgatttggtaaatgccaagatcttgaggcatctatggaggcggttgctagattgcagcagggtatgcctccctcagcttgggagattgttaaagagaactttgaggcaacgtctaagtgggatcttgatgaacaagtaggggtttaccaggcagagaaggaagcacgtggagtatcatacagagggaacaacatttgtcaggggacagagagcagggggccggtgcacaagctgcgggtggttcaggattggggtcagggaggctgaaggaagaagctactggaaaggaatgtataaatgtgtgacttcaaaaaaaaaaaacaagagctaaattgtttgactaagaagccggagagctagcttctatttccagttatactgttaaataggtctgtgaaccctagttaagttgttggacttaaaagattttttggaaggctttcaaagccatgcttagggattataatgtcttgctgtatggaatggagctcagtgaaggttttggaataatataatatctgttttagagtaaaactatgatgacactttaatgagtctaaagagaagaaactagaggcaaagaaacccatttaaagatctttgctgtgatccagtcaagaattgttgagggctgaaactagggtaaccgcagtaagggaaagatagttttgacaggtgttgcagaaatagaatggacaggttttggcagctgcatataggaagtagaggagaagtggtagatggtgtgaagatgactccaagggctgtctggaagattaataattttggtaatcagtaggccacacacatacagctacatgggttctgttttacttttcttaactagtgtccttattattaaacattttgagtgtgtctagtttttttcccaaataaccctatggtcatcttgaggttttttacgaaatatgtgatttcccaaaaaactgtagatgaaaaactgcaaagttaaagtaggcatagaactacactatatatagcagtgtggtttactaatagatgttcacattgctgccttcttggtgtcaaactcggtttgattgacatttgttaaacatagaatgatttccaccaaaaatgatgaaaggaaaagaaaacaaaacttattgtgcatgtgcactctcacatactttattaatcatccaggcctaactacaaccctgtataggagttgttatcttactctttctattttacaaatgaggaaacagatgttctaaggttatgcagctactaagtgatgaagacaggaaagacaggtcttttgactacaagtctattgccctatctattatatcataactgcctgccagcagaatgtgttagtgcttaaaaggatagatgccagatctgtggaagtagggtgaccagtcatcttggtttgcctgggaatgagggtgggttctcagaacccaggactttcaacctggaaagatcctcggtgccacaactgagaaagttccaggcaaaccaggacaggttggtaccctgtccagaaaagtcacttatatgaaataaaccattatctagaatgacttaaataaggtatttactgtatttctttcccataatattgtgtcatcaatgctaaatgacaaatgattcctaagtgaagaggagttaaggccccgccttccttccatctgtttgttttcactggctctgagcatcctgccttgctgcagttacactcaactgtgtgtgaatcagatactagatgcctttgcttctaagtcagttttattttattttttatttttatttatttatttgtttatttttagacaggatctcactctgtctcccaggctggagtgcagtggcatgatcttggctgactgcaacctccacctctcgggctcaggtgatcctcccaccccagcctcctgagtagctgggactacaggcacacgtcaccgcacccagctaatttttgtattttttgtaggaacagggtttcaccatgttgcccaatctggtcccaaactcctgggctgaagcgatccacctgcctcagcctcccaaagtgctagtagaattacaggcacgagctaccgtgcctcgtctctaagtcagtttttaaggaaacttatgctttgcccattccaaatttgatgaaatggcaaaagagctattcagggaaaaatcaaggagggctgtcagtatctgtgatttcaaagtatttatcaaaacaattaactcatttttcttggtcctttttcaaataagtatcacatattggtagttatttctttacgataaatttgttttatactatttttatgagactttgttgacaaaaggattctgtagctggatggggaaacccatattattaaaagaaaaaaaaacctcagataatcatttcactatgccgtacagaatttttacctcattcattttttacatattgaaacagaccacaaattgctttctgggaaaagttttggccctgctgtcagtatttcctgggctggccccatcctggaagaagatttgggggagaaatgggtggtaaggaaatctatcctgtcaacgtgtccttgttgagctcctcagctatcagttaataaatatagaaagtaaattatagataacacaattatgaaagtataaagcacaggtatgtgaagaacattttttttctttgacatattagttgaattcccattttatttcagtaacttctcgtttgctttttaaattttattgaagaacgtgtatgcacaataaaatgtacccatctaattgtacacttcagtgagttttgacaaatgtatgcattctgtcatcccacaaagttccttcgggctctaacatgtatgatttttaagactttaatattgaaaagtaattgagttataaactgatatttctctaattttcttgtataaagtaaggaataccatgttgaaataggtgtctggtttttctaatagtcaaatgccctgatcttcccccctttggtttacatttcccaaaatgaaaagcaacagagcaattgcaccttttagacaaacttagagcattgtatttctatttttgtcatatacaaatttgttacacttatcagaactgaaaactctttgggaaatatattaacaaaaccccattaatttgtaaatgcttaatgcagctaagattgatttctaattaatacacatttgcctatttaagaaaattttcacatcagtcaaacactgaattaatggtatgctgcttcctttctttattcacctgatgatgatatttggggccataggaattttttttcaatgggcaagaattcaaagaaattagaaggtgcttggatttctgtttgtgtgtgtgaaaaaagacaacaaaatgtatagagctagtagtgaaacatgtaaaaaagaatcaaagaaattatgagtttgcagttgacccagatttctatggtggcctgtctaggcctctactcttcactagctgaggtcaactttcctgaaggtcaatgaggaagatagcctcattaaagccaacctgacctgtgttgttgccaaaggcagctgggatctttattcttcaacttgattatgagataaaggtagaacccagcagcagaaattgactttgctactataatccttccaaggttctgcttggattcctttcttaaagtatcatttggtcattcatttcagtacactaaggaaaaatatgttgagtcaataatgactttcatttacttattttgttattaatatttattgaaatgaacacattagtacttgtcctagttctttctatgactagattagaatattctttattttgattttgagtccaggtcagctcttagcgaattttgtttaactgttgaatttctaacacaacctagacattgtttggaaatgaatgagaatacttgtatatttgttaggaaaagcgcagtatctagtttctgactatcactagttacaatgcagctgaaataagccggttctgtaacagtcttgatagcctgtcattcaagtcagtattaccatattagcactattgtgtgattggatcttaggatatataaaaactatgcagacccaggaggcactgtggtgtgatgtaaagagcaaagggctttggttattagtcctgcttcctccacttactagctgtgtgatttatatcattgagccctggacctcagtttctacctctgtaaaatggggagatatatgtgcatatatatgtatgtgtatatgtacatgtatgtcatgcagggttattacagtaacaaatgaggacttatagaggggcactttaaagtctcagagtttgcattagattaacaatagtgaagaaattccagatttagttattaaatgatggatttgggttattaaaagaagctataggatttccttctgtgaaagtattttttaaaaacacatctgtttgaatttagattctttttggaatgactgacattataaatatctgtaagaattacagaactcacaatcaggagaggataagaattaaagcaagtcaacttatctagagtggcaccattccaatttggtagacactagccacatgcagttattgagcacttaaaatgtggccagaccaaattgagatttgctataagtgtaaaaatacatgctagatctcagagataatagtacaaaaaaagtaacttattttattaattttagtatgattatatgttgaaataatactttgtatacattgaattggataaaatatgttatcaaaatgaattttacctgtttctttttacttttttaatgtggctactggaaaatttaaaattatatgcatggcttacattatacttaaattggatggtgttgatcaaaatctttattgagctaggtgcagtggctcacacctgtaatcctaacactttggaagtccaaggcaggaagattgattgaggccaggaattcgagatcaacccgggcaacatagcgagactctgtctctataaactatttaaaaattagctgggcatggtggcacgtgcctgtagcccagctgctcaggaggctgaggtgggagcatcccttgagcccaggagttcaaggttacagtgagctatgatcacaccactgcactccagcctgagcaacagaatgagaccctagctcaaaaaaaaaaaaaaaaaaatccttattgaatgctctcgagcaaacgaaatcttaaatttagatcttttaagttcagatacagatagaatgaaaagttctcctagttcttcaagaaaaatagtagtaaaataatactttacaggaaaatcatttttaaaacagaccacttgaaccagcttccctaactttcccttacttgaccagtctgataggcagaccctggtgggatacttgctttactattgttggagagcccaaactttttaggaaaataatagtcattctaatgccatatggcaggttgatttcatttaagtttctaatttgggttagaaaattaaatattgctacctgtattactagttccccttttaaagggaaataaattgataaaataaatataggcatatagttaaatgtaaggacactaaacacagaaatagattagtttaaaatatttttaaaatttcctgagaaattacaaaaaagaaagtacaacttagccataaaaaggaacaaaataatgccattcacagcaagctggatggagttggagaccattattctttttttttttttttaatctgagatggagtctccctttgttgccctggctggaatgcagtggcgtgatctcggctcactgcaacctccgcctcccaggttcaagcaattctcctgtctcagcctcccgagtagctgggactacaggtgcacgtcactacacccggctaatttttgtatttttagtagagacggggtttcaccatattggtcaggctggtcttgaactcctaacctcaggtgatccacctgcctcagcctcccaaagtgctgggattacaggtgtgagccactgcacccagctggagaccattattctaagtgaagtaactcaggaatggaaaaccaaacattgtatattctcactagtatgtcagagctgagctatggggacgcaaaggcataagaatgacacgatggactttgggggaagggtgggaggggaggtgagggataaagactacacattgggtacagtgtacactgcttgggtgacgggtgcaccagaatctcagaaatcaccactaaagaacttttccatgtaactaaacaccacccgttccacaaaagctattgaaattaaaataaaaaatgtactcattaaaaaaaaagaaagtacaaaggagagtgaagagaggtaccagttactagtctgtaaacaaaacaatacttcaaaatagagatggtaaccctgggtcatgtcattcccaggtacattttgtgctaacatctgtaagcagtcagataatcaccactttaaatcatattttcatcacctgctttcaaattccttcctactttgcctctagagttgatttgtaggcaaatagtgtttttagtttgctatatcagcgtggacttaatagcacttaatacatatatctttaattcacattcatatttagaaacaaacattttgagtttaatattcgtggaatctatagttggaatggatatatttgtgtttttaattgtgctatttgagctatttaatttatacttgaattcaggaaaacatgaccacaatttttctagatcattgcccttatcatttgaaatatatttttatgttgctagtttcatactagcaaatcaagtcaaatcagtgttctgactttagttctgaaatgtcagatccggtgacatttaaattgctttgaaggctggccccccagcaattctgcctttattttgagagtgggtaggtgataagagactagaccaaggacttgttcagccatttaccaaatcaaaatgtgaggctcaaatggagccaaatgtgtggcagaaatggagcatccatttctgcttacaaactttcagtataaccaatgtatcacatagcaaatggtgaatgtggagataaaaatacaatttagactgggcacagtggctcatgcctataatcccagcactttgagaggccgaggagggtggatcacttgaggtcaggagttcaagaccagcctggccaacacggtaaaaccccatctccaggtgctaaagttgaacgagctgatggatatgaaccaccagtccaagaatctgtttaaagttcagacttaaaatagtggcaaataaaaagtcctcatttgtgatggtttgcttctgaaagaaaaaaaaaagtctctactaaaaatgcaaaaaattagccaggcatagtggtgcacacctgtaatcccagctattcaggaggctgacgcaggagaatctcttgaacctgggaggtggaggctacagtgagccatgatcacgccactgcactccaacctgggcaacagagcaagactctgtctcaaaaaaggaaaaatacaatttagttacatgaaagaggcaaaatagaaaataagctgaaaataaagagaaaatatcagttttaattgtggcaaacaccaaatctgtttacttcatgactcctgtgtcacaggatagagttaaaatcaggcttttgattagaatagagaggaatggaaagagaaaaacttaagtcgaaaacagaagatatgaaagggtgagttctaataaaaatgggaagctagagataaacataaaaatgagtaataaaaattttaagcttttcctagaattagaaggcagaacactcctggagaggaaaaatctgtgcaggcatgtgattgatgttgtctggctcagcctggccctccagcacacttgttaaaagctttcctcatggttatgacttcccagcacaaaccccacagctgcttcacatcctcccctcctgcggggccttcctaactacttttggagatggaggcatctttcctgtgcctctgatctcttcctttgcagtaaacactgagcccccagccctgccatgctgggctccaaacatccagcttctcattagaatcttaacactgccctctccaactgatttggtagactctgcaggtaccacatcacttgtcactgccccatttcattgactctaagaaagtcatttgtagaagttagcagtcagcttgcagatggtaggacaaaggcaggaccagcaccatattttctgactccagatcctgtaggcttttcctcactgccacttacaaacacacagagtgcttcctttaaaaaaacaaacaagtaaaaccttctcttgaccccgctatttctttcctactgccagattcttctaatatgatcgtgttcaaacccagcatggcattattggaaggactgctgactttggaattgggcaggccagggttcaaaacctaccctcatgatagctgtgtgatcttgaacacgtttctaagcctcagtttctccatctgtaaaatacctacctcacagtgtggttgggacatcaagtgacagtgactatattaagtacttagcccaatgagaggtgtgataattttaactgattattacataattgtctctggcatactgacctcaaccctgactcctccccaaaagttgatcttgctcaggattctcattaccttttctggctgaatcttgtggtcttttctcagctttcagccttctccagctatttacaacttaatttcctctactctcttgattttcttaatattattgattcttcctttccttgtggcttctcttttgtcaaattttctgacttctttttctcattctacccttatgtaagtcaatcttctaaggttccatctacgatcattgctctgttgacaagactaagttgaattaataaatcagaaaggagataatattatctattttactttctgcagtacatccttagccttggttcttccttacctgtctcccttcgactttctaatataaaaatgtcacattggattttaagtcatcagcaaacgggtaaagccccagtgctattagcactggatggctttcattattctattccatgtagacatggcaagcgatttccatgcccaaactgttttgtatgatgatgatgatgatattaacaactttgttttccaaatagtattatagagtttacacagtagtcctacatacattatttggatttgttcttcaaagtaacattgtgaggtaggtagagtttggaattatccaacactttttttttttttttttttttgagacagagtttcactctttgttgcccaggctggagtgcaatgacgcgatcccggctcactgcaacttctgcctcccgagttcaagtgattctcctgcctcagcctcccgagtagcagggattacaggtgcccgccaccatgcccggctaattttttacatttttagtagagatgtgatttcgccatgttggccaggcttgtctcaaactcctgacctgaagtgatccacctgtctcggcctcccaaagtgctgagattacaggtgcgagccaccacgcctggccccagcacattttataaatgatattttaaaaattctgactttgactctaggaatagtgccttttctgtttaaaccatactattttttgttccctattccgtataacttccctgataggtctataaatgctagattttaggctaaagaatagacaacatatttttattttatttagggaaaactaagaaaaagaggtaaaaatcaaaacagtaaattgagttattagtttattagcagatcaaggaagagttacaaatttggaggctaagattttattagaagagttggggaaagtatttgtggtttgtttttttttttttttttgcttttggggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctcagtgctttgagagtctgaagcagggaggattgattgaggccaggagttcgagaccagcctgggaaacataccaaaacctatctctatttttttctaaaaaaaaaaaaaaaaggttgtaatcagtgactttgattaggaaaaaaaacagaagatatacttgctaaatattcaaaagataccaaggtcagaggttatattcattacctattgcttcataacaaaatgccccaaaatgtaatggcttaaaacaacatacatttattatcttagtctctgtgcatcaggaatgtgtgttccaacttagcagggtcctctggctctgggtctctcacaaggtgataataaagctgttggccagagctgaagtcattttgaggctccactacaatgtggatctgcttccaagctcactcacatgattgttggcagtcttaccttcctcacaggctactggactgagagccacaattccttaagagctgttggcccaagcctcccttggttccttgtccgttgggcctctccatagagcagcttccagcatggcagctggcttcatcagagcaagcaagaggacaagtgagagtatgagcaagacagaagtcacagtctcgtaacctaatctccaaaattacacaccatcacttctgcagttagaaatgagtcactagatccagcctatacacaagggggatgggattataccagggcctgaatatcaggaggtgaggatcactgggaggcatttcacaagttgccccctacaaagggctagctaacatattggctgtctacatcaaaattcaaaaatatttttacaagtttgtagcaaaggagctgaaacaaagaaggtgaaatttaagaccagttaatgttaactccttcattcaaatatgagtaagtgcaagatcagtgtgaatttagttgtgattatgtgaaaaaagatgtaaacattttagttgttgtttgcaacagcttaaaaagcgctgaatggaaggttatgctacattaattaggagtatatagtattcagaacaaagtcatactcctcccgttcaccctggaccattcatagtaagcaggacactggaatgtctgcagaataggataaccagaatggaaaggagcctgaaaattgtgtcatagagacacagccttcaaaatcttttctggcaaacctgctaaaagaattttgaggccaggcgtggtggctcatgccaataatcccagcaccttgggaggccaaggcaggcggattgcttgagctcaggagttcaagaccagcgtgggcaacatggcgaaaccctgtctctacaaaaaatacaaaaactaggtgggcatggtggcacacgcctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactctgtcacccaggctggagtgcagtggcgcaatctcggctcactgcaacctccgccccctgggttcaagcaattctcctgcctcagcctcccgaatagctgggactacaggcacgtgccaccatgcccggctaatttttgtattatttagtagagataggtttcaccaagttggccaggctggtctcgaactcctgaccttgtgatctgcccgcctcggcctcccaaagtgctgggattacaggcatgagccaccacgcccagccttaaatatattttctacacaactgtagaattgcctgtttatctcattcactgtatggaaaatgtctgctatgtgacctacatggcaatgctagtccttattgtcaaatcactcagccaaatcagactcattttctgtcagggaaaaaaaaaatctgacttcatttttcaaacaaaattaaagtgttaaatggacatccctgtgacactcatcttagtattgattttgaattcttaaacagcttaccatgaatatattgcctggataaagtaaggtggaacctccctttttttctcaaactctctttgttttgctttcaaaggtctctccctccctcaggggctgtgcatttcccagccatctctttgaagttaggctttttgggttggaggagtagtttgccttttggatgggtaactggagatgtggagatgggtgattgtagttgtggagatgtaaaagaaaaaccgcagaccacagacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgttgaaaagactgggaggctttggttatccacgaatgtattcgtttcattattctgctggaagagtccccaaagcagaagcccatagatagaacataatcaatgtccacagttatttgaaagattgtcatatataagactatatgcttattcagtgtggcatcagaggctgtaactagaatcaacaagtggcagacgtcacctctaactaaagaagacctttttgatgattaaacttactccatgaatgaagcagcctgtctcacagactatgtagtttctcactagaagcactcaagttgaagctggatccttccaaggggcctgaagataaggttttaattttggactagagatggcctctaacatcccttctaattttaagatattgtaattcttttgttttttttttttttttgagacagagtcttgctctgttgtccaggctggcgtgcagcggcgcgatcttggctcactgcaacctccgtctcccaggttcaagcgattctcctccctcagcctcccaggcacaggtcaccacgcctggctaatttttgtatttttagtagagacagggtttcaccatgttggccaggctggtctcgaactcctgacctcaggtgatctgcttgcctcggcctcccaaagtgctgggattacaggcatgagccactgtgcccggccaagatattataattcttttaaaattacttatctggtttaattttattctttattcaagaaatatatttctgtctgtatgtttattttctgagaaaactaagaacaagttgggtttgttttttgttgttgttgtttttgtttttaacagtctcactctgtcgcccaggctggagtgcagtggcgccatcttggctcacttcagcctccacctcctgggttcaagcgattctttgcctcagcttcccatgtagctgggactacaggcgcatgccaccacgcctggctaatttttgtattttttgaagagacggtgtttcatcatgttggccaggctggtctcacacccctggcctcaagtgatcaaccctcctcagcctcccaaagttctggaattacaggtgtgagccaccacgcccagcctcctaaaaagcaagttttacatactatataaagtaatgatcacagaaagcaaattttaaaaattcacctaaatttcaccatgtatgctaattgtatcaaaggggacttagtgacagtgtagtagagaaaaaaggatctttggtttcataaaacctgggttaacatcccagctctgtcacttttactaattatgtgaggttggccaagttttataagttccctgagcctcagtttgcttaccttcagaatcttcctaagattatgagaactagatgagaaactgtatgtgacttccctttgtaagtggtgaagtgctttttaactataaagtattatttccagtggctttaacaggatagttttagtccctcattgttgaagtagtctgtgtgggattttatgtaactaattttgtatgttgtgatggaaataattcatggttggctgtatatcgagatgagacctggttaaattggatattttccagtgacctgatcccagtgttaacccaaatcactagaacatggccttatgttttcttttgttttgttttcttttttaacagtgtaattgtggaaaatttcaaatgaaaagagagaatagtataataaaccccagcatactggtcaccaagcttcaatagttatcaaaacattttgccattcctattctgttcctcctgatgtctttttctcccctggagatttctaaagcactataatttcacctataaatactcttgtttgtatttctaacagataaggattttttaaatgatcatattattattatacctaacaaaatcaacaataattccttaatatcatgtcatgatcagttgatactcagttttccctgattgaacatgaattttaactgacagatttctgaatttagaattgttttattagctctagggacctgaaagtagattataaattcagttaaaataacttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagtttgagaccagcctggccaacatggcaaaaccccgtctctactaaaaatacaaaaattagccgggtgtggtggcacacacctgtaatcccagctactcgggaggctgaggcaggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatatggaaaagattagattagtaaatttcaaattttaggttagaaaatccggtataaaacttgttaaacaagcaggtacccaggtcccacctctagacattcacttttgcagatgtgagttctgaccgggcaggtcaagagatgattgacctttaaaatgggggtaatacaacataaaggctatatcatcattgtcccaacacacacagtagttttgtagacatctgcatatatttgcacatccattactttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccagactcccagaaagaaagcaggtgttcagcctaaatcacattgttagcacaaacagtttagacacagtgagtcagtcttttcagtcaggaatgtagaggaccgtcctgaaatccaagttcccagataaacctctcaagggccaaccttagtaggcctttcaagccttttatgagatagtagtttaggcctgctatattaactcttctgcacaaactaaaatagagataaatagaagaagggttttaaaagagttgatataaactcctggatctgcaaacaaaatataattgactgtaaagataatgacagggtttggagtttggggtttttttttttttctttttaactgtaaatacagtatcatttttatatctgttaaaaaacatttaggtggtcagatttttgtataaaacaaatcctggattgggatgttacagtatagaacagattttaaactttgaatgctatatgagaaaataaactattcagatgctactgtcttagaaatacatttgaaattgtcactccgataacttttcgtctatgacaactaatcttcaagccactaaaataattttgaataaatttgtgtacatataaaatctgaagaaaattcagttaattttctgttatttaaaagaagtatagtttgttcatttaaaaataaaagttattggccaggcacggtggctcacacctgtaatcccagcactttgggaggccaaggcgggcggatcacttgaggtcagaagtttgagactaacctggccaacatggtgaaaccctatcactactaaaaatacaaaaattagccaggcgtggtggcgggcgcctgtaatcctagctactcgggaggctgaggcaggagaatcacttgaacctgggaggcagaggttgcagtgagccgagatcacaccactgcactccagcctgggcaacaagagcgagactcagtcttgaaaaaaaaaaaaattcttagtgtacaacctttgccatatacataacttgtaaaaatttagaaattacagaaaattttgacaaaaaataatgtcttaattttgttataaaaattgtaacagaaataaatgtcattcacaaacattttggaccatttccttctattggaagcattttgctataccattaaatattttttggatacaatattttaatgacttcattaagacatctaaatgtgtgcatgtgccatgtttaataaattccctatagttcaacattaacattgtttttccctattagaaataatttataattaatatcttgtacataattacttgttcacgccccttgattgctttgtttcctcagaatacatttctgaaagtagaataactgggtaaaagagtatatgaatacatacaaatacatacatcatacttagatttaacctttttctcagtacaatgcctcacattttgaaaaatacattcacataaatatacaacttaaagaattattgtagaagtgaacaaccatgtaactataacccaagtcaagaaattttaaaactgccagtacctcaacagcccctgaattcccctttctcatgataatccccttcttctctcagaaataactaatctggacttcacttctgtgctttttatatccctagcatcaaaataggaattctcagaattctcaaataataaagttcactgtcgtctgctaaaatctattttttttttttttttttgagacgatgtctcgctctgtcgcccaggctggagtgcaatgctgtatcagctcactgcaacctccgccccctggattcaagcaattctcgtgcctcagcctcccgagtagctgggactacaggcatgcaccaccacgcccggctgatttttgtatttttagtagagacagggtttcaccatgttggctaggctggtctcaaactcctgacctcaagtgatccgcctgcctctgcctcctaaagtgctgggattacgggcatgagccaccacgcctggcctaaaatctttatttgaatggaatcctacagtatatactctatttttggtctctgagattcatctggttgctttgtgcagctgttcctttattttattgctatgtagtattgcagtgaacaaactcgcactatttattcattttaatgctaatgagtatttgggtgattcccagatttcactattttgtagagcagatccttccacgttgttcttcagccatgttttaagggatgtacttgtctgcatttctcatatacattttagaatgaggttgtcaatttccaccaaaacaaaaaaactattgagatttttgtcttgaattactatatcaaatcttgatagcaatttgagaataattgacatgtttacagtgttgaatcatccaattcgtgaacatagtgtctatcttcccatttatttagctctttgatttcttgcaataaagttttatatgttcctctgtagaggttgtgtacatctgtattagatttatgtattgtcagatttattcttaggtattttgtttttagggtaagtcagtttctctcattctcccttctctttccctttccttgtactaactttgtgttcctattcatcaggcttcattaattccaacaattaatctgtagaatcatttggattttctccatacataatcatatcatctgtgtataaggaggatttgatttgccctttccaacttttttacatcttttcttgcctttattacaatggataaaacattcagggcagtggtgatggcagttatctctgcttatttctgatcttagagtttgctaagcatgaatggatcatgaattttatcaaatgtcttttttctgcatatgcagtcatgcatcctataatgatatttcagtcaacaacagactgcatatacatgggtgctctcataagagtataatggagctgaaaaattcctatcgactagtggtatcatagctgtcataacataatagctcaacacatcactcacgtttgtggtgatgctgctataaacaagcctgtgctagcagtcatataaaagtataacacatacaattatatacagcacacaatacttgataatgataataaataactctgttactggtttatgtatatactatacttttttgttgttttgtttttattttaattttatttattattattataccttaagttttagggtacatgtgcacaatgtgcaggttagttacatatgtatacgtgtgccatgctggtgcgctgcacccactaacttgtcatctagcattaggtgtatctcccagtgctatccctcccccctccccccaccccacaacagtccccagagtgtgatgttccccttcctgtgtccatgtgttctcattgctcaattcccacctgtgagtgagaacatgcggtgtttggttttttatccttgcgatagtttactgagaatgatgatttccagtttcatccatatccctacaaaggacatgaactcatcattttttatggctgcatagtattccatggtgtatatgtgccacattttcttaatccagtctatcattgttggacatttgggttggttccgagtctttgctattgggaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcctaccaacagtgtaaaagtgttcctatttctccacatcctctccagcacctgttgtttcctgactttttaatgattgccattctaactggtgtgggatggtatctcattgtggttttgatttgcatttctcggatggccagtgatggtgagcagtttttaatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttagacatgaagtccttgcccatgccttgtcctgaatggtaatgcctaggttttcttctagggtttttatggttttaagtctaatgtttaagtctttaacccatcttgaattaatttttgtgtaaggtgtaaggaagggatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagttgggtagcgtgatgcctccagctttgttcttttggcttaggattgacttggcaatgcgggctcttttttggttccatatgaactttaaagtagttttttctaattctgtgaagaaagtcattggtagcttgatggggatggcattgaatctataaattaccttgggcagtatggccattttcacgatattggattcttcctacccatgagcatggaatgttcttccatttgtccttcacgtcccttgtaagttggattcctaagtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttctcctgcctaattgccctggcctacagtatgttttaagctaagtgttattacaggagtcaaaaaggttttaaaattttttaagtttattatataaaaaattatagtaagctaagatttattattgaagaaagaaaaatacttttatataaatttagtgtagcctaagtgtacagtgtctagaaagtctacaatagtagaaagtaatgtcctaggtcttctcattcactcatcacttactgactcacccagagcaagttccatgaatgcaagttcccttcatggtaagtgccctataccagtgtaccattttttatcttttatgctatattttgattgtaccctttctatgtttagatacccaaatatgtattacagttgcctgcagcattcagtagtcacatgctatgtaggtttgtagcctaggtgtgtagtaggatatcccatctaggtttgtgtaagtacactctatgatggttgtacaggaacgaaatcccctaactatgcatttatcagactatatccccatcgttagcaacacatgactatattgaaataattatataataccatccttcaatctattgctgtagtgaattgcattgattcttgggttaaccaaacctggtcatgatttatgatcttcataatcctttttacatattgttgggtttggtttaggctttctgtgtctctcttttttaatttatttttacttttttttttttttttttgagacagggtctcattctgtcatccaggccatagggcagtggcaccatcacagctcactgcagcctcgacctcctgggttcagttattcctcctacctcagcccctttctgagtagctggaaccacaggcgtgccaccatgcctggctaattttgtagagatgaggttttgccatgttgcccaggctggtctcagactcctgggctcaggtgatctgtccgcccagcctcccagagtgttgggattataggtatgaaccactgtggcttcctggttttcatacctagattacacttgcctcataaaatgaattggggaatgttctctcggtttttttgttgttactattgttctattgattgattgattgactgagatggagctttgctcctgtcgcccaggctggagcgcagtggcgcaatatcagctcactgcaacttccgcctcctgggttcaagcaattctcctgcctcagcctcccacatagctggaactacaggtgtgcaccaccacgcctggctaattttttgtatttttagtagagacagggtttcaccatgttaaccaggctggtctcaaactcgttacctcaggtgatccgcccgcctcggcctcctaaagtgctgggactacaggtgtgagccaccacacctggcctctattgttctctttatgtgatttgtagaactcacctctaaatccatccaggccagagttttcaatcttagttcaattccttaaatatttataggaatattcagggtttttattcattactgtgtcacttttagtaaactgtattttgctaagaatgagtgcattttatctaaattttaaacagttttggcataaagttcataataccactgcaggttctgtagtcatgtcttctttttcattcttgatactggtaatttgtgccttctctttttctttctcagccttgccagacatttaccagttttattattcttttcagtgacaacttgtagctttgtaattcttttttttttttttttttttttttttgagacagagtctcactctgttgcccaggctggagtggcgtgatctcggctcactgcaacctccacctcccaggttcaagtgattctcccaccttagcctcccaggtagctgggattacaggtgcctgccaccatgccaggctaatttttgcatttttagtagagacggggtttcaccatgttggccagactggtctcaaactcctgacttcaagtgatccgcctgcctcggcctctcaaagtgctgggattacaggcatgagctaccgcgcctggcctgtaatttctttttattgtgtgttgttttctattttagtaatttctacttgctgttatttccatccttttattttgggtttaattttctgggagctttttcccttttagtttcaacctttttgtatccttgggttttatttgtacctcttgttaaaggcatatagttgtgttttattccagtctctcaatctttgtcttttacttggatcatttagtccatttacatttaattatattttagtatattttgagttttatctatggtcttatgtgttctctatttgcaccacctattccatgtttttttctctcttgatttatttgaatcaaatgaatatttttatcattctattttccctctgttaattttgaagtttaagcactcttttctgttatcttagtgtatatcccagaaattacagtatgcttcgtaacacatcaaattctgatattgataccattattgtcctcctgaacagtgcaagtactgtagaacatgttaattttatataattccttccttgacttttaggctatgtttttcatgtatttaaattatattcgtgtgtataaaaacataaatcccatgtatttatatcatctcctatttcttatattatttgtatcgatttggatttacccacacacttatcctttgtttgttctttattctttcagcatctctaaggttttatctgggttcattttccttgtgtcagtctgctggatgcaaactttccatttttcttagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagatagatagatagatagatagatgatagatagatagattgtattatttttggcttttattctcttgcaaaaaaaaaaaacaagctcagcttttatgttctagggcatagtaagcttcattgtttgataatctgtgctggataatctcagtatatgaagtccctgtgggtttgcttttattgtctgttatttttgctggttattggtcgagatctcttatcccttcatgtaccttattcatttttgtcttgtgctagaaattatgttgaaaattattggcctaagatgatgctttctttctccaaagaggaattttgttgttgttgttgttgttgttgagacagggtcttactctgttgcccagactgaaatgctgtggctcaatcacagctcactgcagcttctacctcctgggctcaagtgatcttcctgcctcagcctcctgagtagctgggatgacaggcacacaccaccacagccacttaattttttttatttttagtacagacatagtctcactgtgtttcccaggctggtcttgaactcctgggctcaaggaatcatcctgcctcctcagagtgctgagattacaggcatgagccactgtgcctggcccaaagaggatttttatttgctgcttctactgcgaaccttcaggcacctagctgtttaagactttcttactcaagatttaaggcttagattttcagtgccacctagatgtaaagccgggttgcaagtctgtgaaggggctgattgcttccagttcacccctagctctttagggcatcagctcagtgctggagagtagagtttatcagattctcttgaattctcactcattttcccttttgagcccaggaattagagaccagcctgggaaatatagtgagacctcatctctaaaaaagtttaaaaattagccaagcatgggggtatgcacctatagtcccagctactcaggagactgaggcgggaggatcacttgggcacaggagatggaggctacaatgagccaagatcatactactgtactccagcctaggcgacagagtgagactctgtctcaaaaaaaaaaaaaaagaaaaagaaaaagaaaagaaaaaagtactttttttttttacttatttagttgtcttcaatgggagacatcatctagtctaccattacaagaagcagaactctagcaatgtatttaaaactcttttaacgtagttttcatattactctccataaagatttaccaatttatattcacacatggtaaataaatgtatctatgtttacattttgataggtcaaaaggatgttttggtttaatttgcatttattttgtcattagtgtggtcaaatattttaaaagtaaatttacccatttcttttgcatctagtcactttcattagttgtttagttttccttagttgttttagttgtaagaattcttttttgtttgtttgtttttgttttttgtttttaatagagatgggctctcccttgcttgcctaggctggttctgaactcctgggctcaagcagtcctcccaccttggcctcccaaagtgcagggattacaggcatgagccaccacacctggcgaagaattctttatttgctaaagatatttacctttttcatgtatttgtaaatattttccccaaatctgcctgttttattttgcttgttgatttttttttaacatgcagaacattaaaattctgtcagaaaattacagataagcaatagggaaggctagaatgaactcttagctactagattagagttgaagacagcagtataatctcatattgaatttattatatgtacacacacgcacacatacacatatacatgtacagatatatacagaaatcataaattatatgtgcatacatgagttagtacacatacattcctagctctgtccacttagagagcctaaagcatacccacacctagatttttgtttctgaatgtcctcctctaatttaagcagccagggatcctcggaaaaatgattataaattctagggctggaaaagagaaaatataagataaacatgaagcatcttagagtgcctgaaggtaaggaagtattcaaaaagatgggggcatatcagagagacataggaaccaacctgaaagcatgtccagtggccaaaactggaacaatttgagcaaaaaataacacagtatagattacaatccaaagtataaaataaatacttatgagtgcatagtgatataaagaaataattagataaacaattgagagagaaaaaaagaagaattccaagtgttaggtatagataatttccctccacccttgagtgtaggttggacttagtaactcactttcaaagaacaaagtatggagagggaaatagtaattttacagtagagagaactaacagattatcttcaccaagtgatcacattagcattaccagtgatcattcctgcgtatatcatccgctccttgatatgatgtgatgagaagggcatttcacctctgatattcttcccaagaaacccataaccctgacctaggcaagagggagacatcagacaaacccaaattgaggaacattctataaaatacttggccagcatgctttaaaactatcaaggtcatgaaaaacaagtaaagactaagaaactgtcaccaaccagaggagactaaggaatcttgacgactaaatgcaacgtggaatcctaaatggcaagggaaaaagtatatagttgacaaactgatgaagtccaggtaaagtctggagtttagttaatagtaatgtaccagagttactcttagcttttacaagtgtactatagttacctaagatgataacactagaagaagttcatttagtggtatacaggaactctctgtacaatcattcctcagtatatatgcaggggattggttcctggaacctcacgtgtactaaaatccacgcatctcaagctctgcagtcagccctgtggaacccatatataggaagttagccttccatataggcaggtttcgcatttagcaaatactgtattttttatctgcatttggttgaaaacattctgcatataagtggacccatacagttcagaactgtgttgttaaaggatcaactgtactatctttgcaacttttacgtcaatctaaaattattctaaaataaaaagttttctttactctaaacaaacaaaaaagaaaccatgagtttacaccatttccagtttaaagtagcaattacagatttttatttacaagacagttattaaattataaggaattattataagtaattttggtattatagttatataacaaaaaagagttcttaccttttggagataagtactgaaatatttatgcataatgctcttgtttttgtttttttgaaacagggtctcactctgttgccccagctggaatgcagtagcccaatctcggctcactgcaacctccacctcccaggttcaagccatcctcctgcctcagccccccaggtagctgggactacaggtgcgcgtcaccatgcccggctaatttctgtattttttatagagacagcgtttcaccattttggccaggctggtctcaaactcctgagctcaagtgatccacctgcctctgcctcccaaagtgctaggattacaggcgtgagccagtgcgcctagccatttatgcataatgttttattgatgtccgggatttgcctcaaaatcaagcagtgggtaggcagtgggtactatgttggaatacaggtgaaacaagattggccaatgtgttgttaattgttagagcagtgtaatgaatgtatgaaactctgtattttctacttttgaaattttccataatataaagtttttttaagtgagaaagaaattacatagtttttaactttttaagttttatatttgtatatcttatctctgaaaatctgggttccttgccacattaatatacttatttgcttcatcctactagtttaaatatgcaataaaaataagactattgaatgcagattaggatttctttgcacttcttttcatccgaagggtatatcccacaggaatgcacaatcaaaaccctgggttttaaagaaattttaaataactcttctcattgtggttttgccacaagcttgatatagatagatttaagtttgtttgtttgtttcagtttgtttttttatttacatagtttttattacaattttagattcacatacagctataagaaatatagatccttgtagactttgcccaattcttcccaaaattaacattctgcaaaactactgtgtcacagccaggatattgacattgatacaatccactgatcttattcagatatctgcatcagtttgtttttaatttttaaaattgtcttttttttctccttgctttaattttggttttagattatgaaaaacatgtatatgattacacaaagtcaaacctgtgaatagggttcattcagaaaggtctagtttgcatccctgtccccattcactttcttgccctaaagaaaacaatttttaaaaattagttattttatttttccattatttttatttgaaaatatgagaagatatgtatatgattttgtgccaccccccttcttacacacttccatatattctcatctaaaccttgatttttaaaaaattttaatatgaaaacactggggatcactccatggcagtaagtagacatcttcttcattcctgtttatgcctgctgaatactccattatggcaaagaattgtttattaaaccattcccctaatgatggactttgggattattttcagccttcttttactacatgaataaccttgtgcatacgttatttcatactgttgctaatgtcaaattccttcctcaaatgttgtgtcattttgcatcgccaccagcactgtctgagggttgtaggcttcaattttaaattgtgatttaaaggactaatctctgtcatataaattagtatatgtcttacttcattaaaaaactgtactcatatgtataaggctagacaaagagagtcatagataaattctgatttattttatggccctcatttatatctgtggacttgaccagaatgcttttaactagagtgggtttcttatcattgtaaggtcactaggtctaagaaaatttgtaatactcagaaatagagagaaggtcatttgtccctctgccatttgtttactttagatagtaggcagagtcattgaatcttattaggaaatataaaaaacatacttgctctttttgccagactcgaaaaagtactaaagctattcatatttcttatacacaccattgagagctcaagaggttcacaggaaataaaggcaagattttgatgggacttttaagacaaggcaaggatttggggtttatcttgaagatgtggatgccatcctaaggcatgtgatcagatcaccatttttaaaggttgtttttttttggctacagtatggctatagtataggaaggaacacatttggatatggggagaattgggaggccattgccattgttcagtatggatattgatggctaggatagatcagtgtcagcagagagcaacagaagtgaattaggaattagaaaggatagggtttgatgattagataaaggaagtaaaggaggaagaggagtcaaagctgacttgccgtctctggcttgggcacctgatatatgatggtgccactgactaacttgggcaaccctggaagcagatgatgcagtatactttggacatgctgagtttgaagtctctgtaagatatctgaatgaaaggactaaataggaagttagatatgtggattaggagcacagagagagatcttgggtagatacagagatttgggaatggttgctacttagatgatttagaagagtatatagagggagaagaaaaaaggacttgaggactgaggttcttccaaattttggaggttgtagaaaaggaggaatagctagcaaatgagatagagaaggaatagctgaagagatagaaaatcacgacagcaaggagttgcagaagccagaaaaaaaaaagtgtatcaggaacaatattataggaaaatgaagggtttgggtaattcttagttccatcctttactagattcctgtattcttcaactattgtcgagtgttcatgctctgcacagctcccattcggcctcatttctgagatgtgctgccttttggtatctattggtatctctttgctgccatttggtattcctatctgatatctcatttccttagtgagggacatagtgagtgaaagaacattagaggacaaatggaaaggcctatactgttgtcctagctctgtcaccaactttatttagtaattttgtttctttatgcctattatctgtgagatatagctagaatttcaggacagagatggctacacatggaaacaattacaatgagaagtaaggagagagaggaagagaaagagccgtcatagaggaggtgatactgagaattgaaggatgaccaggagtttgccaagtggtaatggcaaggatgaaactagaaagaagtagtaaatatattataaagatacagaaatatcataaagctttctttttgagacagggtcccactctgtctcccaggctggagtgcagtagcacaatcatggctcactgcagcctcgaccacctgggcccaagctgtcctcacacctcagcctccaagtagctgggactacaggtgcacgctaccacacgcggataatttttgtatttttttgtagagacagggtttcaccatgttgcctgggttggtctcaatttcctgggctcaagcgatccacccacctccgcctcccaaagtgctgggattacagacatgagtcactgcacctggcaaaataataaaatttaaagaaagaaaatagaatgaagccaggcctcataggaactaggaaaaaagatctcaggaatccaagttactgttctcttcattccttagggttttgtgtctactttgctctggaagaaccagctttctccagttactcaagcgcttgcacatgaccccaaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctatagataaccttcttttgaatcagggatctgtttcatccagtggcaaacagaagcccactgctgtttccatgattgggctggggctttagatgggagagtttaatagaatatagatggcaaatcgactatatgagtgggaaaagagagaggcattacaggcaggcaaagagcatgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccagttgagaatatccaacacacataaacaggaattctagaagtagaacatagagggaatgatgaagaaaagagaccttattcaaaaagataatagcccagaactttcccaaattgaagaaacattgtaacctcagatagatgtaaggtttggagaagaaaattgctaattttcttggattatttgagtttatggtggttgtaggatacccacctgtaggtgtctactccaaactgcctgagtctggcccccaggagaagaacctaggctagcaataagagtttaggaggcattaccattagcacagggtccatttcacttcttggcacctcagtttctaccctagcaacttttgagaatgaaatgaagtgtaaaagtactctgataatcacaacactacatagttttaccattgtcttcattgtcattgtcataaattctattgagtatagagcctcagtattagaggagaagagctaaggaacctggagccagatttcctatattcaaatcctggctctgctactttgtaaccatgtgaccttggacaagttatataacatttgtcttaagcctcaatttcctcatctgtgaaatagtacctgtctcctagtgtttttatgaggattaaataagttactacttgtaaagcactttaaatggcacttggcatgtagataaatgcccagtaaatctttgctattagctattaaagtacctgcatttcacaggaaccttcagtatcttatttcagaggagtgactaatgtaaaaatcatagtctatgaggataataaatttaggtatctgtgtcttcctgtaatactcaaaggatcagtttagttaactgctggcttttgtctatgtaaagagttttgtggttgtttgcaaattgctcatgatgttatttgaacattcaaggacttctatttttttcttggtaatgtctgaaacttggaaataattcatgggcatatgggatattctcctgaggacacaataatggttccatttttcttgctaagttggaacaatttaatcttgagcaaatacctatgcttgtgcttctgtttttgtttatatctgtatacatctatagttttacaaataccaatattgacattttcattttagccagaaacttgcctaaaagtaagattacacgagctagtttgatttcagagtgcaaatggcagtaaaatgaaagcagaaaataaaaaattaaccatatgattattttgtaatccccagtgtgtttgttcaaggtgagatcattttccagattcatccttcacctgtaccaccttcctgatctgcaaggccatatcagggctggcatggttatttacagttatttagatgttctgtgaggcagataaacagaagacaggacacaagtagaactgtcaaaaaaaaaccccaaaatccatgaattccacaagcgactagaaggaacttgttgtggttttcatatctacatcgtttgaaagggcactccctctcctagagatcaggagctgtactgttagtgatggcaggggctgcactgatacacctgcctctgaatgaagagaaggttttgaggagcaagaaggagaacttatttctagagagaagaatggaaataagggctagagagacttagaaacaatcgcagatacacatccataccagagttacaagaacttacacaggatagcaagcaaactgatgcaatggttatgactgatttggtttggggtggcagaggatccatcccagcttctacctgcaaaagtaagtaggactaggtcaaaggtctaagaaacttaaaaaaaagtgtgtttaaactagctgaactaatacatccagtagataaagaattgcacataaggtatttgtataataattttttttgaattaatgaagttaaaaaatttggggagagagggctgggtagaagagagagaaactcgagaacttgggcctttaaaccctgcaagcataactggggccatttaactaaccaacgtcctagttgaacagagctcattttgagtacagaaacaatagtagcttggaaacttagttctacctaaccccatgaaaccctgtctgtctcctggtcagttgggaaagaacttgtgaggatttcagtaattaaaaaaataatccccttgaagaattagaatgtcactgttctctcgataacccccgtaagtccaagttaaggcaatagcagcctcctccttcaaaaaggtgaacaggaagcatggagttatacagcgggctgagaatcaagagactgaggttctagtcctatctgctattaattagttactaacctaaagcaagtctcttaaacttccagttctaagattctgtgatgtaactcatcgtgatttatatctggaggtccctccccctcactttagtgttagagattagggaggtgggtgtttagctgtgaggattagtgagtacactgaggactaacagtgaagttcctacatggtagaagctagaacagaataggggctattgctcttatctgccttgctttttttctggaaattattagaaagccatacagatatgtatgttaacgtaaacaacaaatccagaggtcgtcttagaattatttgctatcccttgtagctggagcttccttatccactaggaggcaccattgtcaaacaacattgattaggggtcaagagctcttgatcatttaagcaattggagaggaaaaatgtctagaaagaagaaaaaagaggtaaatataggaccctggaaattgtgaaaaatcaatctttgttatctagatggacattagaacagttctcagtttctaaaattcgataaacagtatttcagactacatatcaattttagaagtggcaaaatctttcaaggcagtctttttttcgaagaaacaaataagatatgaaaaaagaccttagaaattactgagccaaatcccatctttattgaggagtcatgatcaacccagaaaggttaagtgtcatgaccaagatctgccaggcttgagcctaaaaccgatgtgtagggggggcatttctcattgattttggccatcccaacacctgaactctcttcaagtatttggagaatccctcattttaagagccttgataggggaaaaaatcccatattctactataaaagctaaaaatggcagatatttgcactactaaacatttagacccacagaactaccacaggacacacttggcatcagattcacttagaaggatacaggacagggggaaagaaaaaacagctttttagtcaggcagcaccaggcattcctctgcagtacgagtcctttcagtagtatatacaataaagttcagtaaatataacagggaaaagaaagatttttaaatagtgttgagaaaacaagttaacagttcagaaatcaatttagattcacccttccccacacacatgcacatacaacaaaaatactacaaacaaaatagagttgatagaagctaatcaaatcataggaaagctagcaaaagataaaattatttaacagatctttagagagcttttaaaacttcaaagaactgggatccacaaagaaaaaaggtatcaatagatttaacaaaaattgaaaaaactagaaaattaatttgcttcaatcttgacataaaaggtttacattctatcgaacataaagagttcaccccaacgaaagggaagatattaagcttcatacacaaacaggcaaggacaggaatagacagcttccaccaaaagaactacaattggtaaagaggcatttgaggatatgctcagtcattttaatgtctttgacagtatatcagaattgctttattaaacagtgaatattccctttctccattgaaaaggtgaaggtttctatctacttgcatatcttaattaacaatcctgaataagcaccattcatattgaaaaaatatgattatatcctatttacagtatcagtgcaagaggaggccttagctccatttatagcacctcagacattcccaaccccaaacccacctactatgttgacacatttcctggtgctccaggccttattgttctttgtcggaacaaatgccttgaaatgctgctgtcctcttaactaccatgtagtcaccaccactcccccatgctctcacccttgcttcttgaggacctgtctcagaggctgactactccatgaagactttctttttttttcctttttttttttttttttgagatgaagtctcgctcttgtcacccaggctggagtgcaatggcatgatcttggctcattgcaacctctgcctcccaggttcaagcaattctactgcctcagcctcccgaatagctgggattacagatgcctgccaccacacctggctaacttttgtatttttagtagagacggggtttcaccacgttggccaggctggtctcgaactcctgacctcaggctatccgcccgcctgggcctcccaaagtgctgggattacaggtgtgagccactgcgcccagcccatgaagactttcttaatctctccttctgtaatgtaggctcttagaagatgggatcttcatgtaactggtccttctatcctctacaaatagtagatgtttaatgattgaatactgaatgaaacataatccccccacaaatacggagtagtttagatggggaaagggtgaaaaagattatgcgtacatgactcctttctttcagaaatgaattcgccaccaacaaatatttgtatatattcatcaatatgtgggatagtatgctgaagacaaaatacctgtttatgctctctatttgtctatagacaattgtacagaccagaaggcacctacccatgaaataaataatagtaactgccaggtgcagtggctcacgcctgtaatcccaacacttcgggaggttgaggtgggaggatcacttgagaccagcctgggcaatataacaagattccatctctacaaaaaaatttaaaacttagccagacatggtagcactacttgtgaggctgaggcaggagaatcacttgagcctgggacttcaaggttacagtgagctatgattgtaccactgcacttcagcctgggtgacagagcaagactgccattcattgacttataaataaatacatacgtacacacaaacaaacaacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaattagaaaaaaaacagaattaaagatttttttaaaaaagactgatttgtgtatgcaaggattacagcatttatcaacaaacttactaaatatagacaattcatttaaattatatcaataatatagtattcatatgtatcatctggaaagatggggacataggctctgtattttaaaaatccccctatatggttctggaacatggggcccccataataggcatgaaaatggatttcacatatggagcctttctttacattatgattttacctacttagttgtaatctcttgtcttccattaagtaactgaaagcctggagcagaagtgaggaagtttccctctttgtaacctgagcattttgtggaggataatgcatggactgtaagtcagcttgcctgagttagaatccaggctctaccccttacaagctgtgtgatctcttggtcaagttacttaacttttgctgtttctcagttttctcgtaagtaaaataggggaggtagtcataatacctatgtcgtagacttctcgtgtaaacattgaatgagttaatgcatataagggacttagaaaatacctttcacgtagtaagcactcaataaatgctagctttaattatttattacagcaaaataaggttacttctgtctttgaactgtatataaaataaaccaagcagtttaggtttggctacatctgcttcactcagtattttgtcttcaggattcagccatattcctttgtgtagctgtaattaatttcctttcattgctatatagtattctatacccattttatctattctactattgatggacattgggttgttcacagtttgtgaccattgtgaacaatgctgctataaacattcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtggacatggaggtgggggctaaattttgaaatcaagtacagcaaaaactccaagaggtgttattcttccagaatatcttgagtcttcttggccttctgcaattccatatacattttagattctgctttagagtttccacaaaacctgttgggattttcattcaaattctgttgaatctatgcttcaacttggaagacatcggctgtttacaatattgagtcttcttgtcagtgaacaggataattttctctccatttatttcatttgtttaatttctcttaaaaaaatcatacttttctccacagagatcttatatacctttcttttagatttatttctacattcttaaagaaacactcttttaaaatttcatataacttacaatgattttgctgaactctgcttagttctaattttaacttagattattttggatattctatatataccatctgtaattagtgactgtttcttccttttctattctcatacattttatttctttatcttgccttactgccctggctaggacctccagaataatattgagtttaaattgttagagtggactttcttggcttgttcctgatctaagagttttttaagttttttaatcacaaatacatagttttaagtgttttgacatttattgacctgaccacataatctttcatctttaatctatcagtgtacacaattatattaattccaaatgttaaaagttttgcattcctcgggtaaactcaatttggacctggtgtaattcttatatattgcctgtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaaaaaaaaaaaaaaaaaacttgtcagaaatggcatctaggcctagagttttctgtctcagaagattaaattactgattcagtttcttgaatcagtaaaggattattcaagttttctaattctttttgttaattttggtgagttttatttttctgagaatttgtcggtttcatatacatttttaaatttgtgacataaagtttcagtatcatcttttatttctgcagcatatgaaatgatatctccttcattgttaatactgggtgctatatgtgtcttttctcttttctttttgttatcagtcttgccagagattcatcatttcacagggaacaacttttagctttgttaatttcttgaatatgtttgtcttccatttcattaatttctgcttctatttcctttcatctaatttctttgaatttaatttgatgatctttatgtaacttatacaggtagatgtttagttcttaaatgtttagcccttctctttttttgagtcagggtctcactgtgttgtccaggctggagtgtagtggtgcagtcatggctcactgcagccttgaccttccaggctcaagcaatttggccgtctcagcctcctgagtagctgagacaacaggcccctccatgcccagctaatatttttattattattatttgaagagatgggggtctcactatattgcccaggctggtctcgaactcctgggctcaagtgatcctcccacctcagcctcccagagtgctgggattacaggtgtgaggcactgcacttggccagcctttcttttctaatatgtacatttatagcagtaaatttccctctaagtactgctttacctacattttacaagttttgatgtgtttactgttattattattcagtttaaaatattttctaatgatttattctgagatacatgtaataaaagtatattgtctagtttccaaatgttaggaattttctagatttattaattgctttaaaatttatttatttacttttttagagatgaggtcttgctccatagcccaggttggagtgcagtggtgccattatagctcactgcagcctcaaactcctggattcaatcaagccttccacctctgcctctggagtatctgggactacaggcatgtgctgccatgcccagctaatttttaaatttttagtagagaaggagtctcactgtgttgcccaggctgatatcgaactcctggcctcaaatgatcctctcaccttggcctcccaaagtgctgggattataggcatgagccattgcacctggcctttattaatcatttcagagaatctatttgttgctttgctttttctctattttgtctctttacttcattaatttctgcttattatttccttctaccttcattgggtttaatttgctgttttttaaaacatgtctcatgatgagatgtcactgacttggtaacttttcatattttctaatattttaagtcagcattcacaatatttctattaaatttctaattaaagttttaaaacaagtttatggatacaaactactttgtaagtaccatttcatctgcattctgctttttttttttaacagaactgatttcctatgacaaaagtatagtgcctattcatttttttaaaagtaaaggtaaaaagaagaaaacaaaaaatttcaaatagaattctacccagtctttaacaccccattttaatagcaaaggcttcacactgcatctacttatacataaatatgcatatatatgtttatacatgttaatgtattatgaacatctatgtcaataaatatatgtctataacatcatttaatggcaatataatattctactctagttaccacaatttatgtaaccattctgttgggaatttaggttgcttctaatttctccctattataaatagctgtgataaacccttgtcattaaaacttgaccagtattcctaattatttcccttggaaggaaataattgagccgaaggacatatacatgtttaaggtttttgtcacacattataaaattgcccttcagaaagttgtattggtgtattgttctatcaatagtagattacctactttaagcaaggtttctccagtgccaagttgtgtatgtaacatggatcaccagcttcttaacctgtaagattggacctatgcccctcctcctttcagccatttttctatatttgtgggtctattaatggcaaaaccctgatcttgaaatgtaacgtaccaatcctgtacaagttttgatagtactcttttcattatcattgttaggaatatgttctgctgggcatggtggctcatgcctgtaatcccagcattttgggaggccgaggcagaggggatcacttgaggccaggaactcaagaccagtctggccaacacagaaaaaccctatctctactaaaaatacagaaattagctggacgtgaggtgtgcgcctgtaatcccagctactcgggaggctgacgcagaagaataacttgaccctgggaggtggatgctgcagtgagccaagatcatgccattgcactccagcctgggcaacagagcaagaccctgtcttggaaaaaaaaaaaaagttctaattttcattatgatgatttcttatttgattaattggctatttagcatgatttctcaatttccaagcatttagggttttctagttattttgttaatttatttctaacataactactttgtggttaggaaacatactctgagtactcgtttcttgcagaagtttttagactgagcttttatctccatagtaagcattgaggtttttggggtgttttttttttgtgtttttttttttggtgggtggggatggggtcttgctctgttgcccaggctggagtgcactgacagagtcatggctcactgcaacctcaatctcctgggctcaagcgatcctcccacctcagcctcttgagtagctgggaccacaggtgtgtaccaccacacccagctaatttttttttattttttgtagagacagcatctcactcttttgcccaggctggtcttgaacttttgtgctcaagcaatctgcctgcctcagcctcccaaagtgctgggattacaggcctgagccaccaccatgcccaaccagcattgaggtttttctgtgctaccaacatgacataccagaatttattctgtaccccatttttcatagtgcagctctatggtcccagccaggagcaaagggtgtttcatcagagccttaacctcttagatcaccctggtgcaaaagcaactggaccctgtcattctccatctgaccaccccaccccctcctacctctctagagttcctaaaagtacccctcctttccaaaacccacattcttcccctagggcagaagcagctcttgttcacctctttgagttgtaatcctttctctgttctcaggactagtttttcactcactatactgttaattctcacaagctttaacaaaaactttttgtttgactgggcacaatggctcatacctgtaatcccagcactttaagatgagaggcccaagcaaaaggatcgtttgagcccgggaattccagaccagcctgggcaacatagccagatcctgtccctacaaaaattaaaaataaaaaaattagccaggtgtggtggtgcatgcctgtagtcacagctacttcagaggctgaggcgggaggatcacctgagcccaggcattccaggctgcagtgagccatgattgtgcccctgcagtccagctctaggtgacaaaacgagaccctgtctccatttaaaaaataaataaataattttaaacatttcatacagtttttgtagttggcgtttttgtcatcctcagaaaaaatgctggttggaaaaatccagatttgctctgtacaacagtgttcttcaaggatatttgcagataagtaccaatctgtcaccagtctgccatgagatacatacagaaattgacagtaaacatttagaaactgttacagcaatttgacattgctgtgaaatcatagcacgtgattttgtgccttcaactccagataatcctgttgccaaagcagcatattttggagtggcatattctgatctccctcaatgtgcagccagtaataccttgtgcctcaagacctgtgatctgttttgtttatttgatgagtttggttttggataatttcttaattatataaataatgcatgtttattataaattttaaaaattcagatggatgaaaaggagagacagctaagctcattcataatcccattacttttcacaattcagactaaactgcccttaatttctctctgcatacagtatagaagtccacctcccccatactcttccataggagggtttcttctccctctcctttcattccctcagaatggagccaactaggaaaattcacaatgtgttctttgggggttcttgacagccccagaagcaccccaagatgggaagccaaagagaagagcaataaaagatgccttgtcagtttgtagaatcattatattatcaaataaagtttatcaaagaattgagtcatcaactttgttcaaaaggttcaaggttaggatatcaggatggtatgtattatgaatatgtgtattttaaatttcgttgaataaaatttgcataaataacagtatttttagtttttatttctatatctcatgaaatttaaaattagtagattgcttcttttactttaatatcaattaatattataaataatcaaatagctttaataatagaaaaatattttcacagtgatgcctctctttcagagtaacccttcaaagaatgtgcctgtatatttactaagttgcacaggtggttttgtttgatatctgtggttatgaagcattgaattaaaaaaaaacatataatggctgaaagatcccatttacaatagcaactaaaatataacatgtacagggaaaaagcctaataataaatactttaaaccaatataaagaaaatcgtaaaactataacttagagacatgaaaggaagtggagagacatatcatgttcattgatgagaatattagaaaatgttaatttctagaagttaacctatacatttaccatctgaatcaaaatacaaagattttttatagtttgacaaaatgattttaaaagtcaactgggaagaaaaaaatcataagaaaatgttggtgaaggccagttgtggtggcttgtgcctgtaatcccagcactttgggaggccgaggtgagcagatcacttgaggtcaggagttcgagaccagcctggccaagacggtgaaatcctgtctctacaaaaaaatacaaaaattagctgggcatggtggcaagcacgtgtagtcccagctacttgagaggctgaggcaggagactcacttgaacctgggaagcagaggttgcagtgagctgagatggcgccactgcactccagcctgggtgacagagcaagactctgtctaaaaaaaaaaaaaaaaaaaaaaaaaaaattggtgaagaataatgagatttttttttgccaaatattaaaagctgctactacagtattttattttgtctgtccatgtttttgtttttgttttgagatggagtctcgctctgtcaactggagtgcagtggtgcaatctcagctcactgcaacctctgcttcccgggttcaggtgattctcctgcctcagccttcagagtagctaggactacaggcgcaggccaccatgcctggctaatttttttgtatttttttagtagagacagggtttcaccatgttggccaggctggtcgcgaactcctggcctcaagctatccgcccgcctcggcctcccaaagcgctgagattacaggtgtgagccactgtgtccggccctacagtattttaaatggtaacttgatgcaagaataggcaagtcagtggaagaaagtagaaacctaaaaatacccccatgtgtgtatgcacatgtgtagagattgtcatttcaagtaccagtatttcagatatgaccagacaaaatggattgatccttgctgataattatagcacagggcagtaaataatttccaagtatttctcacggactggttccctccttagtctttatacttctcaccactttgctgcctcctccccaggctccgtcttttccctcatcccttctgggtccctccagaaagtcctctagctctcagaacatctcccaaattctttttggaaacaccagagtccattgaggcattttatttgtaagtatatattacatccctagaaaaagaattccaggattttccctcctatatgttttcatcttgcttcttcatggtccataatgccagctgaggtcgttagtacagtgaatccaaactggtgggataggaacaggttattctgccattttactagatctttgggttgcacatcaaatctgggatctggggctgatcactccacacttgtttaacctacctcaggttcacaacaattttcccagctctatgatcatcagtgatttcaaattcaccaatgtaaccatgcttcatcatcacagttagaaactggacagtaactttggagcacaacctaataagaacctggtgtttgcctctttttggtattgttgatgctctggatagcatcagccaggacattcatgcacaccattatggcagcatggagagatggcagaaagagcctaaattcttattgcttcattatgcaatcagtttagctctctccttttcctaacccctctctcatctaagttgaatcgtgcttaccctcatatatcacaattacaaaggaaaacgcctaagcaaaactgattccttcgctatgagatgttttttagtcctcatagatcaactaaccagcttaaactacagccagtttttaaaatagcgtttcttttctccccacaggacaaagaaatgaaaaatatttactctctgtagtaatcaaggaaatgcaaattaaagcaatcatgaatgacttttttcctcttatctaattggcaaagatggaaaaaaaataatcattatcctagtagagcaagggacacattcacacatggtagtgggagtataaattgttaaactgtttctggtcttgtgtatgtatcaaaagtgttattgtaggccgggcgcagtggctcatgcctgtaatcccagcactttgggaggccaaggcgggcggatcacgaggtcaggagatcgagactatcctggctaacacggtgaaaccccgtctctactaaaacaaatacaaaaaattagccgggcgtggtggcgggcgcctgtagtgccagctacttgggaggctggggcaggagaatggcatgaacccaggaggcggagctcgcagtgagccgagatgcaccactgcactccagcctgggcgacagagcaagactccgtctcaaaaaaaaaatgctattgtatataccccttgtcctagcaactcagcttgtaggaattttaccatacagataatcagagttgctcaccaagatgcatgatcacgttcatccaggctttatttctgatggtggaaaatgagtgctgccatactagggagtagactagaccattataataatgtttatagtagactaggcaactataaacattattttggagaagaatcctatttgacattggaaaatgttccttaggtgtgaaatggaaacttggtaaagtttttagagcctgtataaatgtgaaagtattttcattcatttatataaaaccacaccgagaatcaaataatagaatcaactgttcattaggtgtctacagtgtgtcttctgctgagtattaggtaggggtacattgaaagtataaatatattttttcttgttctttaggactttacactatcatggaactgttgtagggcttaaagatgtgcatttgttccttgcacacccagtaggtatagctataatcaatgggaagagcacaggacatagctagacagagatttcgatcttgtccctatcacatacttgtccactcacttagacaaattatttgaaaatgatgctgacctcatggggtggttataagtatgaagggaggcataacaaggactgcttcctatgatgcctcatgaataggaagtatgttagttcctttactttcccttccagaagtttctatttcctcagtataatatctgcagcaggtatattgggaaactgaactactgaatgaatgaatgaatgaatgagatactggatttaaaaatatgttataagccttaaagcattatgaaaatgttagctgttaatatttgcatagtttcattaatatgtataatatggcaaaattcatgtatacatatataggtgtatgtggggggagggggaggtgtttgtatgtgctaaatgttatggaccatatagagttgttatagaatgaaaagcaaaggaaggcattaatatggctggtaatcattgagggggcttccagggaaggtaggattggaatgaaaccttgaattaaggtaggttttgaaaatgaaaagcaatatatacaaaagtaaaaaagaaaatggtgtactcagggagtgataataagaccattctgcctagagaggaagattttcttgaaacatcagtggacaaggtaggtagaagaggcaaggtgtggccaagacaacaagaggccttacttatctagtaagaaatagaaaactactgtaagttctaagacaatatcgtgacattgcgttaccaacacatctatgtgttacaatatgtttgtagcgatgaactttgggaatggcagtgtaaacaaaaataaattttattttatatatgtcattgttttttccttccacagtatatagcctgaattttccatttagtggtaataacaatagcaagattgttttttaaatccttgtattctacataactgaatatttttggaatttgacttaaaaatatgcacacaaccctagcattgctgttttctgatgcttctttttgtgaaaacctaaagaaaaattatagtcaattttatatactcaatgttatttgatattactgttagcctactcttcctgtttctttccctgcagattttcaatgtgaagatgactgtcatgccctttataatttatgtctatatttcattgaaagaaaggagatttaaataacataacccttagcagtaaatcaactaataacttagttacaatgtattcactttcagtgttgtcttcctggaatttcctcttttcttatgttctttttcacatttttttacagtatggatggagcagatctgtgttttgaaatcgtaaagcgagctgacgctggttttgtgtacagtgaagctgtagccaggtatgtattgtatatctaatcaccagaggtcaagttgaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggtcaggagatcgagatcatcctggccaacatggtgaaactccttctctactaaaaatacaaaaattagctgggcgtggtggcatgcacctgtagtcccagctactcggaaggctgacgcaggagaatcgtttgaacccaggaggtggaggttgcagtgagccgagattgcgctattgcactccagcttgggcaacaagagcgaaactcagtctcaaaataaataaataaataaaatgaaaacgtgggtttataatacaggcttacattttcagtactgctgtctttcccatttctgatgatttttgtacaggaagcggggatctaatagctcaggaaccatgtagaattctacttgggtttttttatttttgttttggcaaatctgcctcattagttcttcattttgccttttagtgatatcaaattatctcacaataattaaggaaaagtaaagaacagtaaaaggaagagaaataaaagcaccatttttaaaaatatatttgcttcaggccagtgtgagacctaccaatcaaatggcagctgttgttctaagtggagaagttgtttgtaaagacctaatgactcaaaataagaaggaaatatgggccgggcgcggtggctcatgcctgtaatcccagcactttgggaggccgaggcgggtagatcacgaggtcaggagatggagaccatcctggctaacacagtgaaaccccgtctctactaaaaatacaaaaattagccgggcgtggtggcgggagcctgtagtcccagctactcgggaggctgaggcaggagaatggcatgaacccgggaggcggagcttgcattgagcagagatcgtgccattgcactccagcctgggcgacagagcgagactccgtctcaaaaaaaaaaaaaaaagaagtaaatatgaaaaatcacaggagccatgcacgtgctgggccacttgcttatacatttagagcaacacagctttctgttttggttacattcaatcataattacccactcctgtaggttgcctttttaatacatggaatacagcatccctccttagtcaccagccatagtatgttgaagggttcaaactcacaaacatattaagtttttttttttttgcggggggtgcgggcggcgggggacggagtctcactgtgtcatccaggctggagtgcagtggcactatctcagctttctgcaacctctgcctcccaggttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattgatttttaaagccacctgtataagctgttaaaatggtgaaaggaactttccagagtggaccagaaaagagtagcattgggaccagtagatgacattgcaaagagagaggtttggaggcagtttattaaaggttcttcctctgaacaataaaaaaaagtaggcggggactcagaaagtattattatgtgtgtttgctattgcagaggatcaatgaccatgcaacaagggcgcgtagattcttccattggtttaatgacagatgacttctaatctttcttcgtcctctctgattctgtgatttattgttaggaaattcagcttgtatcagtattctagtgagaccgactgcaagaagactctgagacaccaagtaatcaaattgataatgttgtttttctccaactggctgagcttcaagaggagcagcaaagcatggcataaaataaaactgtgttcagtccttagtgcaacccaattagttattacctccatcctttcaggggtgatgagttgtggagtgagctaacacacaagatcagattatcaaatcaaactctcagagatcttcttaactagtaccaagctttactaaataatctcaaggatacaggcagtcagaaggctcaagtgaagcagagaagggaagggcagccccccacgtcacttcttactgcctcagaaatgcacctctggcccagaatagatgaggtttatactggggtttgtgggtttccacacacaaaggggagcattgcaaatatcttcattttacaccccagagatttggatagctccattgacattctccaggaagccatctgtgcctcagagatcccgtgttctacttaccatagtaatccttagccagagatatcctattaagggcatttcagagataaggtctcttctgcctagcaaatagcattaggcttttcacctgcattgacaagaatagcagactgaatcacctctcttctaccatgctgcacccctgaaatgcctccttccaaaggcagtaaatgcattgctggccagctttttccttccatggagttattatcttgctgatccttaggaaagataaagataaacaaatatattgctgagtttctctgaaagcacaggtctctatgatgcttcatgaagtgaagttttttgattaaaagtttagtcagcaacttcctagaacatgtgggcagattttagttcttgttttattctgcttgcacactttgacatgcattgcctcgcaggatcatgactgggagggtggagaaagatagttcagttctgttataacttgggaagaaaaacagttccactgtctccacacacgccgcaaagattctgctgtgtacatacgtttgggtcaagtaattgagtgttctcatatgcaaatgaaaaaagcctcattcattgagtttggttttgtgttatgagactttgagataggaattttctttaggttaaagataatttaggtggctgtctcagtgctttgtatccaaaatagttcattctgtgggtacaagctatgtccactttaactaatttaaatttacccagtatttccatgttgacatctagatggacaaataagctgttcctaaatctttgattgaacttaacaataataatattgtactaataatgtcttaacctttgtagcatggtttagagtttacaaagcactttgacaggtgtagtctcttagccatttcaaggggttacagatcttccaaagcctgatttgaaccagtaatgggccacaacaccaagttaacccctcatttgaacaaaacttatggccaggcgtggtggctcatgcctgtaatcccagcactttgggaggctgaggcaggctgatcacttgaggtcaggagtttgagaccatcctggccaacatggtgaaaccctgtctctactcaaaatacaaaaactagccaggcgtggtggcgcatatctgtaatcccagctacttgggaggctgaggcgggaaaatcgcttgaacccaggaggcagaggttgcagtgagccgagatcccaccattgcactccagcctgggagacaagagggaaactccatctcaaaaaataaaaataaaaaataaacaaaacttaattacaggctacaatggcccaagcaaagagtatatgagcacaaccccttatatgtgcatttgcaaagtaagataaattaaaacatcagagctaatgattacatgagcctagctctctggcttaaagccccgttgtaaggagcctgtgattagtacaggaacaaggcttgtgattagtacaggaacaaggcttgggtttgtttttgtttttgttttttctcctacctttcatttttaaaatggaacctttccaattaattgtaatacatgaaataatgcatatgctaactagagaaatattcctgtgagcttgattaaatggtatcatgccaaagagggaacttgatggaaatgtcttttaattgtaaagccaggatagggattttttttttttttttagtcctgagtcacatacacatgttcaaggtcacttgtatcagaaatataagatctggaaacaaaacaaaattctataaatattatacagtgaacagtgttaagtctattgcatttctgtcatgctggttgggaaggaaaagggaaaaaatgagaaaagaaggggaataggaagaaaagagacaaatatggagggaataaaatacagaaaatgaaacagatactcagagaaagagtaatagggcaattatagaagaactttagaaataggagaaggaggttctaaagtggtactgaatcaactgctcttgtcacacatggttgctagttaaccccattaccattttttaattcctgttctttaaaatgctgatttcttctttgttcttcacctgtgctccatgagggctcctcagctggccatgtaaggagtcaggctttctaggacatgtgcctagaattaactccactttgttcaagggagccccaactaaaacttgattatgttacaaaaagaaattgtccgataagggtggctcttccctcatttgtcctcacagctaaatagaagtaagatgaagagcatcttattatttgctggcagatcaaaggctcccactgcttgagtctgaatccttggggcagccctgagcactgtttacataacgcagtccagtttaagtagaattacctgagtattggggaaaaaaattgtcatgttttaagcttgaatttttagtttgcaaagcaaatttacttatgaactatgtgtaattcttttgacttagatagcttagaaaatatagagcatactatttcttcatgaagcccataaacttttgagtctgccaacattttcattattaagcctcactttacaccaatcctgtctgctcaaatcaaatgtgtccatggacagctaatatgagagtgggagttataaactaggagcactgtatattaagttttaaaataaaaattgtttacagtttttagatttcttttgttttttacagccattatatgagacagatactggaagctctacgctactgccatgataataacataattcacagggatgtgaaggtaagtcatttgttatcactaactttaatgtttgtgaagaaatactgatataacaatgataatcaagaattcttctttaatattgtcataaagaacatcttaattttacttctaagtaaaaatgtatttaactgctttgtatttgggaagtcattgtactaattcttactaggaacactataatttcaatttatttatttttactgaagtgttcatgcaatctaaaattgtattatttctcttttgccattgtgtgtgagagagaaatgaaaaatccaataaataggaaaaaccaaacaatatcctatactgagttaattgggggggaaattagaatttggtttatatagtaaaagttaatcataacatattttcataatattgcaatgcagaatagtcagcattgtatttttttgcagatagtttttaaatatagtatgaaatcataattatacatgtaatacgattttatgcttggaataccggtattatcattattcagtctttctgcctatttcatcccagtatcgggttaatgagaactctcagttcctggttctttaacggtgtcaagccaaacatagagggaggcaagaaatgagaccagtaggccttcctcctgatccctagcttctcccaaggcccagaatcactagggagcccctgaggtccctttgaccctgggctacacttttaagctctgatattttgtcactggcctttctctaacctccagcatgcacatacatagtgttccttccctcaagatatattattaaaggcctggcttcttcgatgtatttaatactttaaatgattaagaaaattaagtagagtttaattaaagtgtctataatgtttgggaaattttcacagaaatccttgtagttaaaagctgagggaaaacatgagcaattccaaaaccatctagtaaaatattttaatagcaaatgaaaatcactggagaaatatacaaaatacacattagtgtaaattagttgtaaaatatctcactcatccttttcagatgtgttaagaaaatgatattgttattatcagaactcaacaccgagcatctcaatgggtccccctttatgaaaaagtattctggccaagcccggtggctcatgcctataatcccagcactttgggaggccaaggcgggtggatcacctgaggtcaggagttcaagaccagcctggccaacatggtgaaaccccatctctactaaaaatacaaaaattagctgggcatggtggcacatgcctgtagtcccagctacttgggaggctgaggcaggagaatcgcttgaacccaggaggcacaggttgcagtgagccgagattgtgccactgcactccagcctgggcgacagagcgagactccgtctcaaaaaagtattcttcagttatccaaaaagaaataaaagtgtggaaaggtaaaaggcgggaaattgtcaactgtagtagtttgctgtgcagttattttgcattaattaatgtaagaaagttcatatgtagagagtaaaatatatctctttgtatatattctaaactatatacaagaaaaaaatgataatttaaaaacctaaaatgtgttcatgtaatagcattatgttaagaactgttttgctcaagaggcaattttattttgaatgaattattctcgaaagataattatatcaacatcatataataaacaatgattgacaatatattctactgtaatactttcaataatgtagtcagcttttgattaactggtatttgatatgacaacctaaacctaattaatatccaaaagtagataatttgacctcaccttttaatttaccttctgatttatttatttaacaaatatttgagtgcctactttatacagattactgtgcttggagccctaaaagtattatggtctcagtagggagataaggctcggtatctcttatctactgtagcagatcaacacatgccaaaacatagtgacttcaatcaataactgctgcttacttgctcacaattctgcagtttgggcagagcttgataggactgctcaattctgtttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttagggctccaaaagagcaaaaatggaaggtgctaggcctcctgaagcaaactgacactgtgtcacatcttatgcatttcattagttgaaacatacttcacaaaaaggtcacaaggctagtctgagttcaaggggaagaaacatagattcatattttgattgatggagtgccagatatatacaaggatgggagaacttgttcgtggccacctttagaaagacaaataattattgtgcaaggtagaaggtgataagtatcattaaaagatgaggtcagagaagtttcctgggggaggtcacattggagcttgttcttgaatcatggggtagttatatggagacaaaaagacatttcaggcagaaggaacagtttgtgcaaaggcccaaaagtagtcttacgttggagtatgttagattagtttattatttctaaagtacatgctaaatagtttagaggaagcacgtagaaacatgccaaggaatgaaaaagaagtaattctcaaactgcaaataagtaagaagaaaccaccccaaaaattgccattgttcagttgggagacacactcaacacagagcacacgttaatgttgatattctttttttgtttgttttttgtttgtttgtttgttttgttttgtttgttttttgatacagggtctcgccctgtcacccaggctggagtgcagtggcgcaatctcggctcactgcaacctctgcctcctgggctcaagcaatcctcatgcctcagcctccagagtagctgggactataggcgtgcgccaccacacctggctaaattttttttgtagttttttgtagagacgaggtttcaccctgttgcccaggctgctcttgaactcctgggcttaagcaatcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattctcattctctctctctctctcataattcttggcatatgatccaaaagcattacatttcccaaggatcctgttattatatttattaatacttttttctttacttttttacaaaaggtatttccttttgtaatcattgtaactgagtcttaaaaggattatttggttagatttgaatatatggtaccatgtaatctatttttgggaactgcttgctctgaagaagcagtttcacataaaactgcataaaaagcaatcatataatcctttgaaattcgagagatgtgtgaacatagtgctgggcctccccacagccacacttagtgacatatcaggctatattctttgctgtgggaggctgtcctgggaattgtaggatgctgctaagcatccttcacccactagatgccagtagcatctccccctagttgtgacaaccaaaaatgtctccaaacattgctaaatgtcccctggggcacaaaaattgtccctggttaaggcccactgtcataatagactgttataattctcaagatttgcctccctacaggtattaattaaggcatgcatataaatttctatttttttctgtcatcttcttccctttaattctactttttcttgtgaaagaatgtgaaaactttcattatgtttctggtatttttttttcttcctctcacccctaaattaaaagtactttagaaagaaatagcacagttgtcaaggtaaatgcaactcctggctctttgccttctttcatgggctctactaagcactgagagtttgtggaattttctcctctctcctaactcttgcaggcagccttagatcatgaggttgtggggagacttagttttagacctttctgtcactctgacctactcatgtataattctaataactgaagttgaagtgaaacagtttctctgagaatgcaaattgctacccacaatcactttctattctgaatggtgcctgtgcccagaaggtctgggtgctgtttttagttcttagaactgtgcaaaccccagtcacacacacactcagccagaggccagagtgtttctgagtgtgcttcctttaaatggttttccttgctaacctgtgtgaacacgcctggctgctttttggttcccttctggtctcagttctccttttacctatttaaggccagactttatgataaatttgtgtttatcatataacactggttggcatgacattgtggatttcttaaagcattccgtagtctcttgttctccgttactgatgtttcttttacacctgataccacaactccccaaagtttatcatgttgtatagagaaatttaaattctcataaaacaaaaacgtatttattctttatttattttatttatttatttattttttttgagacagagtctcactctgtcgcccaggctggagtgcagtggcgccatctcagctcactgcaagctcaacctcccaggtccacgccattctcctgcctcagcctcccgagtagctgggactacaggtgcccgccaccatgcccggctaatttttttgtatttttagtagagacggggtttcactgtgttagccaggatggtttcgatctcctgacctcatgatctgcccgcctcagcctcccaaagtgctgggattacaggcgtgagccaccgtgcccagccactattctttattattatattaacattggttaatcttctgcatttcttttataagattttttaacataatgtgcacgttcagttttaatgtggcattttaataattgtacttaggaagatctcatggattacatgattattataaatttatcttgtgtttctaactgctatacttctctttgcccagcctactcctacaaaaaaagaaatcaactccttggttttaagtttctcagcctgagcaacatagtaagaccctatctctctctctccttttttttttttttttttgagatggaatctcgctctgttgcccaggttggagtgcagtggcacggtctcagctcactgcaacctccacctcccacgttcaagcaattctcctgcctcagcctcctgagtagctgagattacaggcgcctgccactacgctcagctaattttttttatatatatattttttagtagagacagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtgatccccccacttcagccccctgaagtgctgggattacaggcatgagccactgtacctgactggaagttgtatttttttaaaactcctaagtccagtgagattattacatgcagtatagcttatgttaaacaaacattactgtcttagtcggatgagttttggtctcaaaactcatgtaagaataaaactacttagtctgggcacaatggcttgcccctgtaatcccaacactttgggaggccaagatgggcagattatttgagctcaggaattcgagaccaacctgggtaacatggcgaaaccccgtctctacaaaaaaataacaaaaattagccgggcatgatggtgggcacctgtggtcccagctattcagaaggctgaggtaggagaatcacttgaccccgggggggtggaggttgcagtgagccagatcacgccactgcactccagcttgggtgacagagtgagaccccatctcataaaaagaataaaactacttttgtaactgtggagaaatctgtgcatctcaggaactctccctgatggactttgagttactctatgatttacatgtctagaaatcactagattggacacttccatttacagctagcattcagggcggtcacctcaagttcccaaatctcctttgtctctgcacattaatgagccaaaaatccaattactactataaacgaattgatactcactgtaaatatttgaagccagaatgtgttcagacttttctcagaacattttcatgtctcagttaagcatcaaagtagaaaaggaaaaaaaaatttactgggtttttgtgtgtgtgtgtgtgtggttttttgtttgtttgttttgcccccggaataacctctggtgatttttgaacacatggctcttgggcaatgtactgtgaattgcttttacagctctaactcaggaacaaaacatgctatgagattaaagccttggaaggattacgtgaacttactttaaacttcattttggacactgaagtaattactatgtgaagaaaaaaaggagtctttaagcagtctctaacaaagtggcaagttactattaatggttgattttattcagctgtttttgtttggttatctgagaagagaatatcagtaccatggaagtagaaatagacaagaagtttatagctccaaagtgcttatgatctctttgggcagatagtacacgcttttttttttaatcataatatatgtacttattacagaatatagtcaccatcatttgtctactgacaagattacatgaaagaaaagaaattaacattaagaaatgcttatctttaaatgttcacttaaatattagaaaaaattggggtgatttacttaactatgcacatatacatacatacatacatatatatatatatatatatatatatttttttttttttttttttttttttttttttttgagacagagtctcactctgtcgcccaggctggagtgcaatggcatgatcttggctcactgcaacctccgcctcctgagttcaagtgattctcctgcctcagcctcccgagttcaagtgattcttctgcctcagcctcccaagtagctgggactacaggcacacaccaccacgcccagctaatttttgtatttttagtagaggtgggtttcgccatgttggccaggctagtctcgaactcctgacctcaggtgatctgcccacctcggcctcccagagtgctgggattacaggcatgagccaccgcacccagcccacttcaatattttcatcagtaaattagtatactttagagttgtggtgattaaaataatatatgtaaagcatataagtagaatgcttggcaaacagcaagtgcttactaagcgttagctactcataatagtaacagctgatttaataataggatctgtaaataagatagtattttctgctctacaaatgaagaaattaacacgtacagaggataagttaatttgcctaagattgtccagctaaataaaaagtagagccagattgaacccaagaagtataacttcagagatcaatctcttaactgcaatactattacactcccttattattcattcatttatttcacaaaaaattaactgccaggtactgtttgtcactaataacattatttatattgaatacagaagaaaatatgcacaatgtgatgaagatgggcatataatgacatagctttttactttgacaaagcctaatccaaatatttaagcatttttataagtatcatctgctttaaaaatatagtcaatgaatattgcttctccccaataacatgagccagataatttcaaataaataatatgtttataaaaccttggatttttttcactgtattattcatgcatttaggtaagatgtgaatgaggatatttcttatttatttttttacttatttttatttttttgttttgttttatgagacagagtctcgctctgcctcccaggctgtagtgcagtggcacgatctccgctcactgcaacctccgtcccgggctcaagcgattctcctgcctcagcctcccgagtagctgggattacaggcgcccaccaccatgtccagctgatttttgtatttttagtagagacagggtttcaccatgttgcccaggctggtcttgaactcctgacctcaaaatgatccacccacctcagcctcccaaagtgctgggattacaggcgtaagccactgtgcccagctacttatttttaaagattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccattggaaacctttcaggaaatagatactcatgaaaggcatggcactgcacacaagtaagtttgcagtcacaaggtgtgacaggtagatgtgcgttgatgtttttttacctatttttgttaaaaatatccattgagagagagtgtttccaaaaacaccaacaatacaaaggaggatgtaaatgattggtaaagccatggaagagatcatagatggttgaatacatgttgtattgttgttcatttatgtcaggttttcttgaattttgtcacaggagctagaatagaattgcagatatttaatattaaaattatttttggtacagtatttaagctgaatagtttttaaaaaagaaaaacattgaattaaataaaatagtaacaaaaatgtattggatggaacgggaaagtatagatggcttcttaccttttctaatcacgattgtccggttgaaataaagacaaaaagttacttattgtgatggataatgcctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaacataaatgctggtttttacttttttctgtcttatatttaaatctttctcgcttcaaagggtacacatgaagtgctgaagaatcatatacaaactgcttttattcttatttttctccttatttcctcacttctttcaggtgagaataacaaaagttactggattctggtcaaataagaaccatgatctctattcagaatgtgccatattctctgtgttcttcaccatagccttctgagcaccacattctccactctttcatgatctagagcaaggtttctcaatcttctttttaatcatgttctcttttgataaacataaaaactgtaccatacacaaccctttgaaattcttatatccccccagcccctcagggcaattttactctctacccccttcagaattatggtttgatttattttctgcatcttggattacagaaattggggttttttttcaaatatgatattataattttataataactttttaaaccaatccacacccaaagtcttgaaaacttgaggactgtgcagtgtctgtgggtttaaataacaagattcttaattaatgtttaccactgtctttataattttatttctttgctatttttatttagaaaacagtccatatgcttcattgtaagtttgtatctgaatctagtgcaacctgatgaattataatctggtttcagttagtgtagaccctggtataaatatataaaacctaatctgtaacttcaccagttcaaaaatcagtcagacagtgaaatgagccagtttatttaagaaaaaattatctgctcacagtaggttttgattttacataaggattggagcttccttttatgatgctgttaaagaaaagcagtagctcctaccttgtgcagataatgcatagtatactaaaaactgcaaaggtaatggtgcttctgtatgaatattaaatgcttccaaacaaaagggacatagacttctgcagaggctagctttatcagacagaagttgagtctctgtaggactctcagtgtagcagtcaacaactaggtcaccatctttaccttcccaaacttgtatctactatgtacatctccttcaaaaataaacttggatcataaaactactagataactattttccagaatttggaaagtactattaagaaatcaaataaaaattacatgttacagatgcaaaactggtctccagaaaatgtctctaagtctatattcccctcaggagaatgtctatctcaagtcactcatgcatacattttgtctctgctaatttgacaaatgaaaaaagttctacaactcttaacttcagttactaatgactgtctacatagttaatatgctgactgcctttcttaatgatcagctttcaaaatttaaaccattaggtcctgtttatttttatagagtttaatttttaagctaaaaatgaataataatcactcttacctgtatgagtagtttatgccaactaaggttatattgttcagggcagtgatgccaaatttcagacttaaaattctctgatcttcactcttccaatatctttagtcagtgtgaatagattcttgcatgacaccaactacagtgggaggaaaaggggaaattaaacagaatattgaagaaattcaatagttatggtcaatgtggcaactgcctcctcaaaaaaccctcatttctctatttctgtagtgggaggaagtggtgaacaatatacatattatacttccttatgattatttcatgaactagttacactccagtaacctttgtttgcacgattgactgaagttaagttcacaggtttaatcccccatggccagttttatatgacacagtgatagaaggagccactctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattgaaagatagttgtaatattatctgttcaggcataagcgtctttggtccgaaaaaagaacgctcttgttttcctccattgtctccaaactcagtaaatgataccatcactccttcagttattcaagccaaaaacttacgaatcatccttaattcctctttctttcacatctcacatctaatcaattgctggtactacagcttctactatcactaccatcattcattagccacatttcatgagagcttactatgtgccagatatctcgctatgtgccttacatccaagtcttatttggttttcacaacaccctgtgaaatgtctcattttaaaggtgaggaaaactgaaactcagaaagatctcataagttgcccaaggtcacacagccatctgtcctcacaggatggtgattggctcacctcaaagcaactaattcaagaacaagtccatagctgcaatgcctttttgtgatctagcctctgaagtcaacagtgtcacttctgcagtattctattggtcacacagagccagccctgcatcagtgtgggacgggtaaatatcaggaggtgatgatcactgggagccatcttggaaactggctatcacagatgtcaatcaaccgttgaaacaaaggaagagtcagaagtactgcttaaaaaccgttgtcagtccactggttgtttattggacaagcatacctggataggtgtaagttttgccagttcttacactattttggtttttaggtctatttttgttaaacagtgtaattcattcaacaaatacttattggagtttctactatgttcctagcagcatgtggaggtcacagaagtaggatgtttagtcacaagctaattgagggtctctggaaattgagcagattccacaagcaagccaagaatttagattaatatgtgatacagatttcaaatgctctgtgaattagagaagggcagaaacagtgactcaaagtggttctgaaaggctttgtgaaagcaaatggaaggaaagagaggagaacataacctagtaagtgacagttttgtgccaggtatgggacagagcattttatgactaagaaccctagagatgtgtggtgggagtcccattttacacgggaggaaattgaggctcaaagaggttaaatagcttgcctagaggaatacaattagtaaattagctttaaaatgacctcattctctgccttagaaagaaattattggttgttctagcaggtcaataagggtaccttatggtactcacaatagggtcatgttttaagtatttttaactttgttcagatagggtttcctgttctgatttatgtatttgtgtatcctgttctagacttgaggtagcagaaactgaccatggaagaaatcaagtccagtttttttctgtctttgaaaactctggactttgttaagcaaactattattccaacaatggcagtataaattctttaggattcagtgattttgagttccccaattgaaatatatgtaaattttattttcattcttctaagaaattaggaaatattgttacaattggtaaaaagagtaaatgtcagggaatactagattaataaagtatgttacaagtattctgtaaaagtggcccctttggacttttctcattcaaatcaccaatagttttctttggttctcattcatcttgcccatccgtctcttcaaggttccccttctattgtccaagtccaaatgctcttggcctaacagttctagttgattcctgtatcatctgccaaatattgatctcctaagtgttctgctgtcacccttaggatttacttccttgaggtgttagagttatgtcctacaattgaagttctgtcttgtattaattttcctgcttttgagatggatttgtgtatcaagtgtgttttttaatctggccccaaaattcatctggagtggttcagtgagagtgtttcaaagggcaggcatatacttacctggcagaggagataccatcatcaaagggcaggcatgtggacatttattttggcaatccatggtgggctatacatagcaaggggacatgagagctttcctgactcacatggattgttggggttagaattagggtcccttatcaatttccctcagagccagaacccagaggacacaggacagcttagtcattcctgaagccatgtgcttcatctagaaattattttaggctatccaaactagtgtttaaactggctgcaactggcctcttaagtactctcactaaccaatcaggagctcagggcattgggaggctggtatgcagaaagagaagacatgactaatttagtacacattagaatatcatattcaaaagataattatttctttaaatcaggggcagtggtaagtaagccttgtccagttcaacatacacccaagccagtggttatctttaggaggagtgagacacagtgcagttactcaaagctatggtttgttcaaggctcactgagccccctgccctctccaggaagtggtgtctggccacagccttgtttccagtcacactgttctcaggccctcaccgcctgccacaagcagctctgatcgtgggtgtcccacccttaatcagagtgtgaagaaaaacctctccttgttctgaagagctggtttctcagcaagcaatgggagcgtttctctcaagaattacttttaaaaacagcagaaaatacagtctgaagtttgtaaatttataataacacagaaaagttatcagcttttgtaaaaagtaaagcagaggttcctcttcgaagactttcctccccatttaattaggaataaatagtaacttctcttagaagtgaaatttattcaaagacctgtgctaacattcttaaatatctgctagccgtgataaagaaatcaatgtactttatgttcttagctcccacaatttagcctaaatatttgccctggcatgcttatactggtgcaagcaagcattgggtcatagcctgttcctcttccttatttgcaggtttttacttttctcagcattccacaagttacttcctccttcttttgttctcctctgcctttgccttttttaagaagttctaagttgctagccaatcgggacagatacagaatgcgaggtcccgttccagccaatggaaaccggacacagcagtagggtggacacgtcagcttataaatgaccctgtctcctttgttcagtgtactcttgtggcaaaactgctggcgagtgtaccctttctgcaggaagtaaaaatggccttgctgagtaaattaaatttatgttcaagtggtatttctttatggtaccggggaacaagcatttcaaacgcttttaagaaaagactaatgacaaaacagaaatggacttggtgagttgaaaaacacatacacaaactcaaagggcattttcttattagtttgcatttccttgtgcatccagtgaaccaactccccaggagttggatccatctctaaattccgctagtaacttcaccttcagtaaccgattgcagcacagctgctgctccaaactgtgggtgaccacccaggaattaaaggttcctcatctcccaaccctttcatcctttgtcttaccaaaccacatgtttccatgaacctgaaccagggccattccagcaaaccccacttcattgacactgagaaagagtagagacaggcttggcttcagctcacctccactagagcactcccactgatcacaaaacccacaccactacctcaaatgctaatagttcttaaagaattccaggaattggccttatgagataactaagattgcctcaggaaggaatgctgaacaattgatttacagccttgttgccacaggccacgccaccaggtggcccattactcaagataaccatagcaaccagatctgctgacctgctttgctcagcccagcctgcatacccttcccctgttaccagttcctgcactttgcctaataagaaagccctatgactcttttcagaaggaagcccgggaattctctctctcttgtgctgcctcccttttgtttgggcataagctccagtgaagctttgtctatgaaagcgcttttggcctcatatcaatttctattgcattgagagtccaagaacccatgatcggtaacaatgccaattgagggtagaaaaaagaaaaaaaatcacacacaaacccaaagtgctttttctattctctcattcaacaagagtctaaacagatgacctctgtgaccaaatgtgtggggatttctcccaatgaacaagcaagcaagcaattcagtggacaccagctgtgtgtcctctaattcagttctattctgacactatctacctggagatagcgtcagatcccacaggttgaaggctgagtccccaagacttcttcctaccttcagatgccagtggcaagccccaggttgtttcacctgtgcttctgaccgacaggctataaatcaaagatcccacagcccctctttgggtccaattaatttgctagagcagctcacagaattcagggaaatacgtttaccgatttattataaagtatattacaaaggatacagttgaagagatgcatacagtgaggtgtgggagaagagagggacgtggagcttccatgccctcctgggcgtgtcaccctccaggaacctccacatgtacagctatccagaagctccttgaaccctgtcattttggggttttatggggacttccttacacagccatgattgattaaagcactggctactgttgattaccttaaccttcagcccctctcccctctctggagggttgggagtagggctaaatgttccaaccttgtcatcctgccttggtctttcctatgaccagccccatcctgaagctacctaggagctgccagaccgcagtcacctcattagcatacaaaaagacatcactttggagtttttgaggattttaggggttgtatgccagacaacagacgaaagaccaaatatatatttcatagtatccagtccaccctctgtcttggatccctcacatcaaaaggatgtacaactcaaaagataccgccaaattactagaatctcattcaatcagtaataatcagtccagcccatcatattgtatgaatgtctcccaaggcgaggccactcaggtttgcaggcttccattcagtcttgtcagagtgctctcggcaaacatatagcttcaccctttacagcagctggtataattaagctaggagacagatatcatttcttgctctaagcctctttcaaggtattaatataatactgggtttctttcatttcataacccatttattctttactctcactactatttttccttatctctataaactcccaaacttttccacctttggatgggacaatagaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagccccactcatgttgaatgtgagcacacacttgcgaaggcaaataaggcagctcttcgtgctttcatctccctctgttttagacaaccagtgttttcattgcctgttccactctctatcaaaccgttactctgaggaagatatctctctgcccattgctgaacattataggctatataatgtgttcctgggtctgaagaagtgacagccatccaaatctgtgcaatatcttctgctctagcttttatggcactctgagcaaactattattctgagaagaatatctctgcccactgctggaacattatgggctgtaccgtgtgttctttggcctgaagaaatggtgttcagctctccaaatatgtgcaatatcttctgttctggcttttttatggtattctcatcattcacatcttccaccgggcaagcaaagcccagtccagaatcagtgtctactcctgtcaaaacccatttgtggcctcccagggctaccagcatcagcctcacttgccagcttgttcagggctttcccaccagggaaatctgccccacagccatgggcaatgtctgtctcttttgctggcagacagaacagtttttattggcattttgtgcctaagatggtgcaaaagaaacatgtctaaatgcagcctatctctgcactgttgcagtacccgtttatccactcatttcacagacccaggtggccacttcaagggagcacccagggttgtctgcttgtgatatcaatcactttctgaaccaggatcttttttttttttttttcaagtcagagttttgctcttgtctcctgggctggagtgcaatggcgcaatctcggctcgctgcaacctccgcctcctgagttcaagtgattctcttgcctcagcctcccaagtagctgggattacaggtgcgcaccaccatgcccagctaattattttgtatttttagtagagacggggtttcgccatgtcggccagggtggtctcaaactcctgacctcaggtgatccacccaccttggcctcccaaagcgctgggattacaggcatgagccaccacgtccagccaagaaaggagctcttctgatgggcattgacatgttctactttaatgcactcctcaaatttccatagggccattctccatatgggcatccctttaataaataggccaggtttccactgcccttctgcctgaccatgtggccaggccactgagtcagtaaaaaaatcaaacacaggggtttttgctattgttcatttctgcagaatgcaattcagccaccaagctaatttggtcttaccttctttgatcaagagtggcatccttccaaacaagattgttcaccttggaactgtcatttacacaccaagcaactctttgttggtcagttgagagctgtttacggggccctgtccaagtctcagtagaatcccgcagttcctcacacagttccagagtcagtcctaggggaaaagaggctccctgcatgagagtatttcctctttgcacttcccagggaggatgctcctgtataaaccatttccattttattatggaagtgttctgggcactgccatccccatttgaatgtttctctgacatcatgtgagaaagcatgggtatttcaggtgtcaagatcattttatgtccttcagtcataggggttaacttcagttaatgtcccatagcaaggtagtaaatacccccaagtggaaattctctactgcaaagtcccagtagttgtcactgggagatgctcacagacttctgagtaagccccagtaaacgctgacaaaggggtagcaaatggagaatttgtccctatgatattccagcttctattctacagattgtgggcttgggtaatcttactggtttgccatttagcatgttcaattaatattgctacaagggtgttttacaatacaaggtaagagaaacattccccagtcagacacaatatccccataatacagtcaagtgaaagagatacaaccacttcatgtaaagtgtgttcaaatgtaccaacttaccttaattttctcaatgcttactttcctaactgtagcctctattacgactttaccaacaggttttgagtttacagtactaggtaggggaagtgttccccacccagacataatatccagttccatcaaacattcaggtaaaggagacataacttctttacataaagcctgtttataaacattctaaatctcgtattcctaccaacccttactttctgtcccagtcccagaatttctcttcttcactcccagaccattttaccattttctccttagaaaaaagctttgaatccccagcagagggttgagccaagggaccttagcccttttgtcaatctttgtcttgattaacctgcctcaacactgctccaagtaattgttggtcagctttctcattgtaatctcttcctctcattttttcaatttctcctaactgggataaatacaccaaacctgtttggatcctcttaccgttaggagaacagcagaatctccctaccaaccttctatagtgatgacctttgttttaaccccatcgatttccactttattcatcccattttttaatagccctctaaagactctaccctgcttagatgagtcccatgactctcctttctttttcctcttagtttcaccccatcaatgttttcttcattcaccttatttctcaataaccatttagactttccaccttcctgggatgagtcctgtgactctcccctctgcctttccccagtctcttgttaattacgctcatgttttcattggtgcccatacaaaagaggctcccttagccatagcatttactacagccagagtaatggatgtattcagtgagtgaatatctcagtcatcataaagccagtcccacatggtctacataggaagcaaatgagctgctgcttcagggtacaccacttggcatttataggtgaaattggacagtccccttctcagggtaaacaggtccagtccaccacgctggccattcccttggaaataacctcctgtgtgtctggaaatctacctttccatctgtgattgttcaataatgaactgcaggtcctacctcaaccaaacatgctcttccactcttgagcatttaaaaccaaagaaactgctctgacagttccttcacagtataccctccagtttcaatagtttatcagttttaccctttccccacattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagggctattatttaaactataaattaaattccttcccaaggctagtttggcctatgcccagtaatggacaaggacagtttagaggttagaagcaagatggagttggttaggtctgatatttttcactgtcataatttccttagttacagttttgcaaaggcagtttcaatcgtaaaggtacttcagtgtccttgcataatttttccttgggggtcagctttgaggctagtggcctgggctcagacagacaaagtctaacctagcattctcctttaatttcatttagctattagagataaacaccaaagaatttagtatttcactttttcatattagtctgcataccctcatgcaaccagtgaaccaactccccgggagttgcatccatctctgaattccaccagtaacttttacctttagtagctgattgcagcacagctgcagctcaaaacagtgggaaaccacatggccacccaggaatcaaagattcctcatctcccacctttttgacgcaggatttttcttggccactttgccaatcagggacctccatggccagcaacgcccccctacctggcctttgcttggccatgggcctgctgaggcgtcaggcccactcaccccacctgtgctatggcttgtacctgcgttcagcagttcccaagctcctgtccttatccacgaagaatgaggatacgctgacaatttgaagggtgaggatgggtagggaagaattttattgagcagcagaacagctttcagcagagaggggacacgggtggcccccccacccctgcagtcgggtggtttgtctctctcagtgtggctgggtccatggtattttatggattcagaatggggcatgtgtgctgattggtttgtgagtatgcagaaaaggttaaagcgaagacaccactcaaaggtgggcacaacagtgtagaaaaccaattagggaagggtaggtatatgtaaaataggtgaggggcggggatcaatcagaggaaagcacaccaaacaggaagacaggttctcaatccagtccatggatttacccgggacatgtaggtaggctttaaactgtcttcagcttgaaggtcaatttcactgaggactcgcccctatctgtctaggcattttgtctgcctcctgctgctgtcactttcattctttctcttcccaaaccacatgtttctgtgagccaagtccattctagcaaaccctacctcactgaaaccaattcatagtttggaaggaaaacaaaactcacaaagtacttttctactctttcaacaacaattaacacagatgatttctgtgaccaaatgtgtggggatttctccccaaccaacaagcaagcaagcaattctgcagttgacaccagctaggtgtcctctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctcacagaactcagggaaccagttacatatacccgtttattataaaggatacagatgaaaagatgcataatcctggggcacggagctttcctgtcctctctggacagaggcaccaccatctgggaaactccacaagttcagctatccagaaactctccgaacactgtccttttgcggttttatggaggcttcattatgtaggcatgattggttaaacgattggccattggagattaatttaaccttcagcccctctcccctccttggaggttggggatggggcttaatgtcccaaccctctaatcctgcctagtctttcaaggctaccagcctcatcctgaaactacctaagggttccagccatcagtcaaccattagcatacaaaaagacatcattctggagtttctaaggattttagcagttgtatgcctggaaagagggttgaagaccaaatatatattttatagtatcacagacctgatcatcaaagtttcactatccttcagctttggcttttggcttttcatataagcttgagtgtgctggctaaacattgtcttttaggaatgcacagcatagaaactctagcgacttcagtggcagtcataagaactggaatcatttcaggggtggtagttgaaaagcagacaggaaattagcaggtttagaataggggagaaactttagcattgaattacgtgaggcaaaaatatatttgagggacaaattttgaattttgacatcttcaaatcagtcaaacttggttcatattatgcttcagaactaaccattcttttctgtagattctttaaaaagccaaaagtagataaagatttctatgaataaagcagttgaggatagaattccaaaaataatgctgttccattgtatcaccccaggtacaaaacacacacacacacacacacacacacacacacacacacacacacacacacaaaatctataccctgggaaacagtgacttggattgcagtgagatttagcgaatttaaaaggcatcatatatcagtgcccagaattctccacttcactgtctctttctagggccaaggtttcctggccattttattaccaatcacttcttttgaatttctagatacaattgtcttaaggtgaagtcccctgctccatgtaacttcctgtccttaatcaaggggaaaaaaagagatagatgtcaagggaagagaaagaagaattgaatatctcatgtcttccctcctatacccattagtgtctgtattcattttctcttaagcgccccaagcatgaaagtcacaggtttctctgagaaccacatttagaaaattaataataataagtgacagccactgatctgcttttatatatatattcatataattttagaaatatctctgagatagattctattattactgtcactttctagatgatggatgtgggtccacagaggataacttgcctacagtgataaaactgctctattataaggtctagatttgaacccagatagtctgactttagagcccacattctttactgttttatatggactctcataatatatgataatactcaatagaatctagtttattgctttaaataaggagaccagctatccccaatgaccaaaaatatatctcatttatgtacttgtttccaattttcaatctcgagatttattaactcctgccaactctccactgtaaaggtaccctgttttcattgtaattgataagtaatctgaaggtgatattttaagactctatgagtatactgtgtttccctttcacccactggattttgacattcttcgatgattctcttcttgcctaaatcagctgtttccttggtggtggcatcttggtaatcttttggtgaatggatatattagatttgaagtagtccttttaagacatcttttggtgagtggatgtattacatttgaagtagtccttttaagacatcactctaaacaagtcttgttgttttatattatttctcaaacagcactgtatgtggcatagtttctaatattttcatgttgcctcttcttccctttcctctatcaaaagccagcctaaaaatgtatggttttaataaacctacaaataaagtattgaacttggaagtataagttctctagagttccagaaatatctggagaaaaaaaaaactggaaagaagaaacctgcgttaaattttataataacactgaaaaaagtctttaagagggtcacttttttaatagtgccttggccagcagagggtaatatattaccagccctagttaaaccacttttgctgacgcataaactgcccacattgcactattttccagctagaaacataaagcaatagaaaagtttggggattttttgaagctctaatacaacaataaatttcttttagtagctgaaaaccactttacacatgatagaaaaaaagtaattgtatagacaatggatttctgtccttaagatgaaagcccggtgccactcatctgcccttaatagggtatgtcctttagggatagtttttgttttgttttgtactagtgattatcacaagagttacttttgtaaagtattcacaactacagttatcctagtggtagaaagaaagtcttacatttcagtatgtgaaagtttttattactgtatcttttagtttttctttaactttttttaatcatagaaattgatggacatagttttaaaagtcaaataacactgaaaagcttgtaataaaaacatgttatgtctattaataaatgtaatttaaagtattttcacctaatgaagacagtataggagaaatcacctctatcctcgactatagtcacttcctcctgtcagtgtaacaacttacgctacatatcccttccacttaagtggtaattttttttttttttttttttttgagatggagtctcgctctgtcgccaggctggactgcagtggcgcgatctcggctcactgcaacctccaactccctggttcaagagattatcctgccttagcctcccgagtagctgggattacaggcacgcgccaccacgcccagctaatttttgtatttttagtagagacaggatttcaccatattggccaggatggtctcgatctcctgacttcgtgatccaccaacctcagcctcccaaagtgaagagatagcttataataaccattccctctttattcagctctcttcatcagggggagcatgtacttgtttttatctcctagaacaagtggtttgttactaaatcttcagcagctccactactccctgcccttcattggtttggaaggtacattctgtctctctctctttctctctctcgctctctcatgcacacacacaaagctttcaagtaaaataactcaaggcattgtcttttttgttaaattactatatttattgtcatctttttagaaatcagtgctacacatattcttcatttatattttttatgcatcatttatctattgctgcatacttaactacccctagacttggtggcttaacacaagaaccatttattcactctcaattctgcaatttgttctagactcagctgggtagttctgtttgtctcacctggtggtcattcatgcagcttagtcatctgtcagctcagctgaggctagctggttcaacatggcctcactcacgtgtctggagcatcacctggaagagttgagcaggctgtgcccctctctccatgtgatctttcatcctgggcttctttacaatgtgatggtctcaggttccaagagggcaaaactggaagctgcaaggtctcttaaggccttattcaaatgtcatacaatgtctaccacattttattggtcaaagcaagtcttaatacctgcccagattcaactgggaaagtagactccacctctggatgagaagagtggccaggaattgggggcaatttttaatctaacacatttccttggatgtgctttcaactttaatgttctaactagacttgttatattttctccttgaaatgcagtgaattggctctttctttagggattactatagtatgtgtatctcagagttcgtagtttcctgggtaatattcctaaaagaaaaggaaattttgctttgtgagagatacccaccctgtcccactttggtcttggagctgtcatgttgttttggttgtttcttgtattaaaaggtatattcagtgtgccatgaatccagctgggtacagtggcacttgcctgtggtccctactacgtgggagactgaggcaggaaaatcgcttgagcccaggagtttgaggctacagtgaactatgatcgtgccactgcactccagcctaggtgacagagtgggactgtgtctctaaaaaaaagtatatgtgtatatgtatatataatatgccatgaatccatgatgtttcctttgtgctttttatcttctataaatcctctccctttaccttctctttccagaatattaatctaacttttcaataaaaccagaagaaaagtctgttgctcttgcttcccaatagctagtttgatcctgagagctggataagttcattgacatcttcaataccagagcttaaaaggatgtagaaagatgattagtctagcatggtggggtagctttccctcctaccatgcttattccctcctaccattattcaaggtttcattattttcaggatcataaatgtcaaactactgggccatgagacttgcattcacttacttagctgcatcctctccctacttgccacatctttttggaaccctgtaatcagtccccacaagagctgaccctgtgtgttcctgtgtttttcaagtttcactagccacaaaggggaactgaatatgaacatgcatgcaaacctcaccagttccctttgcagccagctgaaagttatttttcatgtagaggaaacagtgtttttcttttgagaacaaactgaatttccacacaaatatgaagtgtttcatcttctgacagttcagaggacccaagagaagagggcaccaaattgtgagaaaggccattaaaagagaaactaggaaaacaaagagacaaactgaattggggaagagagaggtgctgctgagtacaggaaaggaaaaaagcagaccacggggaggggtgccggggtgctagaaagtctcaataagtaatggcacacaggacaaggcaggaaatgtaggaaggaactgtctgcaaagggcctataatagctatgccagcagtattaatggaaggcattaagaacttttggtttagaaatttgctgttggacaaaatttcaaaatataccacatttacgtgattactgggcctgcctgagttcatgctatggagccaggtttagatgaaggtgccttgtcctcacttcagaatgcaatatggtgacctgtttggtgtctctgattagacggagaaaaaccaagaatcagatatgtattaacatctcttctaattttttttttttagaagatctctgtcacccaggcttgagtgcagtaacatgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgcaaattaaaaccacaatgagataccatttcatacctaccagattggcaaaaattagtaaatctgataaaaccaagtgttggtaaggttgtgggtaaacaggaactcatttctgccttgtagtgagatgggcatataaattggtaaaatcactttggaaagcaatttgtcaaaactgagataagctgaaaatgtacatacccttacaaccaagcatttctgcttttaggtgttagccataaacttcacacatgggcattgggtatacaaaagaattcacttgagcatggtttcaattagtggaaaaagtggaaaccaccaaattgcccattgttaggggaaatggagaaatgaaccattgtttattcatgcagtaaaacactacatcagtgaaaatgaatgaacaagacctacatgagtctacatagataaacaaaatttgagtgaaaagagttacaaagaatgtaatagtaagataccatttgtgtaaatttttaaaagaaaaagtgcatattgttatgcatatgtatgttgtaaaagcacaaaaatatacgtcagagtgatatacaccaacttcaggaaagaggtttcctcagggaaggatgtgaagtgagctttaatatatctaacattttggatgatgtatacgggtatgaaaaaacttttaagtaaaacgaaaatgttaacatcttttcaattggggtgatgggtacttagctgcctgttatgttgtgtttttccatttttgtatgtttgaaacgttttataactaaaaactatttatatgtgaaattaccaaaaaagaatataagtgtaacagttaactgttgctcccaaaaaacttgcatgacttattaaagcaaaaagagattccatgtatcatcaacacctgtatccaaaccataattagaaggcctttccatcttctgatggttctttatgcatttcatgggccagaagcaaaactaataagggtaggatgctctaatttgattccattttttttcttctattcaacctgtatgagtttgttctggattatcgtacatgtttcagagagagcttccagagtatataaatgtgtgatggttagaagactagttttaaagattgttttttgtttttgtttttgtttttgttttgagacagagtctcactctttcatcaggctggagtgcagtggtgcaatctcagctcactgcaacctccacctgccaggttcaagcgattctcctgcctcagcctcccgagtagctgggactacaggtgcgtgccaccacacccagctaatttttgtatttttagtagagacggggtttcaccatgttggccaggatggtgtcgatctcttgacctcgtgatctgcccgccttggcctcccaaagtgctggaattacaggcgtgagccaccacgcctggcaaagattttgtttctttggcatcacacaattatgatgagtggtaagcagaaatttttgcccccaatacatattaatggcaatttatgtttttttattttattgtaatttatttatttatttatgtttttgagacgaagttttgctcttgttgcccaggctggagtacaatgacacaatctcagctcaccacaacctccgcctcccgggttcaagcgattctcctgcctcagcctcccgagtagctgggattacaggcatgcgccaccacgcctggctaattttgtatttttagtagagacggggtttctccatgttggtcaggctcgtcttgaactcctgacctcaggtgatccacccaccttggcctcccaaagtgctgggattacaggcgtgagccaccgtgcccggcaaagattttgttttttttgacatcatacaattttgatgagtggtaagcagaaatttttacccccaatacatattaatggcaatttatgttttttaaaataaaagacatctcagcaatcaccattgtgcttggacagaactaaacaaaagtgaaaagcattagcagagacaatgtcagtagaatggaagtctaccaacttgcatccctacatatgtaaaatacagttgctgcttacatcacaatgccatgaagattaactgatgataatgcatgggaagcacctagaacagtgaagggcacataaataaacaaatgttactttgcttcccattcccttgcatgtgaacttgaagtggggaaataaaaggaaaaatagaagtttcgaacaaacttactacctcctttccagttctgtgctcactgttaccatccccaaccagctctccaagtcttcatctgaaaacatggactgactgaggcactatggcagccactcagctgggccatgtagctatgacagaggacactacatcatccaacatgggaatgccgcatagtttatctctcgtctgagttgacataattcagattatattccgagtttcaaatcttttcttccgattaaaaatacccctacaagcctctttacaagtgaagtttgtttgttggtggctgaaataaaaggctctccagtaaatgtcatatctgttgtgaatatttttcctgctttgtacttttgcttcagtttttatggtttgggacaaagaatctaaatttttaagtcaaatctatgaatttttccctatagttatttctattattttgtttgaaagttctttcccatctacagatgaactagtcattttttaatcttttatggtctcattatttacacttaattcttgagtgtccttataaattttggggtatgataaaaggtaaggctgtaaattggccttttattttaaataggcacagcactattatttattaatccatcccttccttcctgatgctttttgtgatgtttcctatatatgcagtgattttctctgagggaggagaatgtatgggggtcacctgagctttgcaaaaacacacttaaccccacctttgcaagattccagcacatcttgactaacaggaaccttttttttttttttttttttttttgagacggagtctcactctgtcgcccaggttggagtgcagtggtgcaatctcagtggggcatggtggctcaatgcctgtaatcccagcactttggaaggcaaaggcgggcggatcacctgaggtcaggagttccagaccagcctggccaacatggcaaaaccctgtctccactaaaaatacaaaaattagccaggcatggtggcacgcacctgtaatcccagctactccaaaggctgaggcagaagaattgcttgaacccaggaggcagaggttgcagtgagccaagattgcaccactgcactccagcctgggtgacagagtgagaccctgtctcaaaaaaaaaaaaaaaaaagtcatatacgtattttgtacttttctcatatatcatctaggatctgcttagacatgtgtattcagttccacagataagtttatccttgtgtctgctccccagtgttatccttactgaaggataagaatatattttaatatctgataaagtattatattttgaaaacctaaaaaataattagcccattaacatgttgctgcagcatccaggttgcttgttgggagaactctcttcatattgcttttcttttgtgggataactttcagtaagtctttcgttcaaatagttatattacctctacttttatgtcagcaggaataaagaatccattttttaaagttgaaaataaaactgtactggaagaggattgtctttttctactgacctaatcttagaaattcaaccaccatcaaacctggctctatacagcatacttttctaaaactaacagcaatattcaacactgaggtctcactctgacagccagacaattcattttgcccatatttggttttgcatgtatgagatgttatttagaaagctgttctgaaggtctttgcaaggtaaagatacgtatatacttctgaatttccttttcctgtatgcttctagaactaaaccttgggttaggagaggtaggaactgtttcctgcttgcaaatactaatgcttagtaagaaatgaaagattatatgtcataagtagccttaactttggtaagacagtagcatattttttctaaaaatttagaaaccttctcaggattcaagttactctaaggcatgttatcagatttctctcagtaagcaatctgttataaatagacagattgatttatatcaaaatgtattttattccaaataatatagcaataattaattgagtatactttaaaattttcttaagaatgccattgtgcagagctttatagtaatcatctagtataatgagacagcttctagaactatgagtgtatttatattcattttaatgtcccttaaaagtgataataattgataatataatttcaccaaactgtatacaatgagatatgtaagatgtttaccagtaatgtaaaataaatttttaagtttgaggacatgaaggaaaatagaagttttcataacttaaaaccatacaaacagaaatgctaaatttcatttagatggtatgtgttaacattgtcagggcaaagtaattaatataattttgtcacctttttctgaccctctaatttttctgcaaatttcagtatttatcctcaaatattacttatttttaaaatatacttttgctttgacttattctttattcagttaattatatttgcgggcacttattgaaatatagttaactggccgggcgcggtggctcatgcctgtaatcccagcactttgggaggccaaggtgggtggatcacttgaggtcaggagttcgagaccagcctggccaacatggtgaaatcccgtctctactaaaaatacaaaacagccggtcatggtggcgggcgcctgtaatcctagctacccgggaggctgaagcaggagaatcacttgaacccgggagacagaggttgcagtgagctaagatcacgccactgtactccaacctgggcaacagagtgagactccatctcaaaaaatatatctatatatagttaactgagcactgtatacaagccaaatctcattaaaataaactcagttctgatcaaaatcttcatggtcattcacattgatttctcagccaatggcctaccttaagttttaagaagtattctgactctaaaaaaattttatacaccatgatagaaactttcagatgagtccttggagtttgtcctaagatgcttttacataaattcagtcaataacattcaggttctgtgtatgaccaaagaactggacaaatgctggccaaactttcaagaatgtttgcctaatgacaccccctagattgcaactgtatggtgttctatacagctatattcaaatggactaggaaaaaagctaattactcccaactttttttcttgtaagcaccccttccttccctttctccctatcttattcatccgtccattcttcttaattattcaataaatgtgtattgatctcctatagccaagaaacatactaagctccagggaggcaatgacgaacaagactaagaccgctttcttttagagcttgctgtcctgttattttttaatgtacatgaaaattgcagagtttgctccttttaattctaatttgcaggtttttattgttgtaaagtatttcaaatacccaggagtttaccaaaaataatataatcacgtgcctactacctagatttaagacattaacattttgccatatttgcttcaaatttctccagatataaccattaagttggtatgtatcttgtatatattatcatacatgttttgtatctttattttatatgtattgatccataagaatgtggtattgttttctaccaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaatgtggtattgttttatgtttttatattttacataaatgatttcatgcagtacatacccttttgcaattttgtggggttttttttactcaacattatatttgagatatacccatgttgatgcatgtgagtgtagttcatttcattgcatcgctacatgatattccatttcgtgagtaaaccagttcacttctccatgcctttgctgttatgtccttatttccagttgtttcgtattatgaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggttttgtgaacaatttctttccagtagcaagatgatacatttagctgtgaagaaatgtagatgaatcgaaaggcatgatagggaacaaaacatatagtaaaaatgataagtacaataaaggagttacgagctgtagtggcatatttaccagaattaggaaattttgacctccttttagaaatcctcaatagattcttcccaatcttaatatatgaaaggattattagtaagaaaattagccagaacattaccacaagaatgaagttaaaaatggcttctccttttgcgttatgcttatctctgtaatggaaacacattgtggaattatgccctcctttcttaagtgttaaaataatcatagttaggaatccaccaagagcaagcatccatactatacaacagacataaatactttgtttggttgttattgccttccgttgctgtatagaccgattaatttttatatagcgatccaaactgatgaatccaagcaaaataatgctaatgtacatgttcatataaaacagtgttcccacaaccttgcacagaatcacacctagtgtccacttgttttggttaatatgatacattattcggaaagggaggcagaagatgagtaggaggtctgcaatggctacgttaagtagataaatttgaatggaatttcttttacggtgaatacccagaaatacatagagggcgattatgttcccaaccagtcccacgatgaaaataacagagtaggatgtggttaacacagtagatagcaatttttcatccatgggacaggtagtaacatttggtgttgctgagaagttttgtggcggttggtcgctatgattggttataaagcgcattctgtgggaggagtaaggccagctgctgactgaagttgtcgtcattgttatggtatgacttctcattgtcttctgtggagatcaaaaagtgaaagtgctaaatgacatattcctcatgtgtagttcttatgtcttcagatttttcctacaacggaatgccaaacattgagtcatttgctattttaataacagttactttaactaaaagtgtaaataataggctgggcttcccagcacacgcctatggtcctagctactcgggaggctacagcagaaggattgcttgaacccaggagttcaaggctgtagtgagctataattgagccactgcactccagcctgggcaacagaacaagaccccatctctttaaaaaaaaaaaaaaaaaaaagacagtgtaaataataaatgatttattttcagacattgcgagaaactttacttttatcctactgtatgtagtaacattattgtatcattaaacaagcagcacatagtgtggtatctcatggagtttcatgctctaacctttcctgtggccatggcctacattgaagttctgtttcatgtattatattaaaataactcaatttatgagatcatcttctcttagggaagttcttatgggaatacagatggtggtgaagagaaatgacagctcatatttctcaaagatgagcatcagtttctctaaaggtatgtacagccataagagagctgggcccactgctggccctgcccagcttcagaaccacttcctgccttgactttttccctcatatgtggcattcattcattttgacatgtattgctacatggcgtgtgacttgtggtggtctcattctataagtgggaataaagaagaggatcctaaatttcttttcagcctaagaccaaggtaggggtcttagggcatgcaattaacataatagactaagagaatacagcacctgcaaggttacacagactcttgtatcactggacaggagaaaaaagtaaccaaacaaaaccaagttagctggcagctgccagttagccactcctaacctagaagcatagagtaataacgtagatgggaaacagcatgtgcaatccaagattttgaaagtaacctgaccaaagcttaaatgtgccctgggttcaataatttgagacttgctagaaccttcgaagagatagtgtttgaattctacttgtttgtggcagcagagaatatttgcaaagctacttattattggcccattgactgctgtaaagagcttagtctgagagctggtcataacaagtaaagaaagcatttctggaggtctcatcacattcctctcatagagtgactgccctatttctctacagcagccacttagcagggttaacataaagatgcccagagcaaggttctcaaaatcagacccaactaacttgtgaccaagggcaaataacttaatcttttctatgccttagttttctcatttgtgaaaatgaaaaatgcataagaagaacttaatcctggcacatagtgactgcttaataaaagttagctttaataaacaccttttgattaatctcattttagtaaatatctcacacttggctaagtactgtgtgggaaaggaaggtgaataagacagagaccctattagtaaacattttggaggagtggacattcaaaccctgactgctaccatgcaaagtggatttgaattacataaattaagtccctgatttgatcttatacacagagaaaaatagcctttcttaaagctctacacataatttgattaaaaacaaagcattttggtagagggtaacattaagatttaaaatgttgtaaagttggggagcattgattccacagaagaggaactggctggtgaagaggaagttatgtaatccctggtaagagcctgtttccagaattcaggaaagtggagggagaaaggaagggagcggggaaggactgagtctagtctgtcatgtgtctcaactgcaggaagacaaatttcagaaagtttatagaaaggtataggcatgtttcttgtgatctaagattctggtttttgtttgtttgtttgttttgttttgtttttgagacagagttttgctcttgtcacccaggctagagtgcaatggcgtgatctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaaggaaatcatttttttctaatgaaatgatctctcttgggaggcaatataaggatcttaccactggagatttttgagactaccaccaattgggttctttgtagaagggattatcagtggttctcaatcctggctgcatattagaatcctcttgagggttttttaaagataccagtgcttggctccttccccagatattctgatttaattggtctggaatgggtttcaggcactggtttcctttaaaagctccttaggggattttaatgtgcagtcagaattgaactcttaagctagatggccaaaccattaactaatatttatttagtactttctgtgtaccagacactgtgttaaacacatttatattacttcctttacataattcttgcaatactctgtgaggtaggtatcacaaaagaggtaatgaaagatcaaaaggttggccaggtacagtggctcacgcctgtaatcccaacactttgggagactgaggctggagaatcacttgagaccaggagttcaagaccagcctgccagccaaggcaacatagcatgaacctgtctctaaaataaaaaaaggaagaaagaaagaaagttcaagaggttatgatctttactcttggccacacaactctttttttttttttttttttttttttgagacagagtctcactctgtcacccaggctggagtgcaatggcatggtctcagctcactgcaacctccgcctcccgagttcaagcagttctcctgcctcagcctcccaagtagctgggaccacatccagctaatttttgtatttttagtagagacggagtttcactatgttggccaggctggtcttgaactcctgacctcattttccgcccgcctctgcctcctaaagtgctggggttacaggcgtgagccaccgcacccggcaggccacacaactcttaaatgacagtgcccaagttaggactcagatctgacttttagagcccatgatgcttttcaccaaatctcactccttatcacatagggtcagcattttctttattaatattgagttctatcagcagtattttgacatgattcctttaacatacactttaacaattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctctacaaaaagtataaaaattagcgggtatggtgacgtgcgcctatagtcccagctactcgagaggctaaggtgggaggatcgcttgagcctgggaagcagaggttgcagtgatcctagatcactccactgtactccagcctgggtgacggagtaagaccttgtctcaaaaaaaaagaacataaaaaaaaaaaaaattggccgggagcagtggttcatgcctgtaatcccagcactttgggaggccgaggcaggcaaatcactggagtccaggaattcgagaccagcctggccaacatagcgaaaccctgcctctactaaaaaataccaaaaaaaaaaaaaaaaattagcagggcgtggtggcacgcacctgtagtcccagctactccggaggctgaggctggagaattgcttgaacccgggagacagaggctgcagtgagctgtgttcatgccactgtactctagcctgggcaacagagcgagagtctgtctcaaaaaaaaattttttttttaattaaaaatcacaattacattctgttttaaacttggtgactgtttttttttctcctttgaagttggttagtacattacaatgtcattcactatataaggctatttactgatattttttaaactacctgtttgatatgttaagaattgcttgtgaagacaagaaacaaaccactgtgtttacataggggattaatttcccagtgggcattacttgtgacccatgtgctatattgaagtggtcacaatagttttgtaatagtagatagtgttttttaaatgttgttacttggcaaatcctattcacaagttcaaaaacctagtattagtgcattgtacccccgcaccaccacctactcctgcagttttttttcaactggctcatgtaggagtactggacccagagggcaggacccaacagattccactgtgactccagatgagcagaagcttttaaaatgcagtttgggtatgtttgtgaaaatatcacattgctatgttgaaatacatacctatttggtaatagtcgcaacctttcaccgtttttagtttgacttgataatgactgaatctattcagggcatgcttcaaaattgcattaactgctgtataaaaaatgaaaattgaaaacatattactttggaaataatactattaatagtgtgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagcacaagcactgaatttctgtttcttaagttttcatctgtacattattttagcatattttcatgtattcctttaagacctttgctaaaacaaacttgtattattaggactagatgagatttctgatggtgttctccccttttgatcactatgataaactctcccgagcaaattaaaacatcacctgtattttaagcgaaataatgatgggattctgcagtcttggttttgatcctagtccaaaatttaaccactatctgtccatctatgtaactgctggccctgcagtttagtgttatttccctttttttgttgtcatttgaaatgaagaagttagtttttattctccccataattgttatcctgcagcttgtttgcactaaatatttgactcattgggctgtatctaacattctaattatttctgggtacactcttctgaacattatattctccagagctttttgtttgttataaatatgatttatgggacaggatatttttaaattaatagaataaaaatgttttgtagctcttacttccccttagaacctctgagaaggaaggtggttgctgtattagtcctgcaatattgttgtattggcaggattttattttattgtggtacaatatgtaacattaaatttaccatcttaacttttttttttttttttttttttgagacggagtttcgctcttgttgcccaggcgacaagagattgtacaatggcacaatctcggctcactgcagcctccacctcccaggttcaagcgattctcctgcctcagcctcccaagtagctgggattacagacatgcaccaccatgcccggctaattttgtatttttaatagagacagggttttgccatgttggccaggctagtttcaaactcctgacctcaggtggtccacccacctcagcctcccaaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacaggatttccttcttttatcaaactgcattatattccactgtatatgcaccacattttccctatgcattcatctgttgatggatttttgggttgcttccacctcttgactaatgtgaataatgctgcagtgaacatgagtatgcatatatctcttcaagatcctagcaggaattttttaatgactaaataggcatttaactacgtgcattctatttcatataatctagcatgaatatatttttttctatattattttcctacacctaagacaacccttttcaaaacactaattgttttaatcttcagtttcctcatattgtgaccacattttctcctcaatgtgagtcagcacagctaccaccagatttgagtataatctttttctagttctttctttatataagctttttcctgttcattctgaacattctggtttgtctctgcgttcttagctcattttcgatatgtcctcttcccttcacgcttcctctttctcttgttgggattataaggtatttatattaagatagaagtagaaaagaacaaatgtatacgcttgtttggtgccatctattactgatatcactgttctctttaaatcccaaccctggttaaattcagctcaccacctactccaggcctgaaccttgccatgtaaaatgaggactgctggatacaaacactcaatgatgctgattggtctcacttcaaattcatgactacaaacctcaagtgggcccctgggctgccaacagtcctagtatatttccttagtccagtggttctcaaaacaggggtcccaaacgagttgcgtcaacaccactcagaagcttgttagaaatgtatgttcttagctgggcatggtggcgtacgcctgtagttccagctacttgggaggctgagatgggaggagcacttgagcctgagagtttgagtctagcctgggcaacatagcaaaaccttgtccctaaaaaaaaaaaaaaaaagaaagaaagaaaaggccaggtgtggtggctcacgcctgtaatcccagcatgttgggagaccgaggcgggcagatcacctgagggtcaggagttcgagaccagcctgaccaacatggtgaaaccccatctctactaaaaacacaaaaattagctgggtatggtggcacgcacctgtaatcccagctactcaggaggctgaggcaggagaatcgcttgaacccgggaggcagaggttgcagtgagccaagattgcaccattgcactccagcctgggtgacagagcgagactccgtttcaaataaaaaaagaaaaaaaatgcatgttcctgacttcatcccagacctgtgagccagaaattctggggatggggctcagcagcctgtgtgattctgatgctaaggtttgaggaccactgcttaatcagttcattcttctattccttgaaaatactttttcacacctgtactcttctcagactgccaggaacccctctccttcctcactcccacctggtgatcactttttatttcactgagaaaatagaatcactcagaagagaattttattgtcttccagtgtccacctctgctagtatatacaaatgtctctctaagaaacaaaagccgggcgcagttcttcatgcttgtaatcccagcactttggccagctgaggtgggcagatcccttgagctcaggaattcgagagtagcctgggcaacatggcgaaaacctgtctttaccaaaaactacaaaaattagccgggtgtggtggcacatacctgtagtcccagctactcaggaagctgaggcaagagggtggcttaagccccaggaggtggaggctgcagtaagccatgattgtgccactgcactctagcctgggtgacagtgagaccctgtctcaaaataaataaaataaaaaatttaaaaacctccacaaaaaagctctaggtactactatggaattacctgtagaatatattgttatgtggaaattttgaatatttgtacatattttcttatttttaaaaaactgaaggataaactgaaaactgataaaaatagttaccaatggggaagaaaagattgggagtgggggaagagtgcaaaagctagacctctctgaatagtatctgttttacagtttgtactttagaacctatgtacatgttttatacaattaaaacaccaaattaaggcaaaatctagttgaaacaaatgaacctcactctattgcaaagtgaaagcataaccacaaggagaattatttttggtaacttttaaaatagggtaggggtttttgttttgtttttacgtaattttagacttatagaaaagttatgagaacaagtacgaggattctagataccttttactcagattctctatgttaacattttttccttcatttgtttaatccttctcaatctctcactcttatccatttatgtatttcctaaaaatagggaattcctttacatagctgcagtacagttatcaaaatcagttaatttatgttgacctaatatcattatgtattctacagaccttgttaaaatttcatcagttgtcctagtaaatatcctttataacaaaaataaaaacaaaccgggcacagtggctcacacctgtaatcccagcactttgggaggatgaggcgggcggatcacttgaggccaggagttcgagaccagcctggccaacatgccaaaacactgtctctaccaaaaatgcaaaaaattagtcaggcatggtggcacgctcctgtaatcctagctacttgggaggctgaggcacgagaatcgcttgaactcgggaggtggaggttgcagtgagcagagatcatgccactgcactccagcctgggtgacaaagtgagaccctgtctcgaaaatatatatatattaaaaacaagatctatctttttagtctcctttaatcactttaacctggaactgtatttgaagaatataggccagttactttctagaatgtccctctttgggtttgcccagggttccttcatgattagatctcgttatgtactttggcaggaataccacagcagtgttgccaagttctcaatgcatcatatcaggaagcacatgctatcaatcagtcccattagaagcagtgttaacttcgctagtttctgctgggtttctcccttgtaaaattactagtttcctgtttgtaattaataagtatgctgtagggagatatttagagatcacataaatatcttaccactcttcaaacttccactcacaagttagcatccttgatgattcttacctgaatcagttacgataatgaaaactgacagattccagcatttcttctacatttaattgattttctacttaaagcttttcctccttccccattcatgtatttgtttatttatttacatcagcatagactcatggattctttacccagtagtaaaatgctattttgaccgggcatacctagtgggatatatcttaaggacaaaaagaaccacaaaatcttaaacagcattcagtggtgttgttattgataatgtaggtattactattattttaaaactttcacacacacatacacacacattctgaagcacaaagcaaatgagtaattatgttagtatcattaggtaccaagattacagttgacccttgaacaacatggggattggggtactaatccccgcacagttgaaaatccatgcataacttttgactcccccaaaacttaactactcctggaagccttaccaataacatagttgattaacacatattttgtgttatatgcatcaagggagcctcaagtgatcctcaagtgatcctcccacctcgaccttccaaagcactgggatcataggcatgagccaccactcccagccggtttgataattatagaaagaggtttggctttaaaaatgtcaaaatagcaggatgcagtggcacatgcctatagtcccagctactcaggaatctgaggcaggaggtttgcttgaacccaggagttctgggatgtggtgcattatgccaatcaggtgtccacatgaagtttggcatcaatatgatctcccgggaggggggtaccaccaacttgcttaaggaggggtgtgaactggcccaggttgtcagcggagcaggtcaaaactcccgtgctgatcagtagtgggattgtgcctgtgaatagccactgcgctccagcctgggcaacagggcgagactcccacctctgaaaataaattaaaattaaataatgtcaacataacaggaggatcagtttttgtcagcaaagaggcagcagatgagttctcagatgccattcagaaaagtattgaagaggagcaatatctgcctgaacaggctgttaatatggatgaaaagtgccctattctggaaagaaaatgccacagagaacatctattaataaggaacagaagcaagcaccaagatttagggcaggaagggatacactaactctaataagcatagtcctgatataattccaactgcatttgcacaaaacagtagagtcagcctatctgcctcacttgaggtcaggagtttgagatgagcctgggcaacataacgagacactctaaccccccaaaaaatgtttttaattagccaggcatggtggcacacacttgtagtgccagcttctctggagactgaggcaggaggatcgcttgagcccaggagttcaaggctacagtaagctatgattgcaccaactgcactccagcctgggtgacagagtgagaccctgtctcttaaaaaaaaaaaaaaaatttatcaaactgtcttttgccaccattgcattctccagcttttagatccttcattttttttttttttttttttttttttttcctgagacagtctcattctgtcacccaggctggagtgcagtgtcagcctcctgggtttaagcaattttaccgcctcagcctcctgagtagctggaactacaggcacgcgctaccatgctgggctaatttttgtatttttagtagagataaggtttcgccatgctgcccatgctggtctcaaagtcctccactcaagtaatctgcccaccgcagcctcccagagtactgggattataggcatgagccaccacacctgaccccttcaccttctttttgctttaagttgctatttcgctttttctcaaattatgttagaatctataggtatgtcttttttatacccacataaaagctgcattttcaatactacttaaaaaggtatttcacaaaaagtgcaagattttagcacctactggtgttagctgcaggagtagcttcatgaatttcctttcctttttttttttttttttttttacaatggtccttatgttggattcatttatcttgagatggcagccaattgcagttgcagacctcaatctacaatacatatcaagcaattcagctttttctttttttttttaagatggagtctcgctcttatcacccaggctggagtgcagtggtgcaatctcggctcactacaacctccgcctcccaggttcaagcagttctcccacctcagcctactcagtagctgggatttacaggcgcctgccaccatgcccggctaatttttgtgtttttagtaaagatggggtttcaccatgttggccaggctggtctcgaactcctgacctcaggtgatccacctgcctcagcctacctttttcttgtaatgtcatgactttcctctgtttcttaggagcacttctagcatcaccaatggcactttttatggatcctatggtttaaggtattgcactaaacacagtgaaaataatatgagaactgtgagattacttttactgtgatatgcaatttattggagagatgaactgctcaagcaaagataagtagcatcacacaacatattaggtgaatactcgcaagacttgagctcactgcaacagcaacaggagggagctgtgaaattattacagtagtataatatgtactacagttaattttatggttatgatttaatattgcattctttgtatttgttcacatttctcttgactgaatggcaccgtttacagtctgtgtaggtgtaagttttgataaattttaactctttataatagatttgtgtacatttttatagtactaaataataaaatagtatctaaatatgttttatgcatttatgatatagctttttcttaattttttattccagaagtcatccttcacctttttcttaatttttaaaatagttctaggcaacatggttggtccacgagttttttcaaattgttacgaatctccaaaaaaaactttcaatatattttgttgaaaacaatccatgtataagtggacccacacagttcaaacccatgttcaaaagtgaactatacttgccaaatcaaagaattaaagtaaaaatgctataattgaataggaagaaatattagcttgaacttgtggtttatttatttattttttttttttgagaccgagtttcgctcttgttgcccaggctggagtgcaatggcatgatctcggcttaccgcaacctccacctcccaggttcaagcgattctcctgcctcagcctcccaagtagctgggattacaggcttctgccaccacacccagctaattttgtatttttagtagagacggggtttctccatgttggtcaggctggtcttgaactcccgacaggtgatcctcccgcctcggccttccaaattgctgagattacagacgtgagccaccacgcccagcatggtttatttttctcctaaaaatgcattcttttttcagcactgtccactgaaaagccaaagtaataataacccagtaaaaataatatgcctagtacccacatcatggatttatttatatattttattttatttttatttttattattattatttttgagacagagtctcgctttgtcgccaggctggagtgcaatggcgcgatcttggctcactgcaacctccgcctcctgggttcaagcgattctcctgcctcagcctcctgagtagctgggactataggcgcatgccaccacgcccagcaaatttttgtatttttagtagagttagggcttcaccatgttggccaggatggtctcaatctcttgacctcttgatccgcccacctcggcttcccaaagtgctgagattacaggcatgagtcgctgcgtccagccaattttttttttttttttgagacaaggtcttactctgtcacccaggctggagtgcagtggtgcaatctcagctcactgggttcaagtgaagctactgcctcagcctctcgagtagctggaattacaggcatgtgccgccacgcccagctaatttttgtatttttagtagggacaaggttggccgggctggtcttgaactcctgacctcaagttatccacccaccttggcctcccaaagtgctgggattacaggcatgagccaccgcacctggcccacatcatggatttaaatcgttttttgcactaaaaagaaacagggctacttagagaaatggctgattccagatctggggcaagaaatggacatgacaagcctggaacatcatcttgtgactgaaagcaaggaagttatcagacttctggagtcttacaaaaatacagaagaactgacttaaaggggctcccactggcccaaaatgggacaatttgagcacaaaaatttgtaaaggcagcaactgattaaaacacattaaatatataaaaatctgtaagttcataataattaaaaaaaaaacacctcatcagtcacctttggaggttgcctagaaactaacttggtattctggaaataaattataacagctttattcataatatccaaaaactagaaatagcctaaatgtctgtcaacaggagaatggacaaactgatatattcatacaatgcaatacttacggcagtagtaaaaagaaatgaactactgatcacaacaaaatgaatgaatctcagaacatgctgaatgacagaagccttacataaaagaatacatacttacggttttgtgtctatcaagttctaatataggcaaaacaaacctatggtgaaaaaaatatcagagtagtggtttgcactgggggagatggcagcagagattgaatgggaaggggatgagggagggaggtttgtgggataatgaatttttttagggatttgggttacacaaatgtatgcagttcatcaaaactctaatggtacgcttttgtgcatttcacagtatatacattttttaccttaagcataactttattttttttttactttttatagaagttttaagagacagggtcttgctgtcacccacgcaggggtgcagtggcacaactgcagttcactgcaatcttaagctcccaggctccagtgatcctcctacctcaagttactggtcccaagttactgggaccacaggtgcacgccaccaaaactggcttttttttttttttaagtagaggcataattttaaacaaatattaaatttcaatgatatgtgtgctaaggtgtattaaaaagtaagatggatagaaggataaagagatagatatttgataaagcaaatgtaacaatatttaattgtagaatctaggtggctctttacaatataattctttcaattttctatatgtttgatagttttcataacaaaatgttgaagaaaacctccattttggcacctctaattatgggtctaggcatcaacatctgctaacatcattgagtgaaaagttgatggtgaatcttataatgatgggtcaggcagacaacacctgaacccactgctcaatcctgtcactaaaagtaggatagccaggtgctatgttcttcctgttgcaatacaatagatatatcacctatgaagtattagtgcataaaactaaaattgaatctgaatctaatcaagattctagatctaactacaaatttacaggaaatacaggagagtaaaaaacattaaataataccatgtaggtaccattagtcaagtacagattgtgggggatttcacaggaaaaattacctagtatcttaacaaatcaatggcatgaacattggaaaaaaaaaagcataaggaaggggatctgttacagagtaagagacactcacaagacatagtcatcaaatgcaatgtacagaccttggatcctgtctagaaccaaccaaccgtaataagacctttcttctttttttagtctgttctactccttcaagttattggtagagaaaagacatttttgagacaatcaaggaaaactgaatgtggactgagtattagatgatactaaagaagtattgctcattttgttggacttaataatgatattatggttatttttaagtcctgtgttagaaatactgaactattaacaggttaaattacatttatgttaaaatacttctggggaaaaaaagtaaacagttggggatagatgaagcaaaaatgaaagaatgtccttgtttttgggtttttcgtttgtttgtttttgttttatttttgcctggagacgggcaagttgcccatacatcccagcaggccaggggaggagctgaaagaatgtcagtaattgccaaagctgggtgatagatacatggaagtttattaatctattttctccacttgtaaatgttaaaaagaggcatcctcagcttcacactttcttctacatcccatttctccatttttactacagtaagactgtgaaagatatctgtatttactgtcactacatcatctcctcccattctctcctgaacctggtccaatggggatttttgcctccatcgtgccaccaaaaccactcttatcaaggtcaccagtaacttccaaattgccaaatctaatggtcagttctcagttctcattttaaatgacctttgtaacattgatgactactaatcattcctacttgaaaaagtttcttcacttgacttccggataccaaactgattttcctcctgcttcactgtctagaccttgttttctttgctagattttttcttctgacttcagatattggcgtgcaccaggactcaatcctctgactcttctctatgatttcctaagcaatttcattccttaccatggctgtaaatatcatctgtgtactgttgattcccaaatttacacctctaatcccagcttccccttaatgtcatcttataaaatctcaaactcaatacgtatgagaccaaattcttttttttttttttttcatttttctataaaatagagatggggttttgccatgttgcccaggctggtctgaaactcctgggctcaagcaatcttcccgccttggctccccaaagtgctaggattacaggtgtgagccaccgcacccagcctgaaaccaaattcttgatccaccttacaaactcctccctcagtgttccctgtttcagtaaatggcatcttcattttcactcagttgctcagaccagaaaactaattgttataattgacttgtgtctttctctcacgctcatatccagtagcaattcctgtcagctttacctttagaacataaactgaatttgactacttctcatcatctctgcttctgtcactctagtctagtccaagtcaccatcttctcttgcctgtgcaactgcagtagcctcttaattggtctcctttttccctgtttcttcacaatctcctcacacagcagccagagtgatccttttaaaacctaaaactgatgatagtactcccctgttcaaaaccttatggtgatttcccatctcgctcaacataaaacccagagttcggagagcaggccagagcccaggcccggcccagcggcgcccgccaggtagacccaggcgaggccgcgtgccggcgcgaggggagcccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttttaggagcccgtaggtcatcttggagggtcgtctcaagtattgaacaaaagacggaaggtgctgagaaaaaacagcagatggctcgagaatacagagagaaagttgatacggagctaagagatatctgcaatgatgtactgtttcttttggaaaagttcttgatccccagtgcttcacaagcagagagcaaagtcttctctttgaaaatgaaaggagattactaccattacttggcagaggttgccactggtgatgacaagaaagggattgtggatcagtcacaacaagcataccaagaagcttttgaaatcagcaaaaaggaaatgcaaccaacacatcctatcagaccaggtctggcccttaacttctctgtgttctattatgagattctgaactccccagagaaagcctgctctcttgcaaagacagcttttgatgaagccattgctgaacttgatacattaattgaagagtcatacaaagacagcatgctaataatgcaattactgagagacaacttgacattgtggacatcagatacccaaggagacgaagctgaagcaggagaaggaggggaaaattaaccggccttccaacttttgtgtgcctcattctaaaatttacacagtagaccatttgtcatccatgctgtcccacaaagttttttatttacgatttatgacaggtttatgttacttctatttgaatttctatgtttcccatgtggttttcatgtttaatattaggggagtagagccagttaacatttagggagttacctgttttcatcttgaggtggccaatatggggatgtggaatttttatacaagttataaatgtttggcatagtacttttggtacattgtggcttcacaagggccagggtaaaactgcttccctgtccaagcaaagaaaactgcctacatattggtttgtcctggtggggaataaaagggatcattggttccagtcacaggtgtagtaattgtgggtactttaaggtttggagcacttacaaggctgtggtagaaacataccccatggataccacatattaaaccatgtatatctgtggaatactcaatctcaatgtgcacacctttgactacaactgcagaagtgttcctttagacaaagttgtgacccattttactctggataagggcagaaacggttcacattccattatttgtaaagttacctgctgttagctttcattatttttgctacactcattttatttgtatctaaatgttttaggcaacctaagaacaaatgtaaaagtaaagatgcaggaaaaatgaattgcttggtattcattacttcatctgtatcaagcacagcagtaaaacaaaaacccatgtatttaactttttttttttaggttttttgcttttgtgattttttttttgatacttgcctaacatgcatgtgctgtataacaatccaagcataattgttaagaacacatgtattaaattcatgtaagtggaataaaagttttatgaatggacttttcaactactttctctacagcttttcatgtaaattagtcttttggttctgaaacttctctaaaggaaattgtacattttttgaaatttattccttattccctcttggcagctaatgggcttttaccaagtttaaacacaaaatttatcataacaacaaaaatactactaatataactactgtttccatgtcccgtgatcccctctcttcctccccaccctgaaaaaaatgagttccaatttttttgggagaggggagattgattagaaaaaaatgtaatatgttccatttaaaattttggcgtatggcattttctaacttaggaagccacaatgttcttggcccgtcatgacattgggtagcattaactataagttttgtgcttccaaatcactttttggtttttaagaatttcttgatactcttatagtctgccttcaattttgatcctttattctatttgtcaggtgcacaagattaccttccttttttagccttctgtcttgtcaccaaccattcctacttggtggccatgtacttggaaaaaggccgcatgacctttctggctccactcagtgtctaaggcaccctgcttcctttgcttgcatcccacagactatttccctcatcctatttactgcagcaaatctctccttagttgatgagattgtgtttatctccctttaaaaccctgcctatcctgaatggtttgtcattgtctgcctttaaaatccttcctctttcttcctcctctgttctctaaataatgatggggctaagttatacccaaagctcactttacaaaatatttcctcagtactttgcagaaaacaccaaacaaaaatgccattttaaaagaggtatattttttcttttagaatgtaagctcctcaagagcagggacaatgttttctgtatgttctgttgtgcctagtacactgtaaatgctcaataaatattgatgatgggaggcaaaaaaaaaaaaaaaaaaaaaaacacccagagttctcaccacagtttcaaggccctacacctttgatcatccctcagatcacatttcccaccgctctgccccttgctctcatgcctttccagacacactgggcttccttcttcttctccaaacaaccctccttattcctgtgggcctttgtattggctgttcttctcatctggaacttgcttccatgtggcttgctttttcacttcgttctggtctctgttcagatattacccattagagaggccttctctgaccccaactaaaatagcaattccctagtccccatccctataacacctccttaccagcttaattttacttcctaacaagtaatactacctggctttacattctgttaatttgcatttatggctctatttgctttcttaaattcaactctttaggccaggcacagtggctcatgcctgtaatctgggcactttgggaggccaaggtgagaggatcacttgagaccaggagttcaagaccagcctgggcaacatatcaagacccctcatctctttttaaacataaattaatttaacttaattaagttcacattttataacttgtcttaaggattcaagaatgactgaatctacacagaggagaattatataaattcccttgtaacattaacttaagcctaaacatcatcaacatactattaagggcatacagaactttggagttctgatttcagcttctactccttcctaaggtgataacagttacacagccatggccagaagaccctgttggagtctagtttgcacttttttcttctgtatcatgttcattcttttctaggcttgctcacttgctgtgtcccatactggaatcatgctaggggtattgccatcttagtctgttgtcattgttctctctttgaaccaacagaaagttctaactaacagcagtctatcagttgatttcggtagaggtttgcctgctctcccatagactcttcttgctactttgtgtcatgctgtggtttgctcactattcatttctacacttgccttccttctttctctggctctcacatacacacttgtatttcctggctcatctctgtttgtgctagactattggaaaagtctttaaacttctttggacagaaagaataacttccaaagtagaatcctgatgctcccattgggcagagtaaggattcctcccacctgtgtgtcatcatcaaacacaggtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaaccctcattgttatcacaaagcatatgatataaaggagccctggtcaagcaggataccccttggggagaggatgtctttgccctggactaggaatcaggcaagtggttttctttccccttctcctttttcacctcccacccccacagagaggaaaagcagatccagagaagacatgcccaggaagagcgttgaagtccctgggaacaaggcttaattaaaatcattaaatctgacccatccatgtagtactccttggcttaagggtggaatgaataaagcaaagaaaagaggactgggcagggtggagaaagaaagggccatggctatcccctaacaaccaggatacaatggctctgtaggtaaaatcagaggtttcaagaaacattttggaagtgtaaaatatattttttcctaaagaaatctagactgtcactcaaaggaagacaatattgcatagtaaggcaaaaaaaatgtatctgtgtttcttgaacatccatgcttccttagtaattcttagcactgtactctaaccttacaagcaaataatacctaaagaacattggatggaacaggtatgtatttggagaaatcagccagacgtgagaatatgacaaataattcaagcatccagaataatttagaagtttttaatgtgtttctctattatcatgttatctaattttatgtaaactgcattgttcatcttcaatgaatccttatcttcgggtttgttttttgtttgtttgttcgtctgtttttcttttcagccccactgtgttctccttgcctcaaaagaaaactcggcacctgttaaacttggaggctttggggtagctattcaattaggggagtctggacttgtagctggaggtaagactgctttaaaaaaaaaaaattcttcaaaacctggtcacttgcgactggtataaaactttcaagctacatattagcccaacctcagtgtttcatacctcattccaccccaccccaactcccaaaaagcatcatcagatagtttttaatttaataactctgtagtcataactagaatcttagtcccttaagaatagactcttttttctctttgtacctccagtacttaagagactgtacaagattaaaacagtgttcagagaaaataagtttgaggcatagtgccttttaaagttgaactggccaaatgaagtcaaatctaaaatgtgtagattagccacttcctggtttacactgatggctaatttttaatttcatactgtttgcctttttccatttatcaaagaatcctgctcaagccatcagcctgtatattagcaaagaataagcagatgtgaatgcaggctgattttattattagccaaagcaaaacataatttttaaattcccatgtcagaataaaaagaaaaaagttacaaattatataatcttgcacagcacatttcatataactcaattccttatagctagaacatcaagcagtaacaacatagaccatcttcagaaaaatgagccataggtcatagttgtaatttttttttttttctttcagacaatgtcttgctctgtcacccaggctggagcgcacagtggcacgatcatggcacactgcactgcacccttgaccttccaggctcaagtgatcctcccacctcaacctcccaagtagctaggatcataggcgtgtgccaccatacctagcaaactttttttatttttagtagaggcaaggtctcactacattgcccaggctggtctcaaactcctgggcctaagcagtcctcctgcctcagcctcccaaagtgctgggattacaggtgtaagccactgcacccagccaatagttgtattctttaaataattttttcaccacagtgccctctaaaattaaattacattcaaattttcttttagtttcacattcttttccagttaatcatttccaataatatgcaaaactgcaagctgagtatagtttcaaagaatgctaattttttcccctaatttaaaactttctgttagtgattggaagactgaccaaagggtcaggtagtaaagcacagtttaatcatagaatctcaggactccaaagggccttaacttctccagtcttgtaactaatgattgaattcttccataatattcccaagaaaagattgagttctggtattaaacctcagagagcaaagtagtcactacatcccaagacagttcatttcatttttggataactccttaagtattaaaaagctcatctttgcatctttctgtaacttctacccagtcatcctaatcctgacttttgaaaccactctgaacaattttcatccttccgtatgataaccgttcatctgtttgtagacaactaccatgtccccctaggtcttatccaagttaacttccctagggtgatttggccattcttcatataaactggttcaaaatctcttcagtatccacaaagtacagggcctgaactgaacactctaactacaggtagtacagtacagccgatccagtgcacagtagcattgggctatcacttttttgtgttctgggccttaaatttccctcgagttccccaaattgcattagctttttggacaactacatagcactgatggttcatactgatcttgtaatcaagtgaaaatcctaaattattttttaaacaaatgtcactgttaagctaactctctcaattctggtacttatacagatcatttctatgttaagactacgtaattataacaaataatttctgatgattatattaccaaggttaatgggatgaaatgaaatgaatttattttatatgttatatactggccatatataatgactttgtttctgttgctctggatctatatcctgttggtatttagaatgtcatgttcttcgtattttattgtacatcttgactgggggggaaaatagatgcattatgtttacctggacattttctccatattaatctttttctaaagtccatgaacctttcacctaaattgtttatttttaaagctaattttgaactcccccccaccgcccaccgctggtatgtcagtattcaaaatgtatttttctccatgcttctagaattaaaatacttcctgatggtcaaaatattgtcatttcttagcacacctttttttgtattcttgaaataactgaatgttacgttttaaaaaatagaatatgaataaattagagataaattatttctcttagaaaaagcttttctgctgtttaaggtacttttgaaattttggtaattaaggttgggcacggtggctcatgcctctaattccagcactttgggaggctgaggcgggcagattgagcccaggagttcaagaccagcctgggcaacatggcgaaaccccatttctccaaaaagatgcaaaaattagccaggcatggtgacaagagcctgtattcccagctacatgggaggatcgcttgaacccgggaggcagaggctgcagtgagctgagatcgcaccactgccctccagcctgagcaacagagcaagaccctatctcaaaaaaaaaaagaaagaaattccgtcaatcatttaattatttatcaactttaaagcagaaagccattttcctgtcagtttgaaatcccagtccctagtcctccaaatagaaaggaattcatttctttatatgttgcatatagtaaaaatcatttaaacatatttacactccccctacctgaaactcagctatttaggaaacttacttatccagaatacaactagaaacctagaaaataactacaatagcagcaaaattattcctacccttaaaaatccactcatgctcctcacaattgagcatctaaagacactctctaaggctgacttgctcccatgttttaaaaagttgtatagattcgtgttccttcataccttgcacatgctattccttctagttggagtgccttttgttattttatctatctggttaactcctactgttctggaaggctgagctaacaattatctcctctttaaagcaggcttaccttcaccatcccgagttggatagccctattccttctctctatattcccataactatctgggctacatacctccatgtagcattggatgcagggacttacatcaaagactgtgatttgtaagagtaagggggaccatggctgagggtatctaggacctagcaagcacttaggaaattgctattaaatgaaataaactggttgctagtcaggttctagttaatagcagattataaaagcaacaaattaggagaacgcagaactaaagcatagtgagagaaaagaaataaaagcctgacaaaaatatatatgatatatactgagcagacaccaaaacttggaaagcgcaacagcctttcaatatgaaagaaatcaactcttgcatacctctgaagttcctgagggtgctttctgttctacagcctaggtctttaatcagtatctacaatgacaactctgagtcatcaagaaaaggttaaattatgagcagcattctgtgtaaaagaagtcaggaaattgtagaaagccatacaaaattatttaactaaggtgggcactgtgactcacacctgtaatcccagctacttgagaggccaaggcagaaggatcgcttgagcccaggagtttgagactagcctggggaaaatagtgagactctgcaaaaaaattattaaaacaaaaaggattgtgcgcataaagattcaaatcacaatgtatttaaaaatgtagctattcagaacaattctccccctgagattctggtaggaaggttttattgtattatcaaaatatataatatttaaatatttgtccaaaatatctcaaactgccatttaatttagtttgctaatttgtttccttttcttaaaattttgtggtcaaagtcctaaaagtcaagaagaagtatcagcaaaaacaaggatttttaggaagttggtgtatattaaagattaactccagtcctttttaccttctactgatttacatgaaataaaagagccttcctctacattctttctaccatggtttttcccctatcatctgtgagcaaattattgaaccaaacaacaggcatcttcccgaagattgaacactaattctccagaattgggtagtcttcgtctagctaaatggagagaaccttctcaggatggctgggactggccatggtcgctctgattattcccaagttaaggcccccattttgagtggcttggcccaggaagtggtaggagtcaagttgagtttcaaagcatcatccaaactgtcagcaggtacctaactggtaccctggtaccaattgaatgatactggtttcccctactcctgctagctcctgtccatcagaacaaggctaattctccagtggcccctccctgtccaggctattaatgaagtatggaaggcttagttcccatccctgcagcttcttcgtgttacttgaggaagcaaaatggggcaatacagaaataaaagtatttctctagccaggtccttctagtcaatagttttcactgatctatcgtacattttaaatgaaaatattttcactactggaaccctgaacttaagcttttctattatggggggaggaagggaaaccatatgatctgcagcaaaggtacatcctgatacacaagctaagagctcttttatctttctgcatcccaactgagtttcataatcatgaacagaacttgatatattctctctagctgaaccagaagatctctaaggtcttttaaaaccacagttctgagttctagataaagtattgcacaatcttcaaactaaaaattatcttgaactcagtatgatgaaagagagagacagagggaggaagggaggtggctgggcttgcatatatctagaagagctgccaagtctagtgggcagtgccccatcccacagtgatcttcctgccgggtacaagcctttcattccacaatagaagacttcttttgggatactgagttaaagatagttatgaatgtgcaaacagctagtatcagattccttacagaaagctaatttttgatagagaaacaaaagaaaactctttaaagaagatgaaagtcaaagaggattgaatgggaggagcttcataattttgcttttgtttatgccatatatttgctctcattctcttcatatgttaatgttaggaggaagctaaaaactcctactataacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaaccttctttgtgtaatttgagaaaggggcttcatttttaaagccttctgcttaatttgtaaagttaaaatggaatttcatccaggtataattttagtcattctttatcttaattttaaatttaggccagcacagctgaaaacatttgccatttacattccaggataaactgaaatgccaggatgacaactgcatttcatgatacaatatagaggcatttcagtgtggcttaaacattcctattcttctttggctattaggtgttggcagcctcatgtactatcacagacttgtgattagtaaatcattactttaactagtaaaaaattgaaaattcattactgactttatgaatagcgatatcacaaacacctaaggacttcttggaaataagtaagcttaaagttgatttcactaccccagcttttagactcctttgccctgtcccacaaggtacgactgacagtgactaggaggctgggcatgggaagcatggggatgtgtgtgtctgggtatcaggttaaggctgtttaagttggggaaattctttttcctctcattattactgaaactcatactttctattcaacctcatcactgtttcattttcagccatgactgacaacataaaaccaaaaacatgtgtatgtaacactggactctaaaactatgaggcccctaaagttttctcttcaattcctcggtaatgttagaattttatatgggacttggaaaaataaaatttaaaaagaagaaaagtaaagtggttccagagttacagtcttatccttttaagccataactgaagtttatggagatgagaatggtatatacttttgttggtttatttacctcactcaccatcagtttatgagtgcatataagtttgtcttttgttttagttagtttaagatatataccaaaactctgttaacagagaaagatgttttcagtgtagcatattctgctcctcccagagtcagctggccactggggaataaaatcaatacttaccaggtaactaaatgtctcaggaaactgcttgtaagtagtcatccctcttcaatccagggaagttgtaagttgctctcaggaatgcacagccaaattctggttgaatttagccaagtgaaatcacagatactaacgttttaaaagaaacatgattagtgatacatcagcataataataatactagcaataatgatagctaactcaggcatagcacatagcatagcatactttacataagtaaagtgcttagaatagtttaattcatttaaccctcacagcaacttgtgaggtaggtaccatataataataatcccccacctgcgtttttgagttataggcatttgctaataatagaattcttcctttgtgtttgttcagttgttaacttcctagtttccaaggcaatgtgcttcattccaacagactctggtattttatttcgtctatttttaaaacattgaatagttatttttgtttcttggtaaaaagacttagactattcacatatgtgcaaaaattaagtcatttaaaaattccctcttcctagtattatagtaagtcagatggatggtggcagctacatcataatttttttttgtacctggggtttgaagctttgaggttaataatttatttacttttttacttggctaacctcacctctcatttatcttcaggactttccttacaaaaagcctaggttttcaccaccttagtttgaagtatagatccatctctaccatctatgatgaatctcggcctttttcttttagtatactgtcatatgattctgtcagcatttatttttctatcttttattatcaaaaatttcgaacaaaaatagtagagagaatagtataatgagctcccagcttcagtaacacagacaatcttgttttatctgtattcaacatattattacattattttaaagcagatctcagctgggctcacttgagctcaggagctcaagaccagcctgggcaacatagggagacctggtctctacaaagagtacaaaaattagccaagtgtggtggcacacacttgtaatttcagctacttggaaggctgaggtggcaggattacctaagcctgggaggtcaaggctgcaatgagccatgatcacaccactgcacttcagcctgggcagcagagcaagaccctgtcttcccaaaaaaaaaaaaaaaatagatttcaaaaaaattatttcatcaccttggtggttcttttttgagacagagtcttgctctgtcacccaggctggagtgcagtggcacgatcttggctcactgcaacctccccctcccaagttcaggtgattctcgtgactcagcctcccgagtagctgggattacaggcgcatgcaccacgacacccagccaatttttgtatttttagtagagacgggggtttcaccatgttggccaagctggtctcaaactcctggcctcaagtgatccacctgcctcggcctcccaaagtgctggaattacagctgtgagccaccgcacccggccacatttcatcaccctaatggttctgagcaaaagaactattaacaaaattcttgatctctatggatattttaaagaaaagtttgatgacaccttttaaatgcagtactttttttttctttttttacctccagcagttgcaaatgtgagaccacattagaaaatactgtttcactggagtatatgctaacacttaacctcaattaacttctttgtaaagggcaaaaatatatttcccaaaccatatataagaagtgtaatgtcatatcattattacagataaccagttagtatatacacagcaagattctaagctgctatgggtttggtattcaaataagtaagattgttttatagccttattttgttcccccgtatagattcaatctccccaatttgttttagctactcttctcagctgaaggaatagaaaatcctgtgttggactgtcttgtaaaaaggacaagggagtatccttctaaacctctactcatttcagaaatcttaccacccctttcagatgatttctcaaccactttgtcaaggaaaaattattcagactttaaagagcacattcgctccaggatagggagaggaaacaagtctacccaagccctgtctaatcacttacctcatttcaaactggtcagttgaccacaatttcactaggatgaaaagtgtgggatttcatccctcccaaagtgtgggattacaggcatgagccactgtgcccggctggataatgataattaaacagccttatggcattagtcttaatgggatttgacaagcagaagtggctactatttgaaattctgcctgttggggggaaaaatgaagcacacttcaattttaagggctatccccaacataaagacacttttcactccccatcttcaagtacaaagtctcacattagtcagagctaatgctagcccttgctcaaattgtgatgattcatttatactgcagtgcaagtactgcagtttcatttggctttaaaatgttgtggagtttattcttcatctttcttccttagaaggtgatgtaggtctctgcctgttaaagccatggctttgcttgaaggtcctggcactgggtagctcacataaactcaccccatcagtaaacctgttgatattgaacaaggaatgagaccctactctgtctctgtctcctttccccacttgccttcccaaccccatgccctaaccactctgatttttttttaaatgattctgggtctcagacatatcccttttcccaggagccttctagcacttggctcacagatccacagcctttctcataagtcctgtgtcttttgaacaattcataattatttttgtttgattttaatcaatataccatgtggcttagttgtctcatctctaaaagagacaaaagtaacttcactgaggacagtattcaagcaaatctgttattctgtgggacctacggtagtagaatactttttcctaaacaccgaagttgatatgcagtgaccaaaatatcctattaaaaactttgcacagttcacaattattgctaacctcgattttttaaaacatatcttaaaaatatttctttaaaaattttaagttttattttagttctttctggatcgatgtattctagtctccctagctaaggatctaaagatagaaactggaataatgaacattctagtcttcaattattgaaaatattatcacttacataacaagaatatgggtatggaatatttactaacacaaattcttatgtagtaaagaacaacagaagaattgcatttgtccttttcttagaatgcaagcctttagaatcaaatttctgttctttgctctcagaattttattcacattgaagcaatataggaatattaaataatagtgaatgttaatgtctcatttaaggtaactatgtagttttcctttcctcctcctcagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttctgtcttaggaaaacggcaggtttttttttttttttttagacaaggtctgacaacattgcccaggctggagtacagtggcaccatctctactcactgcaacctctgctcctgggctcaatcgatcctcccactttaacctccccagtagctgggagcacaggcatgcagtaccacacctggctaatttttgtattttttgtagagatgggggtttcaccatgtcgcccaggcttgtctcaaactcctggactcgagcgatctgcccgcctcagcttcccaaagtgctgggattacaggcatgagccactgcgcccagccaaaaggcagattttaaaagttcattttatatcccatcttgccagtgagtattaaggaaaattataacttgggacagcagtgaaacagtactttttgattaaaacattatacagcccaataattccaggcaattttcattttagatgttagaaagactaacgcttggagaggttaagaatttgcgccaagttggccgggtgcggtggctcatgcctgtaatctcagcactttgggaggccaaggtgggtggatcacaaggtcaggagtttgagaccagcctggccaatatgatgaaaccccatctctactaaaagtacaaaaattagcctagcgtggtggcgggcgcctgtagccccagctactgaggaggctgaagcaggagaatagcttgaacccgggaggcagaggttgcagtgagccaagatcgtgtcactatactccagcctgggtgacagagcgagtctccgtctcccaaaaaaaaaaaaagaatttgcaccaagtcacagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatctctactaaaaatataaaaattagctgggtgtggtggcaggtgcctgtaatcccagctacttgggaggctgaggcaggagaatcgcttgaacccaggaggcagaggttgcagtgagccaagatcacgccatagcactccagcctgggctacaagagcgaaactctgtctcaaacaaacaaaaaaaaaagaaatataaaagaatatataattcaaaagacactgccacattactagaatctcattcaggcattgataattagttcagtccatcatcataatgtatgaataggtctcccagcatgaggccactcaggtttgcaggctttccattgatcttgccaggttctaaaagcaggaatggtcttggtttcaccgtttcagacacctgatataattgagctaagaaacagtatcctttcttgctctgagtctctttcaaggtgttaatgtaatgtgataatggatttccctgaattcataacacatttatttattcctttactctcagctgttaattttttcctcactttattaataacctttggaagaaacattagaatcaacatcgtgctggtctagatggcagacagcaatattagtctagtaattacctcctcctcagtccactcccatgcagggagactaaggttacataggtgccaatttagtggaccgtttttaccaccaggcaatatagctgcattcacaattaacccgttttgcacaacccacccccatcaggtccttaggaattctgacacaaggtttaaaaacatagttacaatttcttgtttaggaatcatccctggttctaacactggtagttatggctctggtcctagaaccactgcatagggaggggcagggggagtttagatgatatgggaaagaaggaaagaaaaaagtatagtcattatatcagcatactcccctcttgtcaagaattgcatagtcataacagcatcctctaccaccccccttccccagatcaatcagaaaaacgaaagaatatctagtggggacactcctttagccccactcatgttgagtgtgagtacacactggtaaaggcaagtaagccagcccttcctgctttcatctccccctgttttagacaaccaatgttttcattgcccattttagtctctatcaaactattactctgagaagaatatctctgcccactgctggaacattatgggctgtaccgtgtgttctttggcctaaagaaatggtgttcagctctccaaatatgtgcaatatcttctgttctggcttttttatggtattctcatcattcacatcttccaccgggcaagcaaagcccagtccagaatcagtgtctactcctgtcaaaacccatctgtggcctcccagggttaccagcatcagcctcacttgccagcttgttcagggctttcccaccagggaaatctgccccacagccatgggcagtgtctgtctcttttgctggcagacagaacagttcttattggcattttgtgcctgaaatgatacaaaagaaacctgtctagatgcagcccatctctgcactgttgcagtacccgtttatccactcatttgatggacccaggtggccacctcgagggagcacacagggttctctgcttgtcaatgtcaatcattttccaaacccagaaagaggctcttatgatgggcatcaacatattctacttattgcacccctcaaatttccatagggccattctccatatgggcatccctttaataaataggccaggtttccactgcccttctgcctgaccatgtgaccaggccactggtgactgtccatgagtcagtaaaaaaccaaacacgggagcttttgttattgttcatttcttcagaatgcaattcaactgccaagctaatgtgatcttaccttctttgatcaagagtggcatccttccaaacaggatgctgtcgattcaccttggaactgtcatccacacaccaagcagctcttcgttggtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcccatagcaaggtagtaaatgcaccgagatggaaattctctagtgcaaagtcctagtggttgtcactgggagatgctcacagactttggccataagccccagtaaacatcctgcaaagggcgagcagatggagaatttgtccctaccagcactccagcttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatctcatactcctatcaaccctcacttttaccctttcttgtttaaaaaaaaaaaaaaaaaatgttgagtccccaacagcaggttgagccaagggaccttgccccttttgtcagtctttgtattgattaacctgcctcaacattaccccaagtaactgttggtcagctttctcactgtaatctctgccttctgactttttcaatttctccaaactggggtgaatacagcaaacctgtttggaatcccttaacattgggagaacagcagaagctccctaccaacctttgatagtattatattgagatctttgttttaaccccatcgatttccactttattcatctcatttctttttatttcttttttatttttttgagacagagtcttgccctgtcacccaggctggagtgcagtggcgcaatctcagctcactgcaacctccgcctcccaggttcaagccattctcctgcctcagcttcccgagtagctgcgattacaggtgcccgccaccatgcctggctaatttttttgtatttttattagagagggggtttcaccatgtttgccaggatgctctcaaactcctgagctcaggtgatccacccgcctcggcctcccaaagtgctgggattacagatgtgagccacagcatccggccctattcttcccatttcttattagccctctaaagattccaccctgctgggatgagtcccatgattctcctctttcttttttctcttagtttcaccccatcactgttttcttcattcaccttatttattaataaccatttaaactttccaccttcctgggatgagtcctgtgactctcctctctgcctttccccagtcttttgttaattacgctcatgttttcattggtgcccatacaaaagaggctccctcagccatagcatttactacagccagagtaatggatgtattcagtgagtgaatatctcagtcatcataaagccagtcccacatggcctgcataggaaccaaatgagccgcttcacctggggtactccacttggcattgataggtagagttggacagtctctaccttctcagggtgtacagaccttacagtggcttttattccattcactaggctgactgttccctcaggaataactccctgtgtgtctggatcacattatacccattgttgattgttcagtagtgagctgtgggtcctgcatcaacccaaacatgcctgtccactctgcagcatttaaaaccaaagaaagtgccctaaattagttattctcacaatccattttagtaaaggattttcagtaaactgatgataccaatctatgaaatgagacaatttcttcacactgtaccctctggtttcagtagtttcttggttttgcccttccctcacatcaactaccttcgtggtaaccacaggtcgtagaggtactgtcatccctgtataatttttcctttgggggtcagcttgaaggctagtggcctgggctcagatagactgaaatctgagcttggtctagcatcaaggcctcatccagcatttgtttcatttctgttcagctattacagacaaccaccaccaagggagtgaatatttcatctttttcttactagtttgcatatccttatgcatccagtgaaccaactccctgagttggatccatctctaaattccactggtaacttttacctttagcaattgattgcgacacagttgcagctccaaaccatggaagaccacgataatgaaccaggaatcaaaggttcctcatctcccaccctttcattctttctcttcccaaaccacatatttctgtgagccagggccgttctagcaaaccctacttcactgacactaactgaaggtggaaaaactcagaactgttttcctctgctctcgcaccacacaacaacaacaatcaacacacaagacttctttcaccaaatgtgtggggatttctccccattaagaagcaagtaatcagccctgctgctgggtattctctaattcaattctgacactatagtatcacatcccacagtttgagggcttggtccccaaggcctccccttcccaccctttcagacaccagtcacaagtccaggcctccagaatgtcagactgactggctacaaatcagagatcctacacctgctctttgggttccattaatttgttagatcagctcacagaagtcagggaaacacttttaccattgtgttataaagaaaattacaaaggatacagatgaagagatgcattgatggaggtataggggtgaagtgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaaggtgatgacatggaatagtattacaggacaattttgagatttcagtggatcttgattctccttaagaatattacttctcagcctgggcaacatagggaaatcccgtctctacaaaaataaaaattaaaaaattagccaagcgtggtggtgcgcacctgcagtcccagtgactcaggagcctgaggtgggaggactgctacttcaaaaatatgcattcacctctctgatactcagtgctagttattcctgatttcccctagaaaagagtagtgaacaatttttagatactttctttgttttgttttgttttttatttgtttgttttgccctcccagatatataatgaacactttagaggtaattcctatttctcctttacttttctcactttctccataacggggatcttttgttcattcaaagctggtttaaatgccaaataacaatgaaaatggcaggcattttagtcatttttcaaatctcttagaaggtggtttaacattataccatacctacttacagtgctttcaaagcttatcttggctaatagcatatttatttttggaaacctttgttcctgccaatgattatagttctcgttctaagtaatttgagcttaatacataataaatttctagcacaagaaagacaaaaaatgtcagtaacttaaatgaaaaagtttaagacggctctttgagctgagtatcgcatgccatgtctaaacaacagtttaacttcactacttatgtcatctgaagatggaaaaactcaattagaatgttatccagctggtaagagcaggcttatgttatatttcagtatttgtccatgtgtatttataaatcattactgtggatgtaagaggtatttttttagaatggttgaaatttaaatatgaaaaacacctggataccttgcaaattgaagaaataaaatgatactggttgcagtggcttgagcctatagttgtctcagctacttgagaggctgagtaagtaattactgagtaattactctaagtaattagagtaaggtgggaggattacttgagcccaggagtgaaaggctgcagtgagctacgaccatgccactgtactccaacctgggagacagagcaaaaccctgtctccacaaaaagaaaaaaaaaaacaaataagatgaagaaaaactttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatggaaaacaaaaaaaaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacctagattcaaaaagcaggtccttagagacctaaaaagagacttagactcccacacaataataatgggagactttaacaccccactgtcaatatcagacagatcaacgagagaaaaagttaacaaggatatccaggaattgaactcagctctgcaccaagcagacctaatagacatctacagaactctccaccccaaatcaacagaatacacattcttctcagcaccacattgcacattccaaaattgaccacacagttggaagtaaagcactcctcagcaaatgtaaaagaacagaaattataacaaactgtctctcagaccagtgcaatcaaactagaactcaggatgaagaaactcactcaaaactgctcaactacatggaaactgaacatcctgctcctgaatgactactgggtacataacaaaatgaaggcagaaataaagatgttctttgaagccaatgagaacaaagacacaacatactagaatctctgggacacatttaaagcagggtgtagtgggaaatttatagcactaaatgcccacaagagaaagcaagaaagatctaaaattgacaccctaacatcacaattgaaagagaactagagaaacaagagcaaacacaattcaaaagctagcagaaggcaagaaataactaagatcagagcagaactgaaggaaatagagacacaaaaaacccttcaaaaaaataaatgaatccaggagctggttttttgaaaagatcaacaaaattgatacaccgctagcaagactaataagaaaagagagaagaatcaaatagacgcaataaaaaatgataaaggggatatcaccaccaatcccacagaaatacaaactaccatcagagaatactataaacacctctactcaaataaactagaaaatctagaagaaatggataaattcctggacacatacaccctcccaagactaaaccaggaagaagttgaatccctgaatagaccaataacaggctctgaaattgaggcaataattaatagcctaccaagcaaaaaagtccaggaccagatggattcacagcccaattctaccagaggtacaaggaggagctggtaccattccttctgaaactattccaatcaatagaaaaagagggaatcctccctaactcattttatgaggtcagcatcatcctgataccaaagcctggcagagacacaacaaaaaaaaggagaattttagaccaatatctatcgggggacttgccccgataatcacgtaggttcttttctatttttcttaagcgtcggccggcatgataaataaagggacagagtacaaaagagagaaattttaaagctgggcatccaggggagacgtcacacgttggtaggatctgtgatgcctttcgagccacaaaaactagcaagtttttattagggattttcaaaaggggagggagtatgcgaataggtgtgggtgacagacatcaagtacttaacagggtaatagaatattacaaggcaagtggaggcagggcgagatcacaggaccacaggactgaggcgaaattaaaattgctaatgaagtttcaggcactattgtcattgataacatcttatcaggagacagggttttgagatcaactggtctgactaaaatctattaggcgggaatttcctcttcctaataagcctgggagtgctatgggagactggagtctatcttacctctgcaatcttgaccataagagacaggtacgcctcggggtgggcgggggccagttcaaagacttactcctaggtgcgcattctctttctcagggacgttccatgctgagaaaaagaattcagcgatatttctcccatttgcttttgaaagaagagaaatatggctctgttctgcctggctctccagcagtcagagtttaaggttatctctcgtattccttgaacaattgctgttatcctgttcttttttcaaggtgcctacatttcatgttgctcaaacacacatgctgtacaatttgtgcagttaatgcaattattacagggtcctaaggtgacatagccttaggctgacaggattaagagattaaagacaggcataggaaatcacaagggtattgattggggaagtgataagtgtctatgaaatctttacaatttatgtttagagattgcagtaaagacaggcataagaaattacaaaagtattaatttggggaactaataaatgtctataaactcttcacaatccacgtttttctgccatggtttcagccggtccttctgtttggggtctctgacttcctgcaacatctctccctttctttttatataaatgtgccatggcgatgaaggcttgttcgttctctcgattttgacgcaggattctttgactggtccagcacactaaaaacaaaccgattaaacagagaaacttaattctaaaatttactacagtggagcccccaataggcttaatctaagtcgtggggtttaatctataaagattttctgccacctgatctaacgcctcagctccaggcagaatggataagtgagcttgagaggcttcaaaaatttgtttctttaattatgtctaatgataaattatcttctttacctagaaggtgtcctttgactttttcctatgaattatcagtctcattataggaatacggggtgatgcagaaatccgaagtattccaatcgcactgcatttgcaatgcgatgttcgagactcactacttgatctctaagccaaataacagactgtcttaaatcattaatttgatttgccaatttttgatcgatgccttgttgagaattccacatttgggtggaattggcttgccaatcattaacaaaatgagccctttgaatagattggtgtaatgccattctagcagtggtggccattgcagtgacagtaattaggcctatgataacagcaattaaagtgaaaacaaatctcttagatctttttttagaattcgctgtagcacttcattaattaaatgtattgagggggaggatacctaaggtctaggtaaagttaccggaacctagattccttcttgagctcgaaccaacattacacttttcctggagtcaaaatgggagttaatacaagtgtatagatgacaattgatgcatcggacggtttgattattcgtctaaattttgatatttcctactaacagtgtgtaaggaggcttaacacaactctgtatgggaatagtcaggttggaggtaagtaaagcagaatgtctgggtctacgttgatactgagagagtgggatggtaatgggaacaacagtcgaaatagttttcttttcctatactggcagtccagacatggcaatagccaatttttaaagttctgggtgttctgggctcagaatggggagtatcatacgaggcctgggggtgggtaatgcctttatcttcctattttaagagaaagaatgagctgatcctcgtatgcacagtagaatgatgattctcattctcctgataagaagtaaaataagtagcctccaggcattcctttccaccagaggagcaattgttttttaaatagccttttggtgcctagtctattactagaccatatgagtcattttttagtattactgcatgtgagttaacacagtcttcctaaattaaagttttagatgggccctcaaaatttttagggcatggttttcctgcaggtttatattgaaagtatggggtatctcctattactcctcctttcatttgttttaaaggagaaagggagagaccagagactaaatgtcctgttttatctgtagctgatgtttccggaagataagcagcctagacttgagttcgtagatggatgcaactaggtgcatgtccgaggcacagaggggggtatttataacctatggtaacattaaatgcagtgccttcttctcctggttgagcagggcaacggtcatctgtggctctaggcatccacacactatcgttagtgtagatttctgcaggagcatctatctaggtgagaggtcgaataagtggaggaaaaggcacataagcctaataagaataattatgtgtagcaggtaaatcagtgtgagaggaaactggtgagacagaaagtataaggaggagaatcattaaataaaacctagtgtaagcgagattgagtgctgaaggaggaagagaagaacagagggatgttattttcaggctaatagaaatggtgagatttttaggtttgtaaggagaaaaagaaaagtaatcaggagaagtgggattagttagatgggtctccattgccttcagggaggattgatttacacctattgtgatttgatgtgcctgtttctgaggaatcagcacagatctcatcatatctgaaggcagtctctgacacagacgtcttttctctgtggttttgattgtcagtattcacctgaagcttgagtcttctggtgggtacttagacaggggattgatgatctcctggtgaaacacaagcatatcctcttcctcatgttataattgtgccaggttcctaggtattggtttgggagtttttccataacactggcttgccttcgtttaaggaaaattttttgcctgtataatggcattcggctgcagttagagtattatctttaggaacatttaaaaaatttaaagtaaacaatgccaaatgtaattgggagtggggagttgttaaatcatgttttggttgttcagactgttgggacaattgggtttttaaagtgcgattgtaagggattctagtagtaggatctgtgatgcctttcaagccacaaaaactagcaagtttttattaaggattttcaaaagaggaaggagtgtgcgaataggtgtaggtgacagacatcaagtacttaacagggtaatagaatattacaaggcaagtggaggcaaggcgagatcacaggaccacaggactgaggcgaatttaaaattgctaatgaagtttcaggcactattgtcattgataacatcttatcaggagacaaggttttgagatcaactggtctgactaaaatttattaggcaagaatttcctcttcctaatgagcctaagagcctataggagactagagtctatcttacctctgcaatcttgaccataagagacaagtacgcctcaagggggccagttcaaagacttactcctaggtgcgcattctctttctcaaggacgttccatgctgagaaaaagaattcagcgatatttctcccatttgcttttgaaagaagagaaatatggctctgttctgcctggctcaccagcagtcagagtttaaggttatctctcgtattccttgaacaattgctgttatcctgttctttttttgaggtgcctacatttcatattgctcaaacacacatgctgtacaatttgtgcagttaatgcaattattacaaggtcctaaggtgacatacatctttctcggctgacaggattaagagattaaagtaaagacaggcataggaaatcacaaaggtattgattaaagaagtgataagtgtctatgaaatctttacaatttatgtttaaagattgcagtaaagacaggcataagaaattacaaaagtattaatttgaggaactaataaatgtctataaaatcttcataatccacgttcttctgccatagtttcagccagtccttctgtttaaggtctctgacttcctgcaacaaatatccctgatgaacatcaatgcaaaaatcctcaataaaatactggtaaaccgaatacagcagcacatcaaaaagcttatccaccacgatcaagtcagcttcatccctgggatgcaaggctggttcaacatatgcaaatcaataaacataatccatcatataaacagaaccaacaacaaaaaccacatgattacctcaatagatgcagaaaaggcctttgacaaaattcaacagcgcttcatgctaaaaactctcaataaactaggtattgatggaacttatctcaaaatagtaagagctatttatgacaaacccacagccaatatcatactgaatgggcaaaaactggaagcattccctttgaaaactggcacaagacaggaatgccctctctcaccactcctattcaacatagtgttggaagttctggccagggcaatcaggcaagagaaagaaataaaaggtattcgattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaatagagagccaaatcatgagtgaactcccattcacaattgcttcaaagagaataaaatacctaggaatccaacttacaaaggatgtgaaggacctcttcaaggagagctacaaaccactgctcaatgaaataaatgaggacacaaacaaatggaagaatattccatgcttatggataggaagaatcaatatcatgaaaatggccatactgcccaaagtaatttatagattcaatgccatccccatcaagctaccaatgactttcttcacagaattggaaaaactactttaaagttcacatggacccaaaaaagagcccgcattgccaagacaatcaatcctaagcaaaaagaacaaagctggaggcatcacactacctgacttcaaactatactacaaggctacagtaaccaaaacagcatggtactggtaccaaaacagcatggtactcgtaccaaaacagagatatagaccaatggaacagaacagagccctcagaaataataccacacaactacaaccatctgatctttgacaaacctgagaaaaacaagcaatggggaaaggattccctatttaataaatggtgctgggaaaactgggtagccatatgtagaaagctgaaactggatcccttccttacaccttatacaaaaattaattcaagatggattaaagacttaaatgttagacctaaaaccataaaaaccctagaagaaagcctagacagtaccattcaggacataggcatgggcaaggacttcatgactaaaacaccaaaagtaatggcaacaaaatccaaaattgacaaatgggatctaattaagctaaagagcttctgcacagcaaaataaactactgtcagagtgaacaggcaacctacagaatgggagaaaatttttacaatctacccatctgacaaagggctaatatccagaatctacaaagaacttaaacaaatttacaagaaaaaaatcaaacaaccccatcaaaaagtgggtgaaggatatgaacagacacttctcaaaagaagacatttatgcagccaacagacacctgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaaaacttttacactgttggtgggactgtaaactagttcaaccattgtggaagacagtatggcaattcctcaaggatctagaaccagaaataccatttgacccagccgtcccattactgggtatataaccaaaggattataaatcatgctgctataaagacacatgcacacgtctgtttattacagcactattcacaatagcaaagacttggaaccaacccaaatgtccatcattgatagactggattaagaaaatgtggcgcatatacaccatggaatactatgcaaccttaaaaaagggtgagttcatgtcctttgcagggacatggatgaagctggaaaccatcattctcagcaaactatcagaaggacagaaaaccaaacaccacatgttctcactcataggtgggatttgaacaatgagaacacttggacacagggtggggaacatcacacactggggcctgtcgtcgggtcgggggaggggagagggatagcattaggagatatacctaatgtaaatgacgagttaatgggtgcagcacaccaacatggcacatgtatactataagtaacaaacctgcacgttgtgcacatgtaccctagaacttaaagtataataaaaaaaactataacatgaaaaaaataaataaaagtaaagttttttaattaaaaaaaagataggaattatttctttgataaaaccaccaaaaaaaagttctattcacttatttcacatcaaaaaagaatttgagtgttagaccaagtaatatgttaatgtcttatgactgttaaatgatacctatttaacacctttatctctctgaattaatgatacttggtgtgaatatttattccaacaaaagtaggccatctaagattatattttcctcacagatggttgagctcttctcacaccctctatagccttaatatatagactgtaaagtatactgtcattttaaaaaaagtgaaaaggatatttatatcaggctaatcaatttgaattttgggtaatgaacacaccaattacccgtgttttccaaatctcatgtgcacaagggactatgaatcatgtacttcattaaagtgcaaggcacattactattgaattttttctgaattcatattacattattattattagtgtcaggagatactatttaattcagaaaaaacagcctggacaacatggtgaaactccgtctctactaaaaatacaaaaattagccgggcgtgatagcgcatgcctgtaatcccagctacttgggaggctgaggcacgagaatagcttgaactgagaatgtggaggttgcagtgagccaagatcatgctactgcactccagcctgggcaacaagagtgagtctctgtctcaaaaaaaaaaaaaaaaaaaaaaaaagacgagataccttaacagacttttttttaaatcttgtgattttactagcttagaaaataattgatatcataattgaagcataattttatttaaaaaaatacattttgactctgtcctcacctctctttccacatcaccttagtgaatggtgagcagaaaaggtgtttgctaaaaatagagttcacagtcagatatgtagtaaacttaaacatatttgcaatatgtaaagaattctcaaaactcaataataagaaaacatacaaacaacccaattcaaaatgagaaaagatttgaacagatacttcaacaaagaagataatacagatggcagataagcacaggaaaagatgttcatcattagtcattaggggaatgcaaattaatgccacaatgagatacctgtaaacatgttttacagtggctaaaatcaaaaagactgaccataccaattgttgacaaagatatagaacaatggaggccaggtgcggtggctcacacctgtaatcccagcactttgagaggccaagacaggcagatcacaaggtcaggagatcgagaccagcctggccaatatggtgaaaccccatctctactaaatatgtaaaaattagccaggcgtggtggcaggcgcctgtagtcccagctactcaggaggctgaggcagaagaatcgcttgaacccaggaggcagaagttgcagtgagccgagatcatgccactgccctccagcctaggcgacagagcaagactccatttcaaaaaaaaaaagaacaatggaaactcataacactgttagtaggaacgtaaaatggtataaccactttggaaaacagtttggcagtttcttaaaagttaaacatactcctatcatatagcccaggcattctactccttagtatttacctaagaaaaatgaaacacatcttcatacaaagacattaatattcatagcaactttatgtgtaatagccaaaaaatggaaacaactcagggtccatcagcaggtgaaaggataaattatgatacatgcatacaatggaataccactcagtgttaaaaaggaatgaactattgatacatgcaacaacatggatagattcaaaatcattatgctatatgaaagaagctggacaataatgagcacatactatatgattcaatttatataaaagtctagaaaatgcaaactaagtgacagaaagtagatcagtggctgactggggatggggatgggggctacaaaagggcatgaagatacttttgagcatgatggatgtgttcattatcttgatcatggtaatggttttatggttgtaaatatatgtcaaaacttatcaaattgtacattttaaatgtgcagcttattgtatgtaattatacctcagaaaagctttttggagaaaacaaaaaaatatatattcagagtctatctctctttcaccctttttattatttccagctggtttcatccaccatcatctttcacctggattactgtaaaagcctcctaactagtcttcccgctttttttttttttttaaaccctcatctccttccaatctattctcggcaaaactactaatgtttatttacagttcagggttgaaggctgggcgtggtggctcgcgcctgtaatccgagcactttgggaggccaaggcaggcagatcacgaggccaagagatcaagaccatcctgcccaacatggtgaaaccccgtctctactaaaaatacaaaaattagctgggcgtggtggtgcacacctgtagtcccagctactcgggaggctgaggcaggagatttgcttgaacctgagaggcagaggttgcagtgagccgagattgcgccactgcattccagcctggcgacagagtgagactccatctcaaaaaaaaaaaaaaaaagttgagggttgaaaatttacctattagttctgtaattgctctggcttggatatcttgtactgtgttgaataaaagtgagggaaaacaagaaaaattacctattgaatacagtgttcactatttgaatgatgggcacactagaagccaaacctcactgttatgcaatataaccatatagcaaacctgcatatgtaaccccagaatctataaaaataaagtcagatcatgtcactctagctcaagaccctccactggcttcctctcctactcagaataaaagccaaaggcccgcatggcctaccccagccttgtcatctctctgatctgacccgctattctccttgaccccttcacatcacttcacacacattggtctcctggctacttcttgaaaattccaaacatactccctccattgggcctttgcattggttattttctctgcctagaccactccctcacctcttctaaatgtcactttctccattgggcctactctgaccacccaatttgtttttgtttttgttttttagaaatggggtcatgctctgttgcccaggctggagtgcagttgcagtcatggctcactgcagccctgacctcatgggttgaagcaatcctcagcctcccaagtagctgggattacaggtgcatgccaccacgcctggctaattttttaattttttcatagagacaggttcttgctagatcttgaactcctagcctcaagtgatcctcccatctcagcctcccaaagtgctgggattacaggtatgagccaccacacccagccaaccaccctattttaaatatcaaggtacccaatccctcttacctgctttacttttttgccttattccatagtacttttgacatactctacaatttaccttttttgtgttttctcatcttcttgcactagaatatgatctacatgagggctggaatctttgttggttttcctcatgtatgccaaatgcataggacaatgcctggcatataatcagctcttgaaatatttatgaaattaatgagtgcttatagcatatgaatcctcaagatacattggcaaattagagtaggaccaaagtggggagaagagtaagaagaggtttaaaatacacatgagggaccaggcacagtggctcacacctgtaatcccagcactttgggaggccaaggtgggaggaccccgtgtgagtccaggagttcaagaccagcctgggcaacatggcaaaaccccatctctacaaaaaatacaaaacttagccaggcatggtggcacttgcctgtagtcccagctactcaggaggctgaggtgggaggattgcctgagccagggaggtcgaggctgtggtgagccaggatctcaccactgcactccagcctgggcgacagaatgagaccctgtctctaaaaatatataaataaataatgggggattcatttatttttgagacagggtcttaacgctgtcacctaagctgcagtacaatggtgagatcctagctcaccacagcctcaacctcccaggctccaacaatcttcctgcctcagcctcccaaagtgctgggattacaggtgtgagccaccacacctggcttgcagtgagctatgatcagcccactacactctagcctgggcaacagaggaagaccctgtctcaaaaaaaaaaaaaaaaaaaaaaaaaaaaaaaagcgtgtcctaattagaagagtctgtaattgttatagtccatgacaacgtagaatgctgaatcagttgtggaattgatttttcaaatgcttgttttacctggcaaatcatgtcaaaggtaacctgaggccaggcagagtggcttacacctgtaaatcccagcactctgggaggccgaggcggaaggatcgcttgagctcaggagtttgagaccaacctgggcaacatagcaatactccttctctattaaaaaaaataaaattagccaggctggtgcacttatatcccagctactcaggaggctgaggtgggaggatcactttgagcccaggggtttgaggctgcagtgaggtatgattgtgccactgcacgccaacctgggcgacagagtgaaaccctgtctcaaaaaaaaaaaagtaacaatgcctttataataattacgatttgttattttagccacatagccatatatatgaaatttacgtgacctattatttcagccctttattgctgaaaatgaaatattattttattactatcagtttaaccttaatatccctcatttcagattgcttaccagtatcatggaataaaatctccaatctaaaattcaatctgagttttatatttaagaattttagctttattatttgttttagattaagcttctgcacttttttaaacggttatatatgttcattatctttcatcttacataggagcgggatcgttacgcctacaagattcatcttccagaaacagtagagcagctgaggaaattcaatgcaaggaggaaactaaaggtaaattaaacaaatcagcaaaaaagccaaacagatatagttaatgatcatgtttttattctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttttcaaacttaaatattttgacaaatgtatgtttagttcaatggaaataactttgaattagaattggaattaggggccgggtgtggtggcttatgcctgtaatcccagcactttgggaggccgaggcgggcggattgcctgaggtcaggagttcaagaccagcctggctaacatggtgaaaccccgtctctactaaaaatacaaaaattagctgggcctggtggcaggcgcctataatcccagctactcgggaggctgaggcaggagaattgcttgaacttgggaggtggaggttgcagtgagctgagatcacaccattgcactccagcttaggcaacaagagcaagacttcatctcaaaaaaaaaaaaaaaaaaaaaaaagaattggaactaggattgaacaactatcagaaagcagtaaataaaatcttacactaccttgatctactagaaaatattttcagctcagatcacttttctcaccttctttattcttcctaggtgtctttctccctcttactactctccctatcctccacctcaccaaaaaaaaaaaaaaaaaagaagaagaagaaaagaaaactggtaatcaccccatatggggagtccatttgactttaaaaggttctgaaaaagaccagacataaagtaatggaatcttttcagcactgagagaaaatgctgagagaccatcccccacccaaccctccagagtaacaaagggaaattgattatcttaacttcttagaattaatttatgtttgacttacttttgatactgaaaaatgttaactgttctctaagtggttgattagatagtagtcttccttagtcacatgactcctgccaactataaaacttttcttcttaagtattttcagatatgccataaattctaataataccattttatttttcaacccctgaaattagtgaattattatgtataactctagacttataaaaacatttatatgaattttgaggaaactattaggctacaatattatcctatagacctgaaacttttaacatggtacccactggccacatgcagctatttaaatttaaattaattaaaattaaataaaattaaaaggtcagtttcccagtcacactagcacatttcaagtgctcagtaaccacagttggctagtggctactatattagacagcacagatgtagcttgggacatttccatcattacagaaggatctattcaaccatgctactatagaacaagggaaatattaacatatcattgttggtgttgattattcccattttagcctttcttctcactgattttgcagtcaagggttcaaagtgactcttctctatttgctttaaaaatccttggccaaaataattattaatgataagccattattgagatggtagccaaagaagtttcccaaaacttttattctttttgccttgatatccacctaaacctgtgtagcctacaaataaaaaactcttttattattcaaagtgaaatttggtcaactgtttttgaagttagtttcctccccaaagaaactattattacacttttttgtcaacttttctataagtcattctaaacctaattgctttggcctcatgtgacattacgctgtatggggttgaacctttcattgcccaaatacaaacatttcaccagagagcttgggcttgccccatcacaagaaacacatgctgtacttctcccggggccacagaatcagacttgggcctaaaatagccaaagtggtgactaagattcatttggacagggccaagctgtcaaaacagagaggggtcatgtggatttaccacatccccttgcagggctatttaaagttttaagacccaccaaacaacctagaactaggaacatcagcagggtcattagtgaatgtgtttggcttctgataaggctgtattcttttgagtagttcagccaccttgttaaaacatgttacacctaccatcctcaaggaactaattcccattctgcctcttcagtggacttctagaacagagattgcaacttccttggctttcagagtccaccacacactttattttcacacaactaggtgctcatcctacccagacactattcttaacctcctcagtggtgggtgacagtttaatttgtaatgactcccttggaagtgattaaaagggagttcacagaaagcggtagaaaattacttttgtggccaggcacagtgtttcacacctgtaatcctagtacatttggaggccaaggcgggcaaatcgcttgagctcaggagttcaagaccagcctgggcaacatggtgaaaccccgtctctacaaaatatacaaaaattaaccaagtgtggtggctgtgcatgcctgtaatcccagctattgggggcctgaggcaagaggatcacttgagcctgggaggcggaggttgcagtgagccaagatcacgccactgcactccagcctgggtgacaaagtgagaccttgtctcaaaaaaaaaaagagaaaaaagaaagaaagaaaattactttggtaacttagtcatgatggaatgatggaaaatgtattttccccattttggttaccacatgtttcatgtgtcgagttttttcctcctaattcatactaagctctggaattgtaatacttcattaaaaaaaaataaaaaaaaagaatcctctagataacaatactttctttaataaactacatcgttctgagcacagaactgaatatgaggacattttctcaaactgaatattaggatacatgagacagactgcatgatctccaggctgtgtggaaaatctgtgctctgtggtctggggcttttgagggggcacacctgtactctaaccctggctgtcatctactgaaggaggtactgaggaaagtggtaactgttgttatctgaggatgtctatccagagaagagactcaggagggaatgtattctgaagtcatccctattgcttcttcaattatttctacccctagaaagcaaattccccacagtgaagtgtgttgaagaaattctatacaaatagaagcaatattctatgtttgggtaagtttattgcagtccatttaagaaatggtgagtcgagtccacgtgattcagttaagaggataaaatcatttatttcctatatatacagaaagcaaggatttctaataactttctacagtttttctttattattattattatttttttttttttttttgagagagtcttactccatcacccaggcttagagtgcagtggcgcaatctcggctcactgcagcctccgcctcccaggttcaagtgattatcctgcctcagcctcccaagtagctgggactacaggcaccaccacatccagctaatttttgtatttttagtagagacgggatttcaccatgttggccaggctggctttgtactcctgacctcaagtgatccgcccgcctcggcctcccaaagtgctgggattacaggcataagccaccgcgcccagcctttattaattttgcaaattgcaaaagtattctctgacttactgattggtcacttgtgttcctgaactgtgcataactacgaaaggtttgtttaggagtgccattttctaatactgtataaagctgtactatccagtacagtagtaaatagccatatgtaactgtttacatttcaattttaataaattaatattaaataaaaagtaaaatttggttgctctgttgcgctagcacctttcaaatgctcaataccacgtgtgactgatggctactgtattagacagcacaggtttagaaaatttccttcatcacagatagttctattgtatggtattgctatagagtcttggtaactgcagagtaatgcttatacataagcagcactttttgataggtcaaccaggaagctataatagatattttttggcaattttctttctgttagttcaacaaaaactaacttaaagatttatcaaagacctttgtaccgtaatgaaacccagcatttacatacagtcctctctgtagtaagggtttgtacaaaggcagtaaattgagatagcagtcgttgtgggcttcagctaatcagagcattaaatctggtatccaaaaggtaacctttgagcctgagcaacataaggagaccccggctctacaaaaataaaaaatttgccgggtgtggttgcacacgcctgtggtcccagctacttggaaggctgaggtgggaggatcacttgagcctgggaggtcaaggctgcagtgagctgtgatcacaccactgcactccagcctgagtgacagagtaagactctgtctcaaaaataagcggggtggggaccttaattctaaaaactgaaaacttattctggtatgagcagttccgcaaatattctggtatgaacagttccacaaataataagtgaagtgattttgatcttacatattgattttacaaatcaattaatttgtgattttttttaagaaatacatatataggccaggcacggtggctcacgcctataatcccagcactttgagaggctgaggcgggcggatcacctgaggtcaggagttcgagaccagcctgaccaacatggagaaacgccatctctactaaaaaaaatacaaaattagctgggcatggtggcacatgtttgtaatcccagctactcgggaggctgaggcaggagaattgcttgaacctgggaggcggaggttgcagtgagccaaggttgcaccattgcactccagcctgggcaacaagagcgaaattctatctcaaaacaaaaaaagaaaagaaatacatatatagatatatgttgttttttcttttttaattgagacagggtctcactctgttgcccaggctggtctcaaactcctggactgaagcaatcctcccaccttggcctcccaaagtgctgggattacaagtgtgagccaccatgtcccaccagtttatgattctgaaatgtagaatatattacttcctgttgggcaatagattttgaaaattatgtacatttaagaccatctctataaaatacttttacatagacccaaaagaatttctaagatatctattctgtgcaattactcttaaatataactatatctagtacacttacaagtctcatttttcattttctctagagaaaatactgcagcctcttttagtcatatatcctgactgaaaattatgaaattaaaggttttagacctatgtttaggttatgtttgagtattatatatgtataggctatgctgactaaactgaatgataactctggttttggctatatggagacatatcaaaagttctgatttaattaatcatctcacctaattatcatctaggacctaattattaagtataatcaacccaaattctttaacatctctaccttgaaatgattttcttgacttttggtcatctctgttcagcctcaacctctccaaattctccaccctttttagggcttttgagttcagtcgtctgaattctaataggatgattatctttcaaatttctttgtcacactcctattggtatgttctggtgatacactttctcccctcagtatatttccctgttcactcaggaatatgactatatattaccttgttatttaggtacaaagccaattattctatatctgatacttgtatattttgtatttagatgttttaaaatgtaccctcctgccatgactgtgtattgccttgttatttaggtacaaaaccaattattttatatccaatacttgtgtattttgtatttaaggtttaaaaatgtacccttctgccattgtgcctatcaaacttcatgatgcgtgtttctgagctcaggaaataccaaaaagggagtattcggtttttggtttttgtcttcaagtcagcaatacatctttgttcagctcttgtgttcctcaataactttgttccctccttaagtgcattcagtagttaaacttagcagaaatctgacctaaccattttcttgttttccacttccttaaatgccacacagaatcatctagccagaagcataccattttgatgtttgacatattgacatttcaagaaaactataattatgattaagaattatttctagttcttaactacaaattaaaaacttgtggtgctctttttctctgaatttataatctgccttctcctttctaggttaatttgcttgatagaaaattacaactttaatattatttatcttaacagattgtgaatagtctaattaactcaaaagtattatgtttcgcccttaaaagatactaaattataccttctaaattaaagcaggtagaaaacttctttgtcaagggtttaataaaccagaaagtttgaagaactacttgtataaaatctgattttttaattgttgtattacattattgctatcgatgagcaatattacattattagcaatcagtagcaataatgtaatacaggggttggcaaactatgacctgggggtcaaatccaacccactgcctattcttgtatataaagttttattagaacatagcaaagtacattaatttgcatattgtccatggctgctttcacactacagtggtagaactgagtagttgcaaaagagatcatatgacctttagagcctaaaatacttactgtctgattatttacagaaaaaaaattgctgacccctagtatagtagaaatccttgaactggggagagtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattatttaaaaaaaaaacaaactacgtaaacaaaactgctagtcataagacagataaatttaaagcatactactattgtttcaaaagcatttgcatctcagggctcttttagatactgttttcctagtagtataggtatttattacagatctttgacaatagtagcaagaacaggccttgaagcgtataactaacatcttaagaaatacagttgtacttcatttggaaataaaaataaagcatctctaaaagcctagtttccgtgtgtgggaaacgtgatttgatatataaaaattccattcccacccagcttttaggaaacatgtataatacgtaaagtaaaataagtttttataaaaagaagaactcaacattcactactgttttttcaacatggtaactataattctgcataagaacctttcatgcgtaactttagactttcagaaatctcaaaagttacctggaatgttaacatcaatatcacttctctctttttgcccttccctttctacagtaagtaaactttgtggaaatatattttattaatgttttctggccaggcgcagtggctcacaccagtaatcccagcactttgggaggccgaggtgggtggatcacttgagcgcaggagttcaggaccagcctgggcaacatggtgaaaccccatctctacaaaaaaatacaaaagttagccaggcatggtggcacacgcctgtagtcccagctacttgggagactgagatgggaggatcacttgagcctgagaggttgagactgcaaagagccgagattgtgccattgcactccagcctgggcaacagagcgagaccctgtctcaaaaaaataataataatgttctcatattagcagatacctaaacacaaacaagttttatctttccagaaaaattcaagagttaatatttaaaatttagacttagactacttaggtgatttgataaactaactaaatgagtgattctacatagaccagcaaaaggctgtgctcatgttctagatctttattagtagagttagtaatgatatgcacttacagaatgctttacaatttgcaaagcactttcattaatacattatgacttttgccaatcctgtaagataagtccattttaatattctttttttttcttttttgagacggagtttcacttttgttgcccaggctggagtgcaatggcacgatctcggctcaccgcaacctctgcctcccgggttcaagcaattctcctgcctcagcctcccaagtagctgaaattacaggcatgcgccaccatgccgggctaattttctgtatttttagtagagacggggtttctccgtgttggtcaggctgatctcaaactcccgacctcaggtgttccacccgcctcggcctcccaaagtgctgggattgcaggcgtgagccaccgcgtccagcccgttttcatattcttactttacagataagaaagcctagagaggttaaatgatttactcccaaataccacatgttctcccttataagtgggaactaagctatgggtacacagaggcatgcagagtagtataatggacactagagactcagaataggggagggtggaggggcaagggatagaaaatcacctgttgggtacactgtacactactcagaagacagattcactaaaagcccacacttcactactgtaccatttatccatgtaaccaaaaaccacttgtacccctaaagctgtttaaataaaaaataaaataaatatgatttactgaagcagtaactcccaacatttttccactctacagtcctaagggatgtcatgcactcaaatggcagtgatttccaactaggaataaggggaggctatgcatatagcttaaaagagtcatatgtagttgattctgttgtgtggcctgatggagaattactatacaaaagtaagacattgtcattgttaaaacaaaaagagggaaaaaagattttaaaaagaaaaatgacacataatcctaccacccagagataattaataacattctggtgtatatgcagtcttttatatccatattaacttttttacccaaaaatgagattataatatacattgattttaaacctttttcatgtaattaatcacagacatcttttcattccactaaacacccttctacaacatcattttataataactgcagaatattccatcctgtgttacatgtttgaattcaagatgtaagtggtttcatatacttctacaattcccgattagtgttattctggtatatgcatatgtaatttatttcaaggaatctgaaataatttaaaaactacctctcttctagccatcatctcctatatatttgacttaatggataatccttaagataaataatttgttaaataacttatttatatttgtgtatttgttttaataatctattttttcatctctttgttttagggtgcagtactagccgctgtgtcaagtcacaaattcaactcattctatggggatccccctgaagagttaccagatttctccgaagaccctacctcctcaggtaattggataattcacttattcacctgtgtgggtcatttggcatttacatccattctctcccattgtgaataaacttttcctgtgcatttagttaaatcctccaacggattctaaggaagtttgtcagcaaccaaatcctgtctacatgtgtcttgttccttttcattttaataccaaagttgctttctcctgtggctccaaaaccaacacttcatttttttttcttttcacctcagtaatacttcttcccctttccacactctagacccagcattgcactccatccaatccaacatcctagtcagtcttttgggatctttctgattaccttctctctcaacaaaaacttctaatataagcttttccccaggtcagtcgtattagatcagactgtgggcagcactgctttgaatggaatctttcagtgtagagctgtcttgtgagttatctcctgaaacagttaccaagttcttctttctgtataaaaatctataacacggccaggcatggtggctcatgcctgtaatcccagcactttgggaggccaaggcaggcagatcacctcaggtcaggagttcgagaccagcctggccaacatggcaaaaccccatctctgcaaaaacacaaaaatacaaaaaaaaaaaaaaaaaaaaaaaaaagccaggcgtgctggcctgcgcctgtagtcccagctacttgggaggctgaggcaggagaatcacttgacccgggaggcggaggttgcagtgatccgagatcatgccactgcactccagcctgggcgataatgcgagactccatctcaaaaaaagaaaaaaaaaatctgtaacacatgcatacaagtatccaaaggggaagaacacagaagagttatttgttttgatgaactgtatataagtacccctgaaacaacctgccagtgttcacaaaatcattttataagccagtgcagtggtgtgcatgtgtagtcatagctactcaggaggctgaggcacccggctcagggggatcacctgagctcaggagtttgaggatgcagtgagctgtgatcacaccactgctctccaacctggacaacaaaatgagacctcgcctcttaaaaattaagagataaaaggccaggcacagtggctcacgcctgtaatcccagcactttgggaggccgaggcgggcagatgatgaggtcaggagatcaagaccatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgctgacttggtcattatccagagcccttcccacatgaaaggcagggatctagttgtgtttataggtgtggtccccagtgcttcttattgtttcacgtctgtcttttcttccactccattttgttccctccacctgtaacttcttttgttagctgaaacctctgtcttctctcctcacactcagattacagtggaccctatttaaggggagtggatccagtaatggtttgtattgtcatactgtggctgtatgatataatcacatgcttataatatatttaggataaatctctttgagattttaggtcaagatctctactaccattttcatctttagaaatggagctaaaggctgggcatggtggctcatgcctgtaatcccaacagtttcagaagccaaggcaggaggattgcttgagcctaagagtttgtgaccagcctgggcaacatagggagaccctctactttgtaagaagtcaaaatattagccaagcgtggtagcacacacctgtggtcccagctactagggaggctgaggcaggaggatcacttgagcccaagaggtcaaggctgcagtaagccgtgagtgcatcactgtactcaaaactggatgacagaacaaaactctgtctcaaaaaaaagaaaaggggccaggcacagtggctcatgcctgtaatcccagcactttgggaggccgaggtgggtggatcacttgaggtcaggagtttgagaccagcctggccaacatggtgaaacccccatctctactaaaaatacaaaaattagccaggcatgatggccacgcgcctgtaatccacctgaggcaagagaattgcttgaacccaggacacggaggttgcaatgagccgagatcgtgccactgcactccagcctgggtgacagagcaagactccatctcaaaaacaaaaggaaaggaaaataaaaagagtaatactctatgcatttaggaaaatatgaatatttaaaataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctcaaaaaaaaaaaaaaaaaatcaatgttgaaatattcttttctcatatttcaaatcaagtaattcagaatcagaacccaacgtttgatgtctgaaatcccaaacagttccagtgattgtactcatggaacatgagggctcactttggggtcagctgggggaccatgcttctggtggctcatgtagtgggccgaactgtggcttgataacctgcttgttctaaaatcatactgtttgttgtttgtccatatgctgccttcctcctaggacttctagcagcagaaagtaggtatccctttgttttcctttaaggtgtatcttttatgcaaaagtgtttggctttgcatggttcgtaatcagcttgactttttccttggctgtttgtgtgtagttgtttaagtattaattttaacactgcctggtcataaaattaaaacttggatatattgatttttgaggcattgttgcacaaacaatattaagttctcacttctttcataagaggaaaaaagacagtgttaaaatttcaacggcatttaatacttcacatctgaatttcacatacgaatacattaattctggggaaagagtaacatttattttagagtttgctttcaagaaaactttcagggtaagtgaatttttctttgacaattacatcacctgtaagtggtctttattgcttcctgttactgagtccattttcagtttatttggacctgtgaaataaattctgaaatcatatctcttaacaacttttaccatcagatagaacatttataaggaataatgtaatagctagattttaattacaaaggggcataatttgagtttgggagaaaattaaaatgtaagaaatgtacacacagttgagtacatgtaaaactgaggcaatctgaataagatgggtggattgtatcaatgtcagtattctggttatgataatatactatcgttttgtaaaatgttaccaatgggggaactgagcaaagaatacaagggatctctctgtattatttcttacaagtgcatgtgaatctacaattatctcaataaaaattctaattaaaaaaataaacctttacctcaaagataaatgagaaagcctgggtactaatgattgaattcattttcacattttcttacattagttatctgtagctcaaattgcagctgatttaatataaatcttatagtatattagttacctattgttgggtaatgaattaccttaaaacagcagttgtcatctcacagttcctgtgggtcaggaatctgggcgtggcttagctgtgtgcctctggctcaagatctctcatgagattgtggtccagtgctgctatctcaccggaaggcacaactgcaggaggaatcctcttccaagctcactcacatggttgttgccaggcttcggttccttactggctgtggtcctcttcacagggctggctgttcacagcatggcagctcacttcccagcacgaaagataaaagaggggggcaaaagtgagagacagtgcccaagactgaagacacagtctttacagcctaatctcatagtgacgtcttatcacttctgcactattctgttcattagaaatgagtcagtaagtccagcctgcactccaggggaggggactgattacacaaggctggaaataccaggagaccaggttactggggcccatcttagaggctgcccaccacgtacaaattaataactattaaaatgtaagattcttcccgtctagatttagcgctcctcttttttttttttttaaatcagccaacctgtcatgttatttgagaatgggcatcttggatgtatcagtagtgattttccttagttgtaaagctttacacgagtgggtacttaatagcagaatgttattaaagtactttgaaaaatctgtgctcgaagatgtttctatatggaagcataaactattttaataatcataatggcattagagattataacatctatacgctgacagaatacatatgcagagtttacttcctttaataaatttcaaggtatctgtaccataatccacatatggagaatctaaagcatgtatcaccatatgtaagttctcataacttgagttggatatggcacagatgcttatgtccaaaatacagtttccattacaggattcattattgcttataacttgattgataacaaagaatttgctttgtgcagtgggaataaaaagtgttgaacagggtgtggtgatagagggaagagattggctgcaaagggacaagagagaacttttttgaagtgatgacagtgtacacttaaatggcgacttttaacttaaaacagtataccttagtaagcagattttttttaaaaagtattgtgcttgcaaggaggggctttgattgagtaggtgataatgtgtgtgtgtagtaatacaatgtattaattgatcgctaatataatagaaaaggtattgattactcttagaagaagctaggctaggttcagattctagatttgctcagtgatgctgagtttcatagctatacattgtaaattaagaaatacacacacattgagaatttaatgtgttattttgtgaaaatctgagaagcaggaatgggatttaatgatctcaactgtcatccatctgaaaaacctaacttgtgattttaaataagatggcatactgccttccactattcccttttaaaaacaggaaatgtccctgcttttatctttatgaagttttatttatgaataaagtttgtactatttaaaaaaaaaagaaatacacaaatctttattgaaacaattacagtgaaaacttgggtatatcaaaactcattgaatggtacacttaagatttgtgtatttcattctatgtaaattttacctcagagagaaaaataagcattgcaatctttgctgaagtctttaagggtgaagtgtactaatgctggccactgccatttaatttgaaatgaatgaaaaatacgtgaactgatggatagatgggtagacatgtgataaagcaaatacagcaaactgtcaacatatgtaggatctaggtggtgggcacgattctttcaaactttctgtatgtttgaagcttttcgtagtaaaatgtaaggggaaaaacttttaagacatactcagcctactttaacactgagaactttttagtctaaacatttgactgtttatttttctgtcctccttttggtttatttttacttggtcaacctttttatgagacttccactctcgtaatgagattattctagactcaaagcttttattgaccttaaaagcatatttctctttaaagaaatagaaacattttttaaacagttgacatatttatgctttttttgactattatttcataatagtagcagaaaacttttgaaaaacttgtttgtactggtgagattatttgaaaaagtagaagtattcaaagttaaaatgtgcaggccagtcatggtggctcatgccttgccagcactttgagaggctggggtgggaggattgcttgaggccaggagattgagatcagcctgcacaacatagtgagatcccatctctatttaaaaaaaaaaaaagtatgattataaacctgatttttagatacaaactttattgccaaatgaattatgaaaacaaaatactattctgaaggcagggcattatagtatctaataagttcatgaatgtggaagtttggaccaagggctaggaaaaaaccttatatggtaaatcaaattgagattaaagagagaacagaaattaggcatcacgcctgtaatcccagcactttgggaggccaaggcgggtggatcacgaggtcaggagtttgagaccatcctggctaacacggtgaaaccccctctctactaaaaatacaaaaaaaaaattagccaggtgtggtggcgggtgcccgtagtcccagctactcgggaggctgaggcaggagaatggcatgaacccaggaggcggagcttgcagtgagccgagatcacaccaccgccctccagcctgggcgacagagtgagactctgtctcaaaaaaaaaaaaaaaaaaagaaattggacatcacctcattaccaaatgcaaatcattctgatgcattgctgaggataaaacatgattttgtgggtgggggacagtctattatggaaggaacactgaattaggagtgagacctgggttctaggatttgatcttctgcttattgcctgtggcccttggaaaggttatttaaccctactgagcctctggtttttcaaatataaaaacacttgctgaccaagcatggtggctcaatgcctataatcccagcactttgggaggctgaggcgggaggattgcttgagcccaggaatttgagaatagcctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctactttaaatgcctgctaacagatgcctttgtgctttccagcaaagtatctgctggtcctgtcaacacagctttgatcctgtgtgggggtggtgaattcctgctcatccacctctctgcggctccccaactcctccctaggcagcctgtgtgtcagtttgtttttacctcttctataccgtttacttcagggtataatatgcctacttcacacaccagtctgagagccccttcctcagggccggtgatcatatctctgatttctctgaagcccttgcctagtacctagcaaaaagcaggaatattcaataaagattttggggccaggcgctgtggctcacgccagtaatcccaacactttgggaggcctaggcaggcggatcactcgaggtcaggagttcaagaccagcctggccaacatggtgaaaccccgtctctactaaaaacacaaaaaattagctgggtgtggtggtgtgtgcctgtaatcccagctacttggaaggctgaagcaggagaattgcttgaacccaggaggcggaggttgcagtgagctgaaatcatgccactgtatgccagcctgggcaactgagtgaaactctgtctcaggaaaaaaaaaaaaaaaagattttggttattgtctgacccaatagggcattgttcaagttcttttccaacctccatattcatgcataaaccacacaacttcttgttgaaggtttcctgtatgtttcctagcatagcctattagtgtagtaagttaggcaaaacatagactttgaagccaaacaaacccaggattgagtcctggctccaccatttactagttatgcccttccatgaaccttctgaagctcagttccctatctagaaggtgggataatatatctgccttactgtgttgtcctgaggatgttcctggaacataataaacactcaagaattgggagctgctgttagtgtttccttaagtacttaattcagtgcatactttgtagatattataaaatgaataaaataaagagctgccttaaggaccttacagctaagggaaaaaaagagtgaacaagcacgcacataagtaactcatggagtgcgctggtggtacaggaatggcatggagcacttgggaagttcacagaccaacaaatgatacatccctggtctggtacagccaaaattgcttcctggtcttgagactgaccatcttagtattcacttgataaaaggttgtttttgctttaatcttatattattaataaactgctacataaactgtatatcagcatgagcaatgctggtaaaaggccgagcacagtggctcaggcctgtagtcccggcactttgggaggctgaggcaggcggatcacttgagcccaggagttcgagaccagcctggccgacatggtgaaaccccgtctctactaaaaatacaaaaattagctgggcgtggtaacctgtagtcccagctgcttgggtggctgaggcacgagaatcgcttgaacccaggaggcagaggttgcagtgagctgagatcatgccgttgtactccagtctgggtgacagagtgagactctgtctcaaaaaaaaagaaaaaaaaaactcagtaagatttcagtaagataactgagtgaagatgataattaggtttctgtggtatcagctgaattttttaatatacaaaaaaggcacttgattagtatttttgttattgtggtttcataagtccagaagtttagaactggctttagtaacttgataaacctagcatcatttaattctgttgttgatgacatgctggggtcaggggttcagtgggacatttgggactaatttcttcacatcatctcttgctttccaaggctttcagtaaaggatgaagagaaaattggcttttaactaatttccagattttttgatggaggggggggcactctgaacaaagtaaatcctgagaagatcaggtagaaggaagtggattgggttaatacctctttaggaataacagaggagatgaggactgatttctgccatttatctcttttatcccacttaatatccacttaatgttttcagtgaaaggataccaatagcctggcaggcataattcaaaatttaatattatccagccgggcatggtggctcacacctgtaatcccagcactttgggagctcaaggcagaaggatcgctttagctcaggagtccaagaccagcctgggcaacatgacaaaaccccatctctataaaaaatacaaaacttagatgggtgtagtggtcccagctactctgggggctgaggtgggaggatcacttgagcacaggaggtcgaggttgcagtgagccgagattgtgccactgcactccaacctgggcaacagagcaagaccctgcctcagaaaaaaaaattatccaggccaggcgcagtggctcacgcctgtaatcccagcactttgggaggccaaggcgggcagatcacgaggttaggagtttgagaccaacctgaccaacatggtgaaaccccgtctctactaaaaatacaaaattagctgggcgtgttggcacgcacctgtaatccccgctactcaggatgctgaggcaggagaatcgcttgaacctgggaggcagaggttacagtgagccaagatcatgccactacactccagcctgggcaacagaacgagactctatctcaaaaaaaaaaaaaaaaattatccatagttccttcaacagacgaatggtcaaacaaactggtacatccacacaacaacctggatgaagccccagataattatgctaagtgaaaaaatgcagtcccaaaaggttacatactgtatgatttcatttattctttttattttattttattttattttttaatttttagagggactcctccttgcagaccagggctaccccataggcagtatgcccagaataggagcctcatttattatcaaaatgacaaaattgtagaaatggagaacagatgagtagttgccacaggttaggaggggatagggtaggaggggaatgagcatggctataaaaaggcagtatgagggatccttgtggtaatggaatgttttatagctcgactgtatcaatgtcaatatccaggttgtgatattgtactacagttttgcaagatgttactattggaggaaactgggtaaagggcacatgagacctttatgttattttcttttacaactgcatgtgaatctacaattatctcaaaataaaaagtcaaattttaaaaaatagctacagtaatttccacgtggacagccacacagtatgtggcttaagacccaaatctttaacataattaaatagagctacaaaaatcagtagcttatatagcattttgttttgttttgctattgtagaaaaacttggaaagtatggataagaacagaatgaaatagaaataggacagtaaagataacaactgtaacacttttgctgtgtttcattctgttttttgtttttccggagtttgcatatatgttttgtttggttttttatcgtaactgggaatatacagtttatttagttttgcattctgctttcttgaattcttttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcctgttctcaatgagctgttgggtacacctcccagacggggtggtggccgggcagaggggctcctcacttcccagtaggggcggccgggcagaggcgcccctcacctcccagacggggcagctggccaggcggggggctgacccccccacctccctcccggacggggcggctggccaggcagaggggctcctcacttcccagtaggggcggccaggcagaggcgcccctcacctcccggatggggcggctggccgggcggggggctgacccccccacctccctcccggacggggcggctggccaggcagaggggctcctcacttcccagtaggggcggccaggcagaggcgcccctcagcttccagacggggcggctggccgggcggggggttgacccccccccacctccctcccggacggggtggctggccgggcggggagctgacccccccacctccctcccggacggggcggctggccgggcgggggtctgacccccccacctccctcccggacggggcggctggccgggcagaggggctcctcacttcccagtaggggcggctgggcagaggcgcccctcacctcccggacggggcggctggccgggcggggggctgacccccacctccttcccggacggggtggctgccgggcggagacgctcctcacttcccagatggggtggctgccgggcggaggggctcctcacttctcagacggggcggctgccgggcggaggggctcctcacttctcagacggggcggttgccgggcggagggtctcctcacttctcagacggggcggctgggcagagacgctcctcacctcccagacggggcggcggggcagaggcgctccccacatctcagacgatgggcggccaggcagagacgctcctcacttcctagatgggatggcggcggggcagagatgctcctcactttccagactgggcaagccaggcagaggggctcctcacgtcccagacgatgggcagccaggcagagacgctcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccatctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctaaggcaggagaatcaggcagggaggttgcagtgagccgagttggcagcagtacagtccagcttcggctcggcatcagagggagaccgtggaaagagagggagagggagaccgtggggagagggagagggagagagagagggagagggagagagagagggagagggagagagagagggagagggagagagagagggagagggagagggagagggagagctgctttcttgaattctatatcatgaagatttctctgtgtctttgaaattcttcaaaaacaattttcatttggctacatattccattatatggatattctataacctacgtaatcatcctctattagatttattttccattttgtatgataatatcattatatataaatcttccatttttttccttaaggtgggtttttgtaaatggaattactaaatcgaagtgcatgaacatttttaaggctttttgatatatgttaccagattgctttctggaaaagtggtactgatatatattctcaccaataattgcatgagaatggataaggtctaagtcaggaagaattagaaacagagttctggagcataaagatttttatctttatcaaaaatataatttctcaaccacagcactactgacattttgggccagataattctttgttgtgggggctgtcctgggtattgtaggatgtttagcagcatccctgacctctacccactagatagcaatagctgccctcccgctgtagttgtaacaaccaaaaatatctctaaacattgggaaatgtccacctgggtaacaaaattgcccctggttgagaaccactgatccaaagacttaaatgtgcaatgagacacttattcttagagtttctctactgtgtactaatgttctgaagcttagctccttggagctctttttttgtggagtatatatgtgtattctgcatattgcctgcaatgtaaaagaggctgatcttttttttaaggctgtgtaaatggctttgttactcctcattgtgtatctttccctactgacatctgcctggtttcctggttatgagaagaaacttaaagtgatggcacttccatttgctttgccctacaaaaatgatttgccttgaaatttaatatggtatttggaagtgtcagtcagcgtccctatactttgtctttatcttctgagtaagaagggtaagagtaaaacagaatgagaatgactttggatctcttgagtctgtatgtaaaggaaaaaaaaaggagtggactgggatttttgttaactaaagttcaagtcttaaaaactaagaagcctattttaagcagcaggagttcccagttgaaggtctgttccctgtatctacagctggctttaccttcagttcttgatggaatgcacctgggtaaaaggccaacctcgtttctataatatttcagaacatcttggagtcctgaaacccatactctcttcctgacataaaacttgctgtgtccagatcttctagtgcttaggttatacttgataaatttcattaattcaaagaagataagctgcagtttcctctgaaaaatgaagagcacacaaatacattaataagaacatgaactctctgaaaatactgtgtccttaaattatatgaaactcatttaagtctatccttcagtaaagacactagcctttgaagttctgatatgaattcattgttcttaagtgtaagatttaggtttaaaaagttagtttgacattgactttctatactggctgtttcttttctgtttgtcccccttaggagcagtctcacaggtgctggacagcctggaagagattcatgcgcttacagactgcagtgaaaaggacctagattttctacacagtgttttccaggatcagcatcttcacacactactagatgtaagtctgtctttttattattcttcttttttggtgaattgaatattggccgggcacggtggctcatgcctgtagtccaagcactttgggaggcagaggcgggcgtatcaggaggtcaggagactgagaccatcctggccaacatggtgaaacgtggtctctactaaaaatacaaaaattagccaggtgtggtggcgcatgcctgtagtcccagttaggactgagctgaggaggcggaggcacaagaatcacttgaacccgggaggcggaggctgcactgagccaagatcacaccactgcactccagcctgggtgacaaagcaagactctgtctcaaaaaaaaaaaaaaagaaattgaatatttagcatacctttttactttacatgaattctcagatgtctatcataacaattcttttcagttgccttaagcctatgagaaatgtgggaaatcatccatcaaaaattcatgattgaaatacagtatatggccgggcaccgtggctcatgcctgtaatcccagcactttgggaggccaaggcgggtggatcacctgaggtcaggagttcgagaccagcctgaccaacatggggaaaccccatctctactaaaaatacaaaattagccagttgtggtggtgcatgcctgtaatcctggctactcgggaggctgaggcaggagaatcgcttgaacccaggaggcagaggttgcagtgagccgagatcgctccattgcactccagcctgggcaacaagagcgaaactccatctcaaaaacaaagaaaaaagaaatacagtatatgtacagtacaaatgcaacagagcctagcaggctacaatgggaaaaaatttatatatctttatatttataaattatatgtacataatgcatgcaagtggtatgtgagttttaaaaaagagtagagtacaatcctactttactgaattatcttgtatttctgttaaaagaatccattgaggttagctgtgattactttttattgctttgcacattactttaaaacattatacctccagcatgagtataggagagagaaaagcaaatgagatactttgcaataggctgtattcccacacacatttcatatttaacattgttttgttccatagattcaatgtcttctccttaaaacataagcatatactccatctttaaatattacaggctccactgacagcagactgggatacaaaggaaaaaacagaagctgaccattttcatttcagtcacattttaagtaaaatacctttcttagagaacttggttcacttcagcaatgaaaactcttgggtggtttcgatggtatttgaacatgttagtctttttacaagaaaaatcttcccttaatgagagaatcatacttgctttggggtgcctagaactgtttggtgctgaataattcaccatatgatgtaaatgaagctaaagcaaaatttcccagaatgtgttctacagagcatggctctgggaggttgctatgggtgttgccatggtgggagggggaagtagatcttaaatttattggttaaattatttattgactaaataagtttgggaaatgctacattctttagtctttttatacagatccacaatgggtgttggtatattgatagctctgagatgatctaaagcaaagaaacctttttaactttctttatcagcatttctcaaactaatttgggcacagaacttttattcacaatcctgttgagttctgttttgatgaggaccagtttgggaaaagctcagctaagagtgtttgttgcattatgcttcagctttacactaaatgcagccgtaggtatctaacagttgcttctttccccaaatgtggtcagttcaaattaattatcagattttcatggctagtttggcctttgtatatagtgtacatattaattagggctgactaactgttataacatgtgattctaaaatttgagtggcttaacagaatagaagtttacttcttgctcacttcacagtccaatgcaggtagatgagggaggtcttttccacaccgtcattcagagacccaggcctcttccactaggtcacactgctatttcccagggtcttggaatcttctactgtatcctttgtacctagccagcaaatgagagaagagagaacatggagaatcttgcagggtcaagcttggaaatgggtttatctcacattctttggcaactgctagtcacgtgctcacctggatgtgagagctgaggaacgtagtttagaaatgtgctcaggaagataaggaattgggtcttctctttagtgtaatttatcttaagtagtatctattcactgtcattgctgcagaaagttttcacaattgtgtatttcccactgaagtttataccctttactagaactagttagtgcaatatttagaaaaggctacagcagtgtgtggagattttgtttattttattgtggtcagtgcttaggtcattgccaggtagatttactgaccttcttttgaatcaaggactttttgtaacaaagactttttgtaatttaaacactgagagaagcccaaattggtttcaaagttgtattttttcttactgatatagcaaggtatctgagcacatcaagcttgagattgcaggggagaagcaggaacattactggcttacacaaggaaaggggcagctattcagacacgaataactgctgcactgtttggtataaattgtcacaatttcagaagagattcttagatgttagtgagaaaaacatacttaactttcctttgcatttgtttacattataaagaagtatctgccttattggcatctgccctgtcagtgcaggtcaatttgaaagaggagctgttggactgaaaatgaaccatgcctattaaaaaggtgcagtataagaccaggagtagtggctcacacctgtaatcccagcactttgggaggtcattgtgggaggatcacttgagcccaggagctcaagaccagcctgggcaacaaagcaagaccccatctctacaaaaaatttaaaaagcagctgggcatggtggtgtatgcctgtggtcccagctactccagaggctgaggctgaaggatcacctgagcccaggaattcaagggtgcagtgagccatgatcacactactgcactccaacctgggcaacaaagtgagactctatctctaaaaaaaaaaaaaaggtgcagtatcttctgaattttgtaaacaggtgccatacatgagctccagtcaaattaatgactatgaggccgagccctggacaatatttgcatgcatgtggttctgaatctccaaactgagctatttctaaatgaaagtttaggccaggtacggtgactcacgcctgtaatcccagcactttgggaggccaaggcgggcggattacctgaggtcaggagttcgagaccagcctgaccaacatggtgaaacccatctctactaaaaatacaaaaatgtggtgggcacccataatcccaggtacttaggaggctgaggcaggagaatcacttgaacccaggaggtggagattgcagtgagccgagatcgtgccactgcactctagcctggtcaacagagcgagactccgtctcaaaaatgaatgaatgaatgaatgaatgaatgaatgaatgaaagcttaatcatcatgaatgaaataaaccatcattagaatgtgccctcataccctacatcccataaataaggcttattaagctcatttcacagctaacaggctacattttaataatataatcaatgaagaattcaagtgactgccatatagagaaatctaatcatttaaaaaattttaatatttaaatgtttgtggtatacattaaggaagaaaaatggctatgacgaactcttgaggagcagctgttaaaatgttggattttcagtctgggtgcagtggctcacttctataatctcagcactttgggaggccgaggcgggaggatcacttgaggtcaggtgtttgagaccagcctggccaacatggtaaaaccctgtctttactaaaaatacaaaaattagctaggcatggtggcgcatgcctgtagtcccagctacttgggaggctgaggcaggaggatcacttgaacgcaggaggtggacgtagcagtgagctaagatcacaccactgcacggtagcctgggagacagagcaaaactctgtcaaaaaaaattgggcctttcatttttctttcttcccatgttccacataccatggttgatttggaattgttttattttgcagaatcaaaacgaattcttctgcctttttttgtttgttgtttgttttttgtttaagacagggctctcccaggctggctcactgtagccttgaccttctgagctcaagcaccctcctacctcaaccacccaagtatctggaccacaggtgcaccaccacactcagcccttttttttttttgaagagacaggtctcaccatgtttgcccaggctaccaggctagtctcaaactcttgggctcaagcagttctcctgcctcggcctcccaaagtgctgagattacaggcatgagtcattgccccagcatgaattcctttttaaggattccaagtagggacacccagggggcatagttttatggaccatgaattaattaaggctaattaatcccactgagccattttaggaaatatctttaccatttttatgttatttctgttaactcaataacattctaaatagctaggtatgaagccataattttaaggctgacaaaaagaaacaggattaagttcctaagaaaaactaaagattatctatgacttctttattttttctagtcatgttcttaaaataataacaagctcaaaatttgaagaagcattattagaatttgtttacaggaaacaaaactgccaaactgaaacatttacattaaaatggagaagtactgtgattctactgaaagggaaatgctttctgaaaacctttgaatttgagtaaaacacatttagtttaatctgtagttagaaactgatacagaaaactctaaatatttgctatccaagtggttccagcctggcacacatatgcagcttctcattttgtgggaagaaatacagaggcatgaggaactgcttggtccagcttgttgcagtatgcctgtatttaaaaattaaaagcactggtgctaagatgatcttcgtatgaaatgtatagatcaattagtaaagtacaatttgacattagtttgctaggactgccataacaaagtaccacaagttgtgtggcttaaaacaacagaaattgattgtctcatagttctggaggctggaaagtcctaaatcaaggcattggcaggggcatgctccctccaaaggatccagggaagaatccttccttgtcttttccagtttctggtggttgcctgcaatccttgtcattccttgacttgtagatgcatcattccagtctctttttccgtcatcacatgtcattctctgtgcgtgtgtgtctgtgtatttacatggccttcttagaaggacaccagtcattggacaccctaatctagtatgacatcatcttaattaattacatctataaagacacttatttccaaataaggtcacattctgaggttctgggtaaacataaattttgagtgagggacaatattcaccccagtacagcatggaaaactgatttaaccctgaattaattcttcacgtgtgagtgcaaattacacaaatctaatataaaataatgaaatgttaccctgtcatccattaattatgctttattgggaattggtgttaaagtgttatttatgtcttgtaatgatattttgaatcagttatggattggaatttgtatgtgatacattggaaggtcagtgggtgggtgagtttttgatggactgaaaagccatgttttttggattaaaaacattttacaaatattatttggtagtagttttcagtcttctcagtttctagtataaattttcctattaaaataataaatgtttagtttgtaaatcaccagtgttacaaaacattgttaaatgacacatctctctgccaaactttgacaactaagttttaaacattaactggccatctgtcatacctctgaacagctgttagcatttgttacgcactgctgtttccatagtaaatgcccccacctaattaagattatttttgtaagaagtcttaaaattgtggtttctgaaaatataatgggtgattagattaatatagcaatttattgatgaatttttaaaattgcagtagcaattaatttaggagtctttataatattaatttataagtagacttttataatagacttagtaacttttaaatattgcattagcaattaactgatacttggaatctttcatattttgtatggccaacatctttattataattttttaccgtttagggagagttagcatttttccatctggcctggagttagccatggaaaactacaattcttgatttactatttcgcttttttgagatgacattaaattagtagccatatttagaagagcttatttttagaactcagaagtttcctaaaggaaaaagatggaacttctacaataatctggagataatgtttttgagcaatttggggtctgagaagtaagttaaatacaatgttaggtttggatatttaaagagattgccaatcaggaaatgccaaagctaagtttcccaagaatttgtagtccagccaatttgcatttaaatgtctagaataataaagcctatctgaggaccttcagaggatgagctactagtaatttctcagggccccatccagtcttaagagtcagctttggcaattatgaaaccagctgcacagtgggcccctgcccagtggtggtggtctttgtgcttcttgcctcctggggctgtagactgaagcgcattgctgttccctttgaatttgagtgtctctccactgttttctaactggaggggcaaaacctcccatatctgtttctctccatgtattgaagtagtattgtcagtgtaaaagtacggcatgaaacaaaatacctgaaagctagaaataccatatgtcgtgaatattctcaaagtatttttccttctttcttaatgtaaataaatgtcaataaacttagcaaaaaaaaaaaaaaaaagccgctaagcatatggttctttgttaagcagcaatagaaaactgatagaaccaggaacaagatgaggattgtccactccccacttctattcaccattgtcccagagactctggccagtgcagctaagacaagaaaaagaaattcagggcatgaagattggaaaggaagaagtaatatcatcctttcccagagttgttatcttgcatgtagaaaatactaaggaatccacaaaaaatctaatagcattataggcaagcttagcaaggtcacaagataccagattaatatacacacattatctaaatttctatatgtgagcaaaaaataacccaaaaataaaattaaagaaatattcacaatattataaaaagaataaaataggaataaattgaacaaaaaaaatgtaggatttgtatactgaaaactaaaaaatgctatgaaagaaagatctaaataaatgagcagagatatactgttggattggaggacttaatattgttaagatggcgcttttctccacattgatctatagattcagtgcagtccctatcaacatcccagtaggatttctttgtagaagtcaacaaggtgatcctaaaatttatataaaaatgccaaaacaattttgaaaaagaaaaaaattggataactgatttcaaaacttactataaggctacaataatcaaaatagtatggtgttggcataaggatagatatacagatcactgaaacaaaaaagagtccagaaataaaccctcacctttatggtcaatttattttcaacaagattgccaatgcaattacatggaaagggggatagtctttttttttcaaatggtcctggagcagttggagatccatatgcaagaaatgaacttagaccctgtctcataccatacacaaaagaaaattgcctcaaaatggatcatagattcactttaagagcttaaaactataaaacttttaaaagaatataggaataaatcttcattaccttgggttaggcaaagagttcttagatgtgacacaagggaatttggggggattacggaaatgttcttaagctggattgagatggtggttgtacaactatataaatttactatcatcccactagatttcacagggccattacactaaattaaaatttagctttgtggctaagaatttaccactgattcaaaaatactaaatatggttttttctcccaagaactgttttattaaccagcgtgtagttgtgccttatggaagaagtccaaattgtgttttttgtttgaaaatgttatgaattacataactttatagattttcaatatggaagacaccttagagcaacttattttagttcattccttctacattcaagtacatatttgccatttccaaaaattcacagctttttgatacttttttaacatcaattttttggtcttttttgttgtggcaagatatatataacataaaatttgccacttgcaccatgtttaagtgtacagttcaatgacattaagtatattcacattgttatacaaccatcatcactatccatctccagaactctttcatctttcccaactaaatgtctgtacccattaaatactgactcccattcacccctctccttagcccctggcaaccacccttctactttctgtccctatgaatttgactactctaggtaccacgtatataagtgaaattatccagtatttgcccttttgtgtctggcttatttcatttagcatgatatcttcaaggttcatccatgttgtagcatgtgttagaattttcttcctttttaaggctgaataatattccatcgtgtgtgtatagtacattttgtttgtctactcatccaatattgatgttttgtggttgataattatgtactaggaaaaaccaaattctcagaataaggctgtctaatcgtagggaattctgcctcgttccatctccacacaattactctttctaggatgcaagttaaatcttatgctatacatcttcgtgaaggaatgtgtgatttccactgaaagtattaatgactacggaagtccctccaattcccttatttgttcagataaattacttcttaaagcagggtttagaatttactctagaataccaagaataatgaatcagcttgtcaccagtatcagtgttacccactgagtgccattctctttttatgacaccatgatcaactttaccaaaaggcaaaggaatttgcagaaagccttctaagtacaataagcactgattcttctttatgctatgctcaaggaaaggaggggtttccccctagaaaggaatgtgatatgctcagttaaagaatgttcgatggagtggcttgcagcattcataatccaagaacatagctgttttcttctctttgtggcccttcaaacatgatctcataaaactcttctgccagactgcctttgtgctattctctttaaatttttcatgacagaaattcatttttgctacagctacaccaagtacaaatgcttggtgtttacctatgcaaaataaaaaaggtagcaaaagccaaaaataattaaataaaatattatctgacacacctaatgtaacataaatgttaccttttaaagcagcacattaataattgtatgttcatttaatgtaaatatcatttaactcttgtagttgcttaagaagagccaagctaggaaatgtgattttaacactttaaaaaaatagaaaggaaattaatatcatagtgaaaatttctcatagttgggcaagctcttgtatctgatactaaaaagtaccgtatttcagaagattttattaaaacaagataaaatctgcctatattatatcatgtaactggtttttttcctcatgctttcttttgctcaagaataggcattatgatttgtgttttacagggcttaattttagagttatttgaccacttgaaaaaggcatagagaacagtcaagctaggtcatctgaggccagtgtttgagtttctcagaaatagctgccaactgaccagaaatctgccacactggcctatgttgttaggccaccaaaggcacagtcttcttggattgaactaggaggtcaagcaagtcttaatttcttgaattcaaaaataaatccctgtaagtgcgatgttctaataggattagaacaaaagcagccctgtatacagacaaataaaacctaaacaaaacaagggcctccttagaggttcttttgctgtcaggatccaaaggatttttgcagctttttcaggaaatcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactccatcctaggcaacacagcaagaccccgtctcaaaaaaaagaaaaaagaaaaaaacttcttcctagtgtttaattgtagctccttaagtttttgaaaatgccattttaaattttgcaatgtttctttcacacttacgttgcccatcatgcaatctttaggccactgctaaatacactgctcttctccaagcttgaactacatgatgtttaatgatgccaaggatctttgaaaggactctgtgtgtgtgtgtgtgtgtgtgtgtgtgtcagggcctcagtctgtcactccggctggagtgcggtcatgcaatcatagcacattgcaacttcgaccttccaggctcaggcaatcctcccacctcagcccttcaagtagctgggattacaggagtgcgccaccacacctggctaatttttgtattttttgtagagacgaggtttccacatgtggcccaggctggtctcaaacacctagcctcaagcagtctgcccaccttggcctcccaaggtgctgggatgacagatgcaagccactgcacctggcctcaacaagtttatatgtaaacttgagcaagaaaaatagatttttagatcttacaaagttttctgtgatctccaacttcagaaaatcagttccagtacagtaattgaatatcagttctctgtgtttcagtattaaatcagctttccctaatattttgctcaatttcaaatgtatatgagaaaatacctgttatgtattgatggctgatctgctcagttcactgaaaagatgtgacattgaaactttgttcctatttacccacgtaattcacagaaactgaagaaagttcttaataagatagtcagtgtttccagaacaagttatttcaatggtcattattgctacacagtgtaattccgtgcacactgttattatctgttttattaggatcatcacagacacattcattaaatattttgcagctaaatatttgattcttgcaaactttcattcttttccagcaggaaacttcttcagtatctataaagtaagtgataagatgatggttgctaatgaacatcaatgttctttgcaaccctacaagcctatgcctacagtatagttgcaaaagttatcaacttgtctgaaacagtatacattctggtccttagatttggttttctctgtgcaaaaaaagttagtgggacatacaactcagtgataattattttatagcttcttaccatgcattccattttaaatgttgatcttgataaatactgcacataaactatgagcaaaacacaggtttctatttgataactaagaaatcagaagataatgtgatataatgagtatgataaaaaatgaaacttgatttagtgctttgaatgtaaataaaaggtgacatattaactgattttatcatctttatgtttgaaagtacaatctcaggagatttgaatttaatatcactaccaagtttattctgcttcatttgaaaacccatgtcaaatgtagaatgtgttctctttatggaactgtggcgacacttcctaagacagaaagatgaatgaagcgtgtcggtgtaggtatgtgtggtcatatctgactcagtaccagagatttgcagagagcaggcctatctgtgagacaatatgagacagtctgtttcccttgcagctgttcacatttccttgttttgccctggtgttgtgtgtacatgttttttgttttttgttttttttaataaaaagtgctgaatttgggtaatgataatttcattagaaaaagagagtaaacagtaacagattcattcttgttttccctctagggataatttattaacattcttccttctctcttcctcccccttcacacctcagctttacaaatacacctgataccttcaaatttcaggaaagcaaatagcaaaaggaaatacattttgtcattccaatataacttgaatttaagcttctagagcagggattcacaaactatggccctcaggccaaatccagctggccacctgtttttgtaaataaagttttattggaacacagccatgctcattcatttatggattattaacagccgccctcatacaacacaacagggtttagtggctgtgacagagatcatatggcctgcaaagcctaaaatatttcctatcttgccaggataggattaggatcctgatattctttttttttttttttttgagacagagtctcactctgttgcccaggctggagtgcagtggtgtgatctcggctcaccttaacctccacctctcgggttcaagcgatcctcctgcctcagctaccttagtagctgggactacaggcatgcaccaccacacccagctcatttttgtatttttagtagagatggggtttcatcatgttggccaggctagtctcgaactcctcacctcaggtgagaatcctgacattctttaacatggcaaggcttgtaattgagtagctaatagttttcaaatcatattgagtgtatttttccctgcagcctataaatagaattttttacagcttttttcccaagtatttgccaaagatatctccctggcacaaggcattgtgtattactgaattctagtaacaagctgaggagatctggatgagagaaaggacagcatatcagcagggcagggtcaggtccctgctactctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttaccttgaaagttgtataaagtaagtcagacttaaaagatacaaaagaaagaattaaatatagtcaaaacacatttcttaattttgagggaaagtttttaactgcacatgcaggatcgaagagaaataatatctggttcctaaagaaacaagctgaaataaatattcctggtgtgtttattttatgttactctgaattttttttaaatctatttacaatttctatgtactagtccaaatataatacttattttttctagaggaagcatttcttaaacactactatgtactcagcctcacgctaggggctattacctaatgtcagagaacccgagtctggtcgtgggaaagaaaaagaaccacttaaacagcatgttctataatgtacctcagacattcagttccctcttggctgttgatgcccttggtgtggcagacaccccagtgttggctctgtcctgagttgcagacgtgtggtttctgcatcgtcagtatactcagcacctggtctcagaaacgttctcgtcccctgcccccaggggttaccacatagctttttacttctgagtcctcttgtcctcctgggcagggctgtatccagatggctccagccaggctaccttctgcagtgtctccttgactcatgggaaacacacacatgcttaactcaacatacactacaagcatggcctgccccaggcggcctccagtcatgaaagaggcaggcaccagtctctttttgcttaggaccccaaatgctacatgtcaagctgccccaaggactctctctcacacagagatcctttctagtgtaccaaggtgggcctataagttgctacaattcagcaagcatccctccagagaatgagatagtgagctcttctggctggcacctccagtgtctaatgcgtggttcttttggggcatctaccatccttcactttgtatgagggagggtgcaatcccctctcctttcctcccgaacaagaaggagaagggaataatcaaatacttgctcttcttagtcctgtgactcctacaaatcccagacttctgcctctataggcagaatgaggggtcctggggtgaatatggaagggccattttgactgcctttcagcaagcccaggagaagtggtctagcagctttatagcaggttcagtgccatttacttcctcttggccttagctttgggctttagctgaaagtccaagactactggtaaggtcccaagtaacattttatatattctttatatatgatagaatggggggtgggtaaagggtaagaaagacaagctgcagtcttcctttgttctcaaaacccagctacctttcatttgccccagaccttgacaaaactctacctagatttgaaatttgagtcctgcatatctttgcaggcagcatataatatgcagatgacccatgagaatgagaaatccaaaagcactatgtttctaactactgtttttaaacacttcaatgttacatcgcattcgaacttttttccattgatgactttttatttacctgctttgccatatttctcaaatgctttgtatatgctatggatatcactaaagtattttgagtctctaagacaaaaatgtagaaattggtgggggaaatgaaggttgacatattatgcatatacatcaagatactttccaacttcgggttgcccactgagatcattgccagttgttattgctggggaccaaactacttactctctggtctccaaagggttgaatccttcatacatttctgggcctttggttatacagatttttggaatttgtgagctctttgaagacagaaactcatctttttcatctctgtatccctagtacatagaaccccacattttagtacctagtaagacttcaataaatattgagtggatgggtatgtggatgaaccaacaaagggtcacttctctctgacagtgacaaaatgagcccattcctcactccctcctgcttcagttcttacttgcccttttggttgatgagccagcagccgagattcacagtgtattctttgccacatggacaccatcctctctatcctgtggctgccttgagaggtgcagtttctaggacttgagagctgcagtttttagaagaagcagagcccaatgcccccacctcaggtagaagccccaccttttaattccttcccattgtatctgcctttcatattaagcatcccacctccccctcatcctgccactacttccactgaactttaggtgagttgaatttaatttaagtgattgaactggatcagaccagaccaaaggcgtggaaaaaaatttggtctgagtattttccttggagcagtgcctcaaaagagattccaggcacttgtgtgccacctatgaagttgtatggatagaacagcggttctcacttgaccactctgtgcctcatttttctcatcttaaagtgagaatagtaggggtaaccaactgcgtaggattgtttgaggttaagtgaatgagtatatgttaagagcttagactagtaactatcatctagtaagtgctcaataaaagtaatattgttgctattagtagtagtactattagtactctcaaaagttagcactggacataagattttcaaatacctaaggagtttattaaagcacagatttctggacctccttcttaaattctgatgttgtaggtctggaggggggtccaggaatctatgttccataagtactacatctgattcggccacacgttcttaagaaattacagatataagacctaaggaactgtatatgacatagtaagaccaggtcaaaaattatctccaatttggggagttgtgggattattttttctttgtgagaaaaattgatgtgcatttattaaatgtttaaatagaaacgaaccataatcatagttgaaaatgttggaaataatagtccttgatcaagaaaaaggcaaaacttacagtttatcatggaattagacattataaagtgatggtgctatcaacttgtaaagcctcaaattaaatttgctttttttctcaaacaggtttgagattttttttttttttttttcgagacaaagtcttgctctgtcacccaggctagagtgcagtgatgcgatcatagctcactgcagccttgaccttctgagtagctgggaatacaggcatatgccaccatgcctggctaatttttgtatttcttttgcagagacagggttttgccatgctgcccaggctgttctccaactcctgggctcaagcaatctgcctgcctcagcgtcccaaagtgctggaattacaggtgtgagccactgcacccagccgggtttgagattttataaaaatatttttatgtattcacttagattatttaaactttgcttgataatattatgacacgtcagggggtgactaaatgtgtttttaaagtgttatgtatttttttaattgtgataggaacacttaacatgagctctaccctctcaacaaatcttaaagtgcacaatacagtattgttggctgggcacggtggctcacgcctgtaattccagcgctttgggaggccgaggcgggcggatcacaaggttaggaattagagaccagcctggccaacatggtgaaaccccgtctctacttaaaatacaaaaaaattagctgggcgtggtggcacgcgcctgtgatcccagctactcaggaggctgaggcaggagaatcgctcgaaccgaggaggcagaggctgcagtgagccgagattgagccactggactccagcctgggagacaaagcgagactccgcctcaaaaaaaaaacaaagtgcacaatacagtattgttaatgatagacacaatgttgtacagcagatcactagaacttattcatcttgcaaatgtaatgtagtgtgtgtgtatatgtgtgttttatggtttcttagtttttttggttttgcattttgtttgggtttgggtggtggttttttgttgttttactattttttattgcatgcatgcagtgcaattcatttctataggctagtctggaaacctaatcactatttataacattatttttctgggaaaatatgatcccagttacaacattgacatttctttagagatagaaagcattcagaagatggagactgcccacatatattttacagggatttgggcaaacttttgtggacgagccacaaatcaccatttccctaaaatgttaatataatgttttaaatagagcagcattttactagtctacttatactatttatttaatctctgatttagtagtgctttcttaattaatacatcatttaaaaaattgtccctgctctatcttcacattgcttttgttaggcatttttatgtatgatgtggcccaaatatttataagtcataaaaatttatcttgcattagtataagcaaatctgactataatctgaagaatgtttatagtcagtatttgacttctcaactagcattggtgtacagagtaggtgaagaaaaaaaaaagaataaaaccgaccacgaaaatccccacctgttttagagaagttaggaaataaaagtgttcacaacagccgaggtcatctttaacttttcacttttcaaagcagactgttgactatgaaacactttatttgaggtagaaattaatattttaattgtatttctaaaataattaaatgtatgttcttcagaaagctgaactttggatcatttaggtttgtggaattttagaaatatatttagtttctttcttttttttttttttttttttttttggagacggaatctcgctctgtcgcccaggctggagtgcaatggtgtgatctcggcccactgcaaccttcacctctcaggttcaagcaattctcctgcctcagcctcccgagtagttggggttacaggcgcccaccactatgcccggcaaattttttttgtatttttagtagagacggggttttgccatgttggtcaggctgttcttgaactcctgacctcaggtgatccgcccaccttggcctcccaaagttctggcattataggcatgagccatcgctcccagcgtatatttgctttcttttcagtgtcttctccactctgaattggcagagtcaaaagaaaaaaagtttatgtccttgacttcctgctgaaggataccagcactgattctgttaatgaacagccctagtaaaacaaccataagcctttgtgagaacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtttggaaaataaaaatagatccataatctcatcaccctaacacagtagtttccatttttatatatcgttttctagtcactctccatttgcatataaatttttttatagttgtaatcaaaatgtgtcttttttaacctaccgttatataataagcatatttccatgtttctacttgatctttacaaatataacttctaatgactgcaatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaattagtgaagaaaatttgagtggaaagagaaaataaggctttaaaaaattgttctcttaggctccctggcatttaaccctaagagccattagcagaggcatgactttctctgtgtgggcagatgactatggggaaaaacattgatccggcaggcatttttgcattttctacattacttaaagaaaaattacttgtgtattcttaattaagtagtctaattaattagttctgttcttgaaatcgtttctatttgtgcctgtgtcattttgacatttctaaagggaattggcagtgctgttaatataaaagaaaacttcttattaactttttgtccatattgatttttatggtgagtttggaaaaggatattcagagatactcttccgttaagtttcataaatctgtaataaatatatgttgcagccttgtcattttgctttatatttttcaataaccttttaggttatagttgacagacttttagaacaatttgcttcatttttattaccatcaatactgttcttctatgtattaataacatttgaataaaatgaaaagtttttcaaaataattgttttgcctgccataaaaatccactcataatttttaacttaaaagaatttaacattttgtaaatcttgtgtcatgtttgtattattgtatatcttgtttattttttaggtattggaagaaatttcatgttaccctgagaataacgacgcaaaggaactaaagcgtattttaacacaacctcatttcatggtaagtaataattaaacttccatagaactgaaacctcactttcaaaagaagtttttaaactaccctcataaaatgtagccagcttcatctcatgcatttttatccatatcatatgagactattaagattacaataccaggtaataccaaatattttaagactgttttgtttactttgtgtcacaactgtaaagatactcttggtgaagtggcttttcagggactgtactcatcagacaagggattttctttcttatggggtagtcctttagtcactggaactgtttatgttacttaaaccacaaagaactaaaattagagacagttttcaataataaggaatcgtctgaatctaggtgatatattggaagaattacatctcttttgacaatgcaaaactgctgcactttcttggttcatttctactatatggaaaatggggataacacctgtatttagccaaatataaagctaaatagctaaacaaagctcaaagctcaaaatagataagatactttgctgtggaaaaaggtccatgcttatctacctaactgcaatacaaaaacacaattacagatggaaattcatgttgaatataccattttaaaagcattagccacatcagtttatgtgaaaaatatgtgaaaagtggaaaatttacctcactgccctttgggagaaaatctgacttaaaagccttgttcttataactactattacagatgatactttgaatttttatttatttatttacttttgagatggagtctcaccctgtcacccagggtggagtgcagtggcgcgatctcagctcactgcaatctccgccttccaggttcaagcaattctcctgcctaagcctcccgagtagctgggattgcaggcgtgcaccacgacacctggataatttttgtatttttagtagagacgaggtttcactatgttggccaggctggtctagaactcctgaccttacctcctgcctcagcctctcaaagtgctgggattacaggcatgagccaccatgcctggccacaggtgacacttttaaaataatagtaacagtataatatgtgtatcaaagcaattacctgtgagttattatatatatgctgttttatgatagtgtttctttttttctttttcttttttttttttttttgagacggagtttcgcactgtcgcccaggctggagtgcagtggcgcaatctcggctcactgcaagctcagcctcccgggctcacgccattctcctgcctcagcctcctgagcagctaggactacaggtgcccgccaccacgcctggctaatttttttgtatttttagtagagacggggtttcactgtgttaaccaggatagtcttgatctcctgacctcgtgatctgcccgcctcagcctcccaaagtgctgggattacaggcgtaagccaccgtgcctggccctttatgatagtgtttctaaacttttaaccaagttattgaaataaagtttttttcctaaaagtaactacctggaaagaagcaattaccatattcatccttcctaactctcccacccaagcattaaaggctgaattcaagtataatccttgagagtatttgactttattctatggtaacagcactgtccagtgaaatacaattaggatacaggttctaatgcctgtagatgagtgcatttttacaacctaggtgtataaacacagaacttcgttcaaatctcacctcttttatcaaggtatcttgtaacctctctacccttctcttgaactttctcttctctaactcttttccacttgtttgtattcacctgcataacattctaatgcttgctggcctgccagagcaggtctcttcccagtgaatgagccagggcaatttttctttgtccttccatatcccagcccagttttgttgttctcattgagcttatctcatttagtcattgtgattatctctatttcacagagcaggagaataaagaaactatatgctttattaataatcctcaaatgtgatgaatcacaaatatctgcagttaaattaccgttaatattaccttgttcactgtttcatgcatatgtgctgtgtttccccagattataattcattcccttttagacagcatgtcttctatagcaggggtctccaacccctgggccactgaccagtacccatccgtggcctgttaggaaccaggccacacaacaggaggtgagcagcaggccagccagcattaccacctgtgtccccctcctgtcagatcagcctaggcattaggtcctcataggagtgggaaccctattgtgaactgcgcatgcgagggatctaggttgcatactccttatgagaatctaatgcctgataatctgaggtggaacggtttcatcccaaaactattccccgacctctatcccccacccccacccaccctgccatccgtggaaaaattgtcttccacaaaatgggtccctggtgccaaaaaggttggggaccactgttctatattataaaagtggttaaagatgtgaattcagatgacctggggttgaactccatccttgccaccgtaactttatgaactctgactctgagtcaacctcgtggagtcagaataagaattaagtagctgatatatctactgtgcgtagcacaatgcttgacatatgcttagtgcctaatagatgttatctgatacctattattagttgctccatagtatctatcatgtatagggcacatagtaagttatcagtaaaacattgaatagattaggaacctgcccgtttgcagataggttaggctctccttggctgactgctctgtgcagtgttccatagctagaaacagatatataataaattttggaccaggcacagtggctcacgcctgtaatcccagcattttggaaggccaaggcaggaggattgcttgaacccaggagtcaaagaccagcaacattgggagaccccatctctacaaaaaattaaaaataaactagccagacatggtggcacatgcctgtagtcccagctacttaggaggctgaggtgggaggatcacatgagcctgggaggtcaaggctgaagtgagccatgatggcaccactgcacttcagcctgggcaacagagcgagaccctgtctcaaaaagtaaaaaatgccaggaactgtggctcacgcttataatcccagcactttgggaggctgaggaatgagagtcatttgaggtcaggagttcaagaccagcctggccaacatggtgaaaccccatctctactaaaaatacaaaaaaaaaaaaaaaatagcctggcgtggtagcacacacctgtagtcccagctacttgagaggctgaggcacaagaatcacctgaacccaggagacagaggtttcagtgaggcgagatcacgcctctgcactccagcctgggtgagagtgagactctgtctcaaaaaaaaaataaaaaatgaatttggacagacatgtctttctataaattgctaagtaaactcagctcaattcagagaatgatatagggccgtatgagaccaatagatctttcagatttgaagtaagctaaataaattaacatatacccaaataggagccttttttttcatcaaaatcattacggctcatatagcccattgtatgacagcttatctgtcttctaagtctcgatatgttttgcttttctgaagtcagagagaagttaatatgtgcattgctattagtaaacattttcagaaataataagtaatttttataatttattgaatacctagctaggtgcttaaaagacattttcattcatttatcaaataagtaaatgcctactgtatgccaggcacactatgccaggcactaaggacctagtaatgaataagacaaacaagatccctgccctcatggaacttccactctagtggaggtggggtgggaggacaggtaggagaggtagaggtagacaatgagcaagtaagctaacaagataatttcatatggcaataataactatgaagaaatgaaaggataatggtgcagagattatagtaaagtgggagctgctttagataggggaaagcccctctgaggagtagacatttgggctgagactcctttgaggaagagcaaatgcaaaggcccagagacaggaaagagctttgtagattcaaggagcagaagtcctttgtggctgagatacagttaacaagggagagagtggtacttcctgtaccaagagaggtcagcagaggccagaccaatttatttatttttttaatatataaaataaggccaggcatggtggctcacgcctgtaatcccagcattctgggaggccaaggtggacggatcacgaggtcaggagttcgagaccagcctggccaacatggtgaaacctgtctctactaaaaacacaaaaattagccaggcatggtggtgggcgcctgtagtcccagctactcaggaggctgaggcaggagaatctcttgaacgcaggaggcagaggttgcagtgagttgggatcgcaccactgcactccagcctgggagacagagcgagactccatctaaaaataaaataaaaaatataaataaataaaagccttccaggccattgtaaggagtctgcagttttctcctgattgcagtaggatgacactaagtgatggcacgcaggaaaatatctaatctgtgccttgctggagctgatgtgtagagaacggactgtaggggggataagagtttagggagaccaattggaaggctgttgtgagaggttgtagaggcttggagaaaggtgaggatggtagaacatgggcagatggggtttctgtgttggagatggttacatacaagaggacttgctgatggttgggatgtaagctggtgtaattaaacccatttcacaattccgagaggaaattgtgccctaacaaggtaaagagacttgcttaaggtcactcaccaatcagtggcctcaatgaggttcaagccagatcctgctagcgccaaagcctatgctcctaaaagtcagttgatttataatgctaatcagatttctaataaatttaagttgagctcattggtcattcctaaataagcttttgtgtagataatatcttatgtgggaaatataattctgagatatatatatatatatatactatattaaataagcttttaaatgctggggctttctatcttataagcgtttttaaaatcatggcttcaaaatcttggtatttttaaagaaatattaatagctaaggggaaatatgttaatacttacaatttttttattatgccaaggtttgggagttattcttggcatatttataatttcacacttatttgctcagtcatccgaatttttctttgctttctgattattataacatgaggatttaacattgaattacccaacactgaaaatccagatacttgtagatatttacagtaactaaaggaagaggaaataagggtaaatttaaacgactttaaaattctgtgttttttttttttaagagacggggtcttgctctattgcctagataggagtgcagtgacaccttcttagctcactgtagccttcaactcctgggcaaagcaatccttctgcctcagcctcccaagtagctgggactacaggcatgcaccaccatgcctgtctacttttttttattttttgtagagacgggggtctcactttgttgcccagactggtcttgaactcctgagctcaaacagtcctctttccttggcatcccaaagtgctgggattacaagcatgagctaccacacctggcctaaaatctgtatctttagaggtcatcataaaagaatattatctcactgattacttttttagttattccatttgaaaggctgactttttaaaaagaatatttcctttgcttattgcagctgtaaaatatgaaacattaaatagtcagattttttccactctagtctgatgttgttagttgtcttatacatatccttactatagtacaaaaagtgaaagtgtttttttcctattacacgattgttacgtagttaaaactgacagctatttcagcttagtgacaactgctcactcatacgtcttaacatatttgaagaaaaatgttcaaattttggtttccctattttttattttatatactcttttaagcttttaaaaagatagtctgtaagtggccccctttttctgtttggatatgaattagagctttaggttaagtttcgttttgtggtagcaatcatttacagtgccaaattgtggttaatatcgagtatgaccttatttggtgacatcatttaagcatttttcttttagagtccagtttgagtattattttatgattgtgggcttaatccttccttgtaaataatgcattaaatacaaatgtttgcttatataatttaaaagaatgagtagaggcctgtaatcccagcactttgggaggccggggtgagtgaattgcatgagctcaggagttcaagatcagcctgggcaacatgatgaaaccccgtgtctacaaaaaatacaagaatgatctgggtgtggtggcacatgcctgtggtcccagctacttgggaggctgaggtagaaggttcacttgagcccaagaggtcaaggctgcagtgatatgacgaacataattttagcaaatgaaatgttccagtttttatgttactgatttttgctttttgccctaaatcttggtttcttatgtgaccacaattaaatcagaaaaagagggatttgcccacataggacagcctctatacttgggctcaggagtaccagtacaaggtgcagttagggcactggtgaggaagccaaggtccccagggccatcatggagcactactttcaagctatatattgcttagtgccccttggtgctcctcacccaaatcccagtttagaccagccttctgagattgtgaaaatatctgccatttccattagaaactcaactgtgtataatgctcaaagcatattctttactggtaacaaatcagcattatcttctttatgattttaccagattgttaccttttttttttgcctcgtatgcatgcctttaaaattaaatagccaagtcatgacttttttaagccttttaataaaataacttaatttcagatgctatgagttattatttttaaagcaattttaactgcatttcattatctgcagatattaccgcacagatcccaaattaaaatagaaccaaatttatagttagcacataagaaaatataatctttgtataaagctccagacattttgatagctgtagattctctttgaaatagaaatgttcaaatatttatgcttaatagaaagggtttattatgatggcacaaaaagtgtggtgagtagaaggacattcttttttagggaaacaagggacattttattgttgaagttcaccaagctgacaaatagagatgtcagttcaaagaaatcactttctctttgttaataggctttgcaaaaagaagtcataataataattctcaacttattttttatttaaacaagtgctccaaaaaatataatgaacaaaaaaatttaacatatttagagtttgagttccatatcatacgtgatattttggaagattacgtttttaaggtacatctgtgtgtatttttttctttttctaaatcatatgctataaattattttcatcctttgggttatataaaagcgtcattgtaaatgccattgatgaaagatacttgctcaatactccaattattgcactatttctttttaaatttgtttcaattctaagccccagcacaaatttgccaactctatttatagatgattcttttagctaaattacttgaaattgtaccgtctaccttcatttgaacaagttagttgataacacctctgacccagataatcatcaaacacatctcttcattgattcactcatttattcacttacgttttaaaaaatctatttatcatgattgtcacaaaaaaattgagatagttggatgtcgatattacacactttatgttctctttagatgaatgatacctttgagaggaaaagaatgagatatgtttatagaataaatttgtcagccccatgtctacaaagaaaacatttaaaaattagccaggtgtggtggcatgcacctgtggtcccagctacacagaaggctgcaaaggaaggatcgcttgagcccaggagatgaagcctgcagtgagctgagatctcaccactgcactgcaccctgggtgacagagtgagaccctgtctcaaaataaataaataaataaaataaatttctgctgaaatagtaatgttattaataatttttttcttcataaaacactaggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttggagagccctcagcttagacatttctggtcctaatcctcatttagtaatctttgccagttatacaatattatcttgcagcacatggggggcatgcagatcacctcaccccttctggtactatccaggcaactctttggcttaagagcataggctacagcaggttttgggtgtcttgggcaaatcacttcatgtcagtggacctcagttggctcatctctaaaagcatagttgactaaatgaatgatccccaagatcccacctagctctgaaagtctaatattccattcattcattttatatattcattcatttattcaccaaatatttttgaagtccctactaagtgcaaatcactcttattagatgccagtgatctattgtcagataagacactgccccttactagagctcacgttccacagggctggctacattaaacaagtaaatttgtagcttagcacggtttacttaacaagcccagttatgacagagctggagaggagagaaagctgtgttggagaggcaggaaggtgtgatgttcagccaggcaaagcaggcaagaaggtagaagggaccacaagaaggaggcctcagagtgtcttgggatcattaagttctcaagcagtccagtgacagctgcttgattgtttgtgtgaagactcactacatagaaacatagactgaattggcccggtgcagtggctcacacctgtaatcccagcactttgggaggacgaggcgggtggatcacgaggtcaggagttcgagaccagcgtggccaatatggtgaaaccccatctctactaaaaatacaaaaattagccaggtgtggtggtgggtgcctgtaatcctagctactcaggaggctgaggcagaagaatcgcttgaacccgggaggcggaggttgcagtgagccgagatcgcgccactgcactccagcctgggcagcagagtgagactccgtttcaaaaaaaaaagaaaagaaaagaaaagaaaaaagaaacatagactgaataaaagcataaaactacatccctgagttactttttcagaaagcgtaaaatggtcttgagtctcccctaaaagtctccttccaaaagcttttctgtcttcgatgatcctagtgaagatgtatatttcttctccttttgatgggtttccatgaaaacaggaattattttatgtgaaatataaaatatatattttcaataatagagtgtcaatctctaatgcatttaatacaactttatttgctttcttagttgtcttattcaaagcattatgttactgtgcaggatattcctatatgatctgttttgtttttcagaccctctgcaatgtgtccattcctcaagggtgacatactcctgttacacacctctgttttcccatttgtagcatcatactcataatttttttttttattgattggaattcccatagttgcaagtgacaaaaatcaagcttgaactagcttacaaaatagaggaaaggcttatataaacagggaaaggccaggagtataactttcctaatatctcccctcaagctggtaggttcaggagtaggcacctaacccaagctatgccaatgccttccctagaatttgtgaacttgggaacagagagaaagtgaatcagttcctctctacagagaaatgtttgggacctacagaataataaatgttaactacagttggtttgaggtgaacttctcctggccatgggagaccctttttgtctcatttgctactgtacctagcagagtgcctgcctcatagtaaattcacgttaatgttagttgaatgaatacatacatctattagtttcaagggtggaagctgtattgtactatcatttcccttatgaaattagatttgacttacacactaatttacagcatttttccaggaacacttttcttagtaaccatacaagctgattgaatgtacaagttggaaatgaaacttgaatattacaattgaatcttaggactggaaatattttgataaaccagtttttcacattgctcacctaccacttctgaaaactgcaaaataggaacaatgcaaagttatagtttgtggagtggtacaaattaagtttagagtataaagtctcagatatttttatcaagctttctgacagtgttattctctagtgaaaaataaaagacacagtccctacccttaactgtctcaaattcaaggccactttccagcaagggagcctgttaaaaagtacagatttccgggctccattcgaggcctcctgagcttaaatctaaagagtgggtttaagagtcagcattatttaaaatttccctgtgtgattcttaggattaaccagatctagtgcaaaaaatatgtttatgaatgcttgttttttttaatagtggataatcagaaaacaaaaagtaatccactctgtagaatagtattctggcattaaatgtgactatagaactttcatttctgtccaagatagagtaactgggaccagatttatcctctcatttgaaacaacccaacatataaaaaacaaaatatcatgaaagaacagttttcaagacattagacatcaggcaactaaggacagtgatctcttgtgagacaggaaacaaggtgacccatatgaatgccccaccatgctgccttgagagagtttccaggccacagcacagggaggggaactaaggcagagtaggcagactccctaaattgaggggacagagctgagagtctggggtgaccaaagcaactagagttcataggacagagtactgaagaggagagagctgcacacagacagaacctcagatctgcagaggatctccctcaagtattcagcagagtatcgatcagtgcatgtctaataggaaattccccaacactgagaaactccccaacactctccactttggatggaaaaaaaaaccatccaaaaggattggaaggaacagcgcctgcactacctgttcccaccagtcagactagaaaaatttctaattcatggctcattgtgtagagcgctcagggaagtcttatctctgtaatgagaagtaattagccccaaactgacaactgctccagacctgcctaatggatcatgaacgcaagacccaaaggatcaaactatgtccgagtaactgatctaagtctcagaacaaaacataagaatatttttaggaatacaaaaacatcaactatgcaacaaattcacaatgtctgacatctaatcaaagattactaggcatgtaaaaagaccagaaagtgtgacctataatatggagaataatcaatcaaaaatgacatagaactgacagataatagaattagcaggaaaatacactatgggattaatggcagattagacatttcagaagagattagtgaacttgaagacagagcaataaaaactatcaaaaatgaaacacagcaagaaaaagaatttttaaagatgaaaagagcatcactgagccgtgggacaacttcagtcagcctaatacatggttaattggagttcatgaagaagagaggaaaagaaagaagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaaaaaaagaaaaaagaaattttacacacagaggaacaaacataaggatgacatcaatgtcttatcggaagcagtacaaacaagaacagtgtcataaagtactaaaaacaaacatttctcaacttagaattctaaaccaagcagaagtatctttcaagaacaagaaggcaaaataaaaatgtcttcagacataccaaaactgaaagaattcagcagacccacactataagacccacagtatatttaggacattcttcaggcagaaggaaaacgataacagattgaaatctgaatctacaaaaagggaataaagagcactggaaatgatagctatatgggtaaatctataagttctttttcttattacttcaatctcttataattggcaatttaaacaaaaataacaatgtgttttagagtttatagtatatggaaaaataaaatgtatgacaacagtagcacaaaggtcaggaagaaagacatagaagtactatatactattgtaaggctcttatatgatgtaggggggataagggttatatgtgaagtggtataatatcacttgaaggtacactgacaagttaaagatagatgctataaaccctaatgcaaccactaaaacaacaaaatgaagagttgtgagagaaaacacaggagagaaaacagaataaaaaataatacaaagaaaggcagaaaaagataacagaacaggtggaacaaatagaagtcaaatagcaagaatatatatttataccagactgtatcaatcatcatgttctgcttgtaaaacatgcacttcatacacaaagaatagtttcaaagtaaaaaggtagaagccaggtttggtggtgcatgcctgtagttccagctacttgggaggctgaggcaggaggatcacttgagcccaggagttcgaggatgcagtgggctatgattgcaccactgtgctccgcctgggtgacagtgtgagacttcatctcttaaaaaaaaaaaaaaaagtaagaagatagaaaaagatatactgtgataacattaatcaaaaggtagctggagtagctttattgatatcaaaatatattctcagaccacactgggattaaattagacatgaataacagagagagataaatcgccaagtacttgaaaattaaataacacaattctaagtaacccatgaattaaagaggaaatcaaaagggaaattaagaagtattttgtaatgaattaaaatgaaccacagtatgtcagaatttgcaggatgccactaaagcagtacttagggagaaatatgtaccattaaacacctatattagaaaagaagaaacatctcaaatcaatgacttcagcttataccttaaaagtaactaggacaaaatggagtaaattaaacccaaaatgagtagaagagaagaaataataaagatcaaagtagaaattaatgaaatagaaagcagaaagcaatagagtatcaataaaacagaaaatactttttctttggaaagatcagactgatcaggaaaaatggctatacaatcacggggaaaaaaaacatgaattaccaacatcaggcatgagagaaggggcatcactacagagtctacagatataaaaaggatgataaagaaataaacagatttatgccaataaattcaacaacttagataaaatggaaaaattccctgggagacagaaactactaaagcttatttaagaaggaataaactgaattgccctatactatctgaaaattgaatttgtagttaaaaactattcctcaaagaaaactccaggtcaagatggcttcactggtaaattctgtcaaacatacaatggagaaataataccaattctatacaaactcttttcaaaacattgaaaaaaaaggaatttttcccagctcatcctagaaagccagcattgccctgataccaaaaccagttaagacattacaaagaaagaaaactatagactagtattcctcatgaatgtagatgtaaaaattctaaacaaagtcttagcaaagcaaatccaacaatatatgaaaaggttaatatgttctcacttcagcagcacatatactaaaatataaacagtacagaaaatattatcatggcctctgtataaggatgacatacaaatgcatgaagtgttccagatctttaaaatatatatatgttatgatcaaatggtgattaacccaggaatacagctttacttataatagcccaaaccaggaaacaattcagtgggtgagtggataaactgatatgtccatacaatggaataccactcagcaagaacaaagaacaaactactgatacatgcaacatcatggtggaatctcaaaataattatgctgagtgaaaaaaacaacaaaaaagagttcatactgtatgatttcatttatgtacagtgcaaacaaatctgtagtcagcaaaagttgactgtatcagcctttggtcgacaactatattatcagctttttgattgtcacattagtagttgcttagggatgtggtggggagggtatggagggatgggagaatattaccaacgagcatgaggaaacttttgggaatgatagatatatcactatcctgattgtggccatagtttcatacatatgtcaaacttatcaaattgtacactttaaatatgtgtatgtcaattatatatcaatgaaaactgtttttaaaaataataggcaacattaaaaatggagcaacagggaaaataatcataattagaagatttaaaagcactatcggccaggcatggtgactcacacctgtaatgccagcactttgggaggccaaagcaggtggatcacttgaggtcggcagtttgaaaacagcctggccaacatagtgaaccatctctttccttaccctcgtctctactaaaaatacaaaaattagcttggcatggtggcaggcacctttaatcccagctactcaggaggctgaagcaggagaatcacttgaaccctggaggtggaggtagcagtaagctgtgattgtgccactgcactccagcctgggtgacagagtctcaaaaaaaaaaaaaaaaaaaagaaaaaagaaaagaaaagaaaatagtgtgttaaaagcattatataaaatatatgtatatagcaatcaaaaaatcaaaaatagtatttttgtcatggagcaattttgtgtgcgtggcatactggatggtcttctccattttccatattttctttaattttttttaactggtaattaaaattatctaccgcaaaatcacaaatattaagagaagcactgtcatagtaattctacttttgctgaactttttattttttttttaacagggaatcactttaaaaatgaatgaactaaatcattgtattgttgcaagaattatgcatgggggcatgattcacaggcaaggtaagtttcatatatatttctttctttgccttccttaattttttttccctgtagcctagtgaagaaaatgtttttgtttgttttgtttttgagatggggtctctcactatgttgcccagactggtcttgagctcctaagtgcaagcaatcctcccgtctcagctttccacaggtgcatgccatcacacccagctaagaaagtataaaggatacatataaagaatcttttaaaatcatctttgattttaatcattattggcctccattgtttcttattcatctgcacaggctccagcatgtagataatgaagggagaatatattagagttctgttagccagagcatctctgtattagattactacttacggggaccacgggagataaagcaaataattacactgggcctcacgatgtaggagagacatctgttctagagtaaaagatatatgtaaataaataaccatttaagaagtgttctctcattcatttaggaattagatatgctatttataaattaggacatcatagagttaaataatacaaaaattaaatggtaagagatgtcaaatcgatgattaaattattaatacctgccatggtgagtgcagtcattctgtggagagaattcactaagaactggaatagacaaagaatgatgtgggggttttttttgagacaaggtctggctcagtcacccaggctgtgcaatggcacaatcttggctcactgcaacctctcctcccgggctcaagcaatcctcccacctcagcctcctgagtagctgggaccacaggtgcacaccaccatgcctggctaacttttgatatttttgtagagatgggcttttaccatgttgcccaggctggtctccaattcttgaacccaagcaatctgcctgcctcctcccaaagtgctgggattataggcatgagctaccttgcccagctcgaagaatgattttttaagaaggtgcatcttcagttaactctcaaggatgggcagggtttggatatgtggatttaggctttttctttgaaaggattgagttatatgcactagtatttagaggatgttccaaaaatgattcttctggcagactctctgtctttgagatagggttatttttgtacttaacacctctttccttacccccagagagcgagaagtaacactctaagcattttagtgccttattctcctcttgagaataagaggagatcactgtgtacacaacatgatgtctggcatcattgctgctttcagaggaatccttgtaggcgtagagggtgtacagcactcccacaggaggatatttggttttagattccagtatgtgttttttgtttgctatttttaataatttttatatgttcagtaaagccacaacatcattctttcttttttttttcttttcttttttgttttttattatactttaacttctagggtacatgtgcacaatgtgcaggtttgatacataggtatacatgtgccatgttggtttgctgcacccatcaactcatcatttacattaggtatttctcctaatgctatccctcccccagccccccaccccctgacaggccccagtgtgtgatgttccccgccctgtgtccaagtgatctcattgttcagttcccacctatgagtgagaacatacggtgtttggttttctgtccttgtgatagtttgctgagaatgatggtttccagcttcatccatgtccctgcaaaggacatgaactcatccttttttatggctgcatagtattccctggtgtatatgtgccacattttcttaatccagtctatcaatgatggacatttgggttggtcccaagtctttgctattgtaaatagtgctgcaataaacatacgtgtgcatgtgtctttatagtagcatgatttataatcctttaggtatatactcagtaatgacatggctgggtcaaatggtaattctagttctagatccttgaggaatcgccacactgtcttccacagtggttgaactagtttacagtcccaccaacagtgtaaaagtgttcctatttctccacatcctctccagcacctgttgtttcctgacattttaatgattgccattctaactggtgtgagatggtatctcattgtggttttgatttgcatttctctgatgaccagtgatgatgagcattttttcaggtgtctgttggctgcatggatatcttcttttgagaaatatctgttcaaatcctttgctcactttttgatggggttctttgtttttttcttgtaaatttgtttgagttctttgtagattctggatattagccctttgtcagatgggtagattgcaaaaattctctcccattctgtaggttgcctgttcactctgatggtagtttcttttgccatgcagaagctctttagtttaattagatcccattagtctattttggcttttgttgccattgcttttggtgttttagtcatgaagtccttgcccatgcctatgtcctgaatggtattgcctaggttttcttccagggtttttatggttttaggtctaacatttaagtctttaatccatcttgaattagtttttgtataaggtgtaaggaagggatccagtttcagctttctacatatggctacccagttttcccagcaccatttattaaatagagaatcctttccccatttcatgtttttgtcaggtttgtcaaagatcagatggttgtagatgtgtggcattatttctgaggcctctgttctgttccatttgtctatatctctgttttggtacgagtaccatgctgttttggttactgtagcctcatagtatagtttgaagtcaggtagtgtgatgcctccagctttgttctttttgcttaggattgtcttggcaatgcgggctcttttttgggtccatgtgaactttaaagtagttttttttccaattctgtgaagaaagtcattggtagttttatggggatggcattgaatctataaattactttgggcagtatagccattttcatgatattgattcttcctatccatgagcatggaatattcttccatttgtttgtgtcctcatttatttcgttgagcaatggtttgtagttctccttgaagaggtccttcacatcccttgtaagttggattcttaggtattttattctctttgtagcaattgtgaatgggagttcactcatgatttggctctctatttgtctgttattggtgtataggaatgcttgtgatttttgcacattgattttgtatcctgagactttgctgaagttgcttatcagcttaaggagattttgggctgagacaatggggttttctaaatatatagtcatgtcatctgcaaacagggacagtttgacttcctcatttcctaatcaaataccttttatttctttctcttgcctgattgccctggccagaacttccaacactatgttgaataggagtggtgagagacggcatccttgtcttgtgccagttttcaaagggaatgcttccagtttttgcccattcagtatgatattggctgtgggtttgtcataaatagctcttattattttgagatacgttccatcaatacctagcttattctgagtttttagcatgaagggccattgaattttgttgaaggccttttctgcatctgttgagataatcatgtggtttttgtcgttggttctgtttatatgatggattacgtttattgatttgcgtatgttaaccagccttgcatcccagggatgaagctgacttgatcgtgttggataagttttttgatgagctgctggattcgacgttccagtattttatggaggattttcgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaagaatatatattctgttgattttgggtggagggttctgtagatgtctattaggtccacttgttgcagagctgagttcaggtcctggatgtccttgttaaccttctgtctcattgatctgtctaatattgacagcaggaaacatcattatttctttaacttctctttgttatattactgcactggctaggaccggcagtctttcaaggagtggtatagtagacatcccgtcctattcttgtttttaaacggaatctaaagttagccgggcatggtggcgctcacctatagtcccagctactcaggaagctgaggtgggaggattgcttgagcccaggagttcgaggctgtagtgagctatgatcacgccactgtactcacctgggtgtcggagagagaccttgtctctagaaaaaaatgtttttttaaaaaggaacctttccaatatttcttcattaagaataatgtagatttttagtacatgccttttattagggctaaagaagttcctttatattcttagttgctgagcattttaattgtgaatgggttttgaatttaatcaaatgctctttcagaatctgctgagatgatcatttgtttttttccttttatctgttaatgtggtgaatgtcttttaaagatttcctaatgataaactacccttgcatttctcagataaactcagcttagtcattacatattatcttttttatgtactgcccgactgtctgctaatgttttgtttataagatctcagtatgtgcatttatgagtgagactggcccgtagttaattttcctctcttgtatttctctgattttagtttcaaagttatatctacttcacacaatgacttggagagtattccctcttcagttctccgagagattttatataatattggaatgatttgtgtcttgaaagtttggcaggacttgcctgtaaagtatcacagcctagtgttttggtttttagttttaagaaagttttgtttttgttttttaacaactgcttcaatttctttaacattaaaaggccatccaggctttctatttcttgagtgagttttggtaaattacattttcctaaaaaaaaataagttttaaaatattgcagagagcttcttcatagtattctctcatctttttattctctgccatctttgtcattatgcccctgttcatttctaatattgtttatttgtgcctactctttttttcttgatcaaccttgccagaggtttgttcagaaacccactctgggtttggttcattctcttcattatatgtttattttctgtttcattgttttatgacctaatttttattatctcctttttttttaactttctattggttttggctaactttacaaatttgacacatagttcatttatttccagtcttttttttttttttttttttttttgagacagggtcttgctccatcggccaggctggaatgcagtagcataatcatagctcactgcaacctcgaactcctgggctcaagtaatcctcctgtctcagactcctgagttaggactacaggcaaccacactcagctaatttttttaatactttgtagagatagagtcttgctttattgcccaggttggtctcaaactcctggcctctagtgatcttctcgcctcactcagcctccgaaaacactgaggttatagacatgagccaccatgcccagccttcttttcttttctttttttttttttttttttttttttgagatggagtctcgctctgtcgcccaggctggagtgcaatggtgcaacctctgcttccgggttcaagcgattctcctgcctcagcctcccaagtagcggggattacaggtgcccaccaccacgcacagctaatttttatattttagtagagacggggtttcaccatattggccaggctggtctcaaactcctgacctcatgagctgcccacctcagcctcccaaagtgctgggattacaagtggaagccaccatgcctggcccagccttcttttctaatatgtgcctttaagactaaactctccctctaagtactgtcttaatgtatcccaccagttttgacatgacgcatttttataactcagttctaagtatttttatatttctattatgatatttttcattgacctatattatttataattgtctgttacttttcacacttaacaggattttctgtatatctttttgtaatttacttctaacttaattacattgtggtcagagaatgtagtctgtatgacaccatttctttgaggtttgttgagacttgctttatggcatagcactttaatcgtttttataaatggcccacgtgtacttaagatgaatgtttattctttaattgttgcatgcagaggtatctttttgtaatgaagccaggtcagtgtgtacatttctgcacaatttataaataaggaagcaacattgtaaataacactctaagcattggttcttggtcatttctttctagctgaagtattacaagatgctgaaatgccaaccaaaagattaaattatctttaacagaatttgctgttgtgtagatattatcatgtcacaactcttggaaaattgacaaccttcgtatcatatctggtagataacgatagcagccaacactgtcatggtgcttggtatgtgccaagaacagttctaagccttctgcatttattaaatttgtttagttcttaaaacaatcctatgagatgggtactattttcatctccattttacaaatgtgaaaactgaggtatggagagtttcagtaatttacccaagatcttaaagctagtaagcaaggaagctggaatttgaacccaggcagtctggatccagaagccatacttttaaaccactatacataccacctctctcagaaaaatagatttctgcagccatccatcaaaactgtgccttccacaagtagatatatctgttttgatgaggttactacatgagttaaataattctgctgcaaccaaacttgtacctgcctctgaaatattggccctcaatattcaacttagtttttaaaaattacattgatgcctctggattttgttactatgaaagcatatatcatttcatgtttataatgttatataatttcttaggtacacttcatgttggtgatgaaattcgagaaatcaatggcatcagtgtggctaaccaaacagtggaacaactgcaaaaaatgcttgtaagtaaatgaaagtttttcctttcctaaaattgacttttactttgttagcttgtttttaaatatacaaataaggagtattcttctgtaatcagagaatttctggtaccatatttatgtggacttgaacttatataacattcataaaactgacaactagaaaaatgttgaaatacaatagagtttacaaacattttgcctgtctttagcagtgtgggctttaacactctccttttatcctttatctcctgtttcttaccaagcagatgattaaagaaaaccttttcagtgtttgtacatgtgaactagtttctcactgacctcaactctcctgacatcagcagtgtcagaaacctctttcctgttgagctgagtcatagccagctgtcgtggatttctctacagcatagaagggaggaaagccacggtagaccaggccatttttgaccatacatatccaaaatctgtattcaaattaggctttggattttttaaaaaggcaaaatgacagcctttgcctatgttcattgtcatagcaagcagacagaggtgtttggggcctctgatcccttttcccactgcagtgtagtagcacccaggttatgaatacctattaagtatgaaataagcttcacagactcaccaaacatttttttttcttttttttgagacggagttttgctcttgttgcccaggctggagtgcaatggcgtgatctcagctcactgcaacctctgccccccgagttcaagggattctcctgcctcagcctcccaagtagctgggattacaggcatgcgctaccacaccctgctaatgtttgcatttttagtagagacggggtttctccatgttggccaggctggtctcgaactcccgacctcaggtgatccaccagccttggcctcccaaagtaccgggatgacaggtgtgagccaccactcccagcccaaaatttttttttaaaaaaaagccaaaattaataagcaaaaagtggctgggtgcggtggctcatgcctgtaatcccagcactttgggaggccaaggtgggtgaatcacctgaagtcgggagtttgagaccagcctggccaacatggtgaaaccccgtctctactaaaaatacaaacattagcaaggcatggtggcgcgtgcctataatcccagctacccgggaggctgaggcaggagaatcactggaacctggaaggcagagtttgcagtgagccgagatggtgccactgcactgcagcctggatgacagagcgagactctgtctcaaaaaaataaataaataaaaaatttttaaaagtaaaaagcatattctatggggtacaccattataatgtggcatactcaatgtaatttttatgtaattacctagtctattgtctaattcaatgtatattcacttttgaaaggcatgtcacttagaaagttttgtattcacatctataaaaaggtgaccattgaagatctgtgagaccattgctgtatgagcaaaaggcaattggctgctgggcttttcccaggaacttactctactgttaactcgagcagtccctgcttcatgactacatttcattttccggctatgtgctctcagatggcttgtgctaattgcccccatgtgttttgagtggcttcttacatggttttgtgaacaattgtttgtaagaaaacttttctttctttcccaccaccccccctccagagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaaacggagtgtctgagggaaaaaaactaaaggccataattgcagtaatatttccaggaagttcattcacttcccttgttaagaaatcacatagatagttcttctttctaaggatctgagaagtgatctatttctgttgagatacagttgttcatacaattgtgacaggtctctagatggaagttaagtctgcaatgaattgataattgacttcactagagggaaataggcttttgcaaccttttgtaaaactgtttaaatttagaatggtatgtgatctgtaaacaagtaagttttctagagtaatacagccccaaagtttctttcttaaaataggcttatcctgtagaaattatagttcttccaacctatattattcagttttgtgttggttgttaaatgagattcaaaaatctattctttttgtattggaaatataaatgggcataaatgatatcatcctttggtcattgcacgttcagctcgagtgttatttattgaagcttgttctttcatgtgcatcttccgagagtatgtgcatcaatatgaagtacacacttcctaaagtttatttttaagactgacaggtaacttattggatttgtacttaggagaacctgagagagaattgtaatacttctagtctctagtgatggtgtaaatttcataagaaaaatcagaggcttcatattttttaaaagcctattgaagatacatattaaaatgtatagttttgtcaagtatatttttggtgagccatggcaattgaggtgtccgttgtaacgggtcttgagctcctcttggtggctttttatggaacttcaattaatagtatatttcaaaagaaaatgcagaattgcttctgttccaggattcagagtattgaaatttgttacctagaacacaaactttgctgggaaacaaagaatgtcacacttaacattctatgtaaataattttaatattccagagttacagatgtccttatatcatttctcatctgttgaagaaatttagtaaatacaattgacttttgtctttttggctaactaaccagaaggtactgttagttattaatacaacataagtttctctttttttttttaaatggtcgaactagtttggggtggaaccagtatcatagatgtaaattctatgttcttgagtaagaagaacccctcttaccttctttgcctttgaatagtagaaaaaataatgatacttctctcctagctccacctccagcctttttggccctcctgttccctggcagaattcaagcttgtggttggactcttcccagctagggcaatacttcaaaaaaaaaaaaagaaggctctctggccacctgcatctgcatcccccaggtccttggttaaagagtagacccctgcccctcaccctggctctactgacttgagtctctgcgggtggcacctggagatcagtcttgctcactaacatatgagaatgctcttctaagggatctcattacctttaaggctgacaggttctagaaatgctcttaagtcatctggggaaaaaaaatgtcttttaaaaagacatgcacatttctaaggcttaaaagaactctacagaagcaaaaattaaaaagtacttatttccttcctctccttgttcttatcgttaaagttgatttggacactaagggaatggagcctggaaaatattttgagtgtatagaatagtagagagaaagcaagcgatagaggagcctggatataggaagagtggctgtggctcctaggatctttgctggaagtgtaatattgttataggcttgagattattgttttaatcaatctgctaaaatagtcttaaaaaaagagttcttctctgatgtatatctcttttacccttactagtaataatatttattctataatagaaagattctgaggtgattgtaacatgtgaaatcttaggtttgtttctcttcagattgggtcagttagtaactcttgacacaggtactaaaaattattaaatacttttcaaacctaatctttaataaaaattaggcagttgggatcttcagcacgataatttatggtaatgtttgtcatcttatacttgatagggttttaatatcaagtcactcttctgggtctcattaaaagaaagaaaaggtatagaatgttagagataggaaagaattgattaatgaatgacacagtcatcacttaaaatatgtgagccttcgaactgcaaaatttttttcatacttctgtgaaatcatgcaagcaagtcagtatggcacctatacagctcaaacctcaaaggaaatggttgtcagactgtggttgttactgttgatgtaaatatctctgtgtttctgtgctggtgttctgtgttaatgaaccttgtgtcttatttcagagagattccccttccacttccagacagtccccagctaatggtcatagcagcactaacaattctgtttcggtaagaactttagctccacacagcaaagtgtgacaattttgttggtgctcacctgccatgagtgttctagttacatgtgttcagtggaaatagtgtcttctgctgatatacaaggctactacagctacaatgcactttactcctggaaaatctttttcaacatttccttctcattaaaaatccccttcaatagttaaatttgaagaaatatagttcaagactgctttggtcattctaaaaatatttctatgccaccccatttgtatgtatgactttgctcaaacctatgcaaaggatgtaaacggaaatttgtttaaacttctaaatattttttaatttgaaaaagataaatgtaagaattttgcagagtaggcatttgggtattcttgggctttgtagttttctattctgagtgatatcagcaacatgttttagtttccgctatctaagtttacgaattggtgtgccctctgttattgtggtacgtgcacatatttttgtgaattataagccttgcctggatatgaaaagcaaaaagaactggcttcaaactgcacttaagccacgctgttatcacatctttaacacaaagtactttatatttgacttgaacttggagttttaaattttttcagaactatccattttggaatatagaaagaattgtttttaacttatttaaacaaatggaagcacttaacaggtgcagactggcaatattttggttgctaatactgctgtttatgacccagttaaaattattgagagttctaataatgcagcagtattcttctttcctgacttttaatttgccctttgagaatatatcaacttttttatcaggtaaaattgtaaataatttagaaattatctcaaatggaatgatattctaagtatatcgtaagagaaattatgaaagaaaattgtctatgactttattttcaactttaaaataggctaccaaaggaattcattcataacagttaacatttaatacttttaagatgatgaaaagccatatagccattgaatttttcaaaatctaaatggttgcagtgactaagttgaaaagggcaacagctccttttatttattttttttttttaataggctgtttcacttgcagtggcttttgtgttgaagatgctgagttgtttcttaagaacacattttctctctgcttaaacttacctgctttcttcagcttgctgctaaatggcctgggtttgactttttgataactcaacatttctgataaatggaataatgtatattatctctttacaacttaaatctagctcatttttttaaccatattgtaacagaacacacaaattactttgtactcttgaaaaataaatgaaaatttttctcctgggttggctttattctacaggacttgccatcaactacccaaccaaaaggacgacaggtgaatagatatcctctatagaaacttctctaaactgagcagctaatagccaatcctttattaaccctttccatcccataatgtttgcattttggaccataacatttgagcattgagagcttgtaccatttcattttaacacattacacatgactaattctctataaagaatttttcctcacatctttgtagctgtaatggttattgtaatttcaacctgataattttatattaatggttaagaattcagcctttgggggtggctgtgggcctgcctctggcatgcaaaagaattttaaaggttataaaattcttagaattctaagactaactaaaaagttattcttaaaatgctgatgaacatttttaagcaaaaattttctgaagttgaaagctttttcttaaatttgtatttgcatgtgtatttctaaaagccatttgcaatgaaaaataagaaaagaatataaattatcttagcttcacatcctgatatacctgtgttagttcaaacatgaaaagttaagtgctgcctaacactggcaagtaactttcaaattgccagcactttagaggtatagattttaaatgcaaatgcagagacttgtaattttataggctggattgctgaaaataaacagaaaaatcacacagtggttccaaagtcttcaggttggttttacagtgacttaaacattaatattcaattttaatttcaagagatagaatttttatgggatttttatcttgaaatatggtattaaaaataatcagatttagtgttaagatatgtataaattagtacctgatagaattcacccataattttgtcttaagactgtataattgatggaacattgggtatgaattaccttatcttaaagcatttaaaaaataaaataattcataaaatgctgccatataataaacccttgaatgctaatctatttcctaagtaaactcacatatcataaaactcagagccttgaactatgcatgtcttgaagctctgtgctgatttcaagtgttacattgggggaagctagggttcaaattcatttttattctctcagaagagtaaaatacaaacctaaaacctaaattagaaaaaaatgaagctttttttaacttttaaaaaattgtttgagttacacttaactttatcagcaatgtgtagacacactgccagttgtcatataagcattctacagcaagataccaacccagagttcttgctaattttatatcgtgtgctgctttagggttaaaacctatcctgactgctagtatttatggcttaaaggctgccacgcagtcatgacaacgtatccataatgccagcatcaccaatgcaggtttaaaaaagagcgagcatacttttctataattagaggcctattctgttacagtaaaagcataaattaagtctttatttttattaaacaagtatttcaagtgttccttccaaataaaaacagcaaagttttgaagctatactcatcaaagattactagtacattgtttctagcggtagaagttttttgtgtcgtatttccatgcatcgtttttgctttcaccatctgatgtcctgtttgtattgtaactgttggtgtgtggttatgacattagagctaacttctctttcacatcactatggcatcctttcttacgaactcctgttttatagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggtatgtttttatgcgtgttttgctttgcttggttataaaaacaaagccctgaccatccattttccaattttatattattttagagtgtaaaacctgtttgatatattccttcctttacgagccaaacaaaatttaaattagtcatccaagaattctatatcttcagtatctagtgagatcctagttgcagagtcagggcttcattttacacaaaaagaaaggaaggtctggaaagagattggatgagcagccctgagccaagtcatggtctcacagcagagccctccactcctatatgctgttataattgttttagaatggcattaaaaaaatgtacgttctccttgcccttctacatgctttcatgcccatcccattcccaccaccagcaaaaaatgtaggtgcagtgcttcagtgtcactcagagtatttgaagataaaatgtatttcactgttagaaggaggtagtcagaagctttgttctttaccttgccagtcctttaaaaataccttttctgctagaaagtttaagccctaaaagcaggctaaagttaggggttttaggcactgtttttaactgagagaaaaggagtcacagatcactgtatattttgataaaatctatttctgctattattgttaccgtttccttagttgaactgtcttttggaaaatattgatggttttacctttgttggtacttgggcaatataccagattatttctagcacaaaagagataatgtctgagttttgtttcatgtggcaaaaaataacagccattaagcatcctgccagttcctcctaaaatacttgaacccagctaaaagagaccaaagacattgagtccatagaaatttctacctgcttttatctatttttctcactagttaagagatttctcagttaatctcttttgcttgatcgcctctttcagctatcccatgtttccccaaaaaatagtattaaatttagaatgttggagctgatgaggacttcagatgccatcattttatacataaggaaacgtgggcccaaatggagaagcagcagccttccatctggcattgtctttcagtctgatcttcgagaaacagttcaagcataagcaggaggaaagcaatctttaagtcgttgccgtgatgatgccattatattcttactgatatttacattttacagaatgtcttctttaatgttaccatatattatgggcatttattgaaaataattgtgtagattccagacctcttctgcctagtcagatcatctatataaatgtttcaccaatttctagaactctgagtcctctggaggaatcctgagtgatggcagtgcaaaaagcagatttgcttcctatttcctgtaatggtggatgagattatttggataaatcctcctgatgaaaaaaaatgaaaagtgccgcagaaaatatgtttttcaaatgaccttgaaagcactgaatagctgaaaaggtatcaggggccaggcatggtggctcacacctgtaatcctagcactctgggacgccgaggtgggcagatcacttgaggtcaggagttcgaagctagcctgaccaacatggtaaaaccctgtctctacttgaaataaaaaaaaaaaaaaaaattagccaggtgtgatggcaggcacctataatcccagctacttgggaggctgaggcaggagaattgcttgagcccgagaagtggaagttgcagtgagccgtgatcgcgccactgcactctagcctggacgacagagtgagactctgtgtccgggaaataaaaaaaggtactggggagctcagtgaccaattttttttttttttttttttttttttgagacggagtctcgccctgtggcccaggctgcagtgcaatggcatgatctcaggtcactgcaacctctacctcctgggttcaaacaattctcctgcctcagcctcctgagtagctgggattacaggcacccgccaccacatatttttagtagagacagggtttcaccatgttggccaggctggtcgtgaactcctgacctcgtgatccacccactttggcctcccaaagtgctgggattacaggtgtgagccaccacaccaggcctcagtgaccaatttttatgtgaaagcctttaataagaatgataagtggaatatcagagttaccaagtggcccattttgcaaacagggcatttgtcattactgaacacttctgtgccagagaaccaaggttaagatctaaggccagtacaagttggggaatctgttagaagaccctcctcattgttaggagtgcaagaggcagtccccccaggctaaaaggaaacagataagcatacccttatttcccttcaacaccggaggactatagagaaagctgccttgtcactgagcaaagcaaaagatgaggaaattgggaacaaacttccaaattgtggccaccagtccaccttgaatggatttgcacccaggtacacacagcctggggcagccaggggagctgaagccatgtacttgatttgaagtttcccctttctttactaatagtttcagatgtatggtataaacagaaagtctctgaaggcaaacacttttatcctaacccccactaacttcatcctatccgcccgacataaactttttccagggcagtagccagcaagtcaaaattatcaggcacacaaggaaacaagtaagacccaacagaaatgacagatagtagaaacaaacccaaacctactgcatatattggaattaagagacaaagattttaaaaataagcttacgaagttggttcgtttgtttttgagacaaggtattgtgctctcgcccaggctggagtgcaatggcatgatcatggctcactgcagcctcgacctcctggacccaagcaatccacccacctcagccttcccagtagctgggacaacaggcgtgcaccaccacacccagctaatttttttctttttcttttttttttttttgtagagatgaggtctcactatgttgcccaggctgatctccaactcctaggctcaagtgatccttccaccttagcctcccaaagtgctgggattacaagtgtgagctaccacgcctagcccaggtttttaaaaatcaataataagcttgtaaaatatcttcagagagcagaaaaaaaatgttaatgacatagcagattttaaaaagaaccagaggaacatccagggggaaacatgcagtaacaaaattagaatctcagtggtcacacctattagaatggctaacatttttttgaagtttcatcagtgggtaaatagatcaataaattgtgatatagccatacaatggaatgccactcagcaataaaaaggatcaaactattgatatatgcagcagtatggatgaaacacaagatcattatgctgagtgaaagaagccaggcaaaaaagagaacacgctatatgattccatttacataaacttctggaaaatgcaagatgggggtggagggagggaggaattacagaggggcatgaggaaattctggaggtaatgaatatgtttttctttttttggagacggagtctcgccctgtcacccaggctggagtgcagtggcgcaatctcagctcactgcaacctctgcctccccggttcaagtgatcctcctgcctcagcctcccgagtagctgggattacaggcgcctgccaccacgcctggctaattttttgtgtttttagtagagacagggtttcaccaggttggccaggctggtctcaagctcctgacctcaagtgatctgcctgcctcagcctcccaaagtgctaggattacaggtgtgagccaccgcagcacccagccatttttattttttattttttatttttattcttctaaagtcaaggtccctctctgtctcccaggctggagtgccgtggtgcaatcttggctccttgcagcctggaactcctggattcaagcaatccccctatctcagcctcccaagtagctgggattacaggcgcccgccaccacgcccaactaatttttaaattttcgatagagatgagatctcactatgttggccaggctggtctcgaactcctgacctcaggtgatctgcccgcctcaacctcctaaagtgttgggattacctgtgtgagctaccacacctggctaagaatatgtttttcttgattgtagtgatagtttcatgggatgtttacagatatcaaaactgataaatttgtatactttaaatatgttcaatatattgccaaaaaactgaactgttaaagttgcaaaatatatagagggagaaaaggattctaactgagatgataagaaagaggcccactgggcagtgtgtaccccaagacctgaataggactttgggggtataggaagctattcctggcagaagagaaagatcaattttcctttgcttggaaactgaattggcctctgggatgtcagtgggcatccaatactaacaagaaagatttgaaacaattgtatcagccagacccccaaaactttgatcaaatatattgctaccaagtcacattcttcacattttctagatgagaaatcagttttttcggacccaaatgccttactctaggcacatcaatttagcccttcaatatattttagctcccggactctgtcatccctccccttgccttgcctacaagatcctgatctaagccatcaataaattggtaggcatgtgtttgaaatttccttccaggttgaccttaaccctaacacggtttctgtgcacttactgagctaaaagagctaatgtttatttctgcagtgtctggtaaaaatcaatttcattcctctgtcatcacaccacatgagactatgccacaattttttcctgggaacctgtatttttgttttaagcttaagaacatttattataagatactctctacattgtaacataagcttcacaaggtcacacgattttgtctcttaacctgtcaaaaaattcctcaattctgtttgtttccaaagattctatgccttttagttctgactaatagcacatattgacttgcaccaaaagaatccccaaagcaagcctttatcagcctcctctgtatgccacgtgggtaatatatggagatggactttgatactattactgagagttcgcagtattttccaataaatgtctttcccccaaccaaaaataaatacataaaaacttcagtgaacaagagcgagtaagagatatggaagacagcctctttaagaaaatagaaaataatacttcccaaatcattttatgatgtcaacattaccctgataccaaaattcagtaaaggcagttcaagaaaagaaaactacataccagtatctgtcatgaacacagaagtaaaaatcctcagcaaaatattagcaaattgaatccagtaatatattaaaaagataatatattatgagccagtggaatttgtactgggaatgcatagctggttcagcatttgaaaaccaatcagccgatccactagattaacagactgaagaagaaaatccacatagtcatatcaatagatgcagaaaaagcatttggtaaaattcaaaacccaatcagattaaaagtctcataaactatgaattgaggggaacttaacctgataaaggacatgtatagtaaacctacaactaacattactagaaagggaaaaaatttgcagatgatatgattctgtgtgtagaattcaaaggaatctgtagacaattagaattagtagcaaggtttagaaaggttgctgatataaaatcaatatacaagggactgggcgtggtggctcacgcctgtaatcccagcactttgggaggccgaggcaggcggatcatgaggtcaggagatcgagaccatcctgactaacacggtgaaaccccgtctctactaaaaatacaaaaaaattagccgggcctggtggtgggcgcctgtagtcccagctacttgggaggctgaggcaggagaatggcttggacccgggaggtggagcttgcagtgagccaagatcgcgccactgccctccagcctgggcgacagagcaagactccatctcaaaaaaaaaaaaaatcaatatacgaaaatcaattctatttacaagccacaagcagaaaataaaacttttaaagggtaccatacataacaccacttgcaacaccataatattataaagtgttcttgcacacacacaaaacaaaactggatctgattaggcctctaggttttattacctatttgcaggaaatacaaaggacagagagacatactaaagataccacagggacacagtcagaaaaatccagactctacagaaactaaaggacaaactagtttctacaacaaacaaattgtaagaaaagaaaaaggagggagagggaacctatagattttaaagggatttcagaagaaaactgtactcttggatttgttccaaaataatctatgataaggtggtataaataaagccaggcgcagtggctcacacttgtaatcccagcactttgggaggacgagacgggcggatcacctgaggtcaggagttcgagaccagcctggccaacgtggcaaaaccccatctctactaaaaatacaaaaaaaattagctgagcgtggtggcgggtgcctgtaatcacagctacttggaaggccaagacaggagaatcgctggaacccgggaggcggaggttgcagtgagccgagatcgtgccactgcactccagcctgggcaacagagtgagactctgtctcaaaaataaataaataaataataaaaaaataaaataagctatgactaataattgtcaaagcagggttgtagatagctgggtttcattacactatatccttgtatgtgtttgaaagttttagtgttacaaagtgtttcttaaaataccatttacaaagcctttattaaaaaatgaccaggcgtggtgactcatgcctgtaatccctgcactttgggaggccgaggtgggcggatcacttgaggccaggagttcaagaccagcctggccaacatggcaaaaccccgtctctactaaaaggaaaaaaaaatacaaaaattagctgggtgtagtggcgcacacctgtagtcccagctactcaagaggctgaggcatgagaatatgtcaatcctgaaaggtggaggttgcagtgagccaagattgtgccactgcactacagcctgggcaacagagagagactctgtcttaaaaaataaaataacctaggaataaatctaacaaagatgtcaagacatttacagaataaattataaaatttattgagaccgggtacagtggctcatgcctgtaatcccagtacttttggaggccaaggcaggcggatcacttgagcccagaagtttgagactgtcctgggtaacatagcaaggtccagtctctacaaaaatacaaaaattaggccaggctccgtggctcacacctgtaatctcagcactttgggaggctaaggcaggcggatcacctgaggtcaggagtttgagaccagcctggccaacatggcaaatccccatctctactaaaaatataaaaaattagctgggcgtggtggcaggcacccgtaatcccagctacttgggaggctgaggcagggagaatcacttgaacctgggaggacggaggtttcagtgagctgagatcgcaccattacactccagcctgggcaacagagcgacactctgtctcaagaaaaaaaaaatgggtgacatgcacctgtagtccgctacttaggaagctgaggcggaaggatcacttgcacccaggaggtcaagatgacagtgagccaagattgcaccaccgcattccagcctgggtgacagagtaagacttcgtctcggcgggggtggggggggaattatatctcgagacatttaaaaagatataagtaaatggagagacatactgtgtttaaggactggaagactcaatattgcagggatgtctattcttcctagatagatttcatagataagatgcaatcccaacagttttgaaattgacaagctaagtttaaagtctacatggaaatgcacaaggtcgggaatagccaaaatgctcttgaagaacaaggaaggaggtcttgctctaccagataccaagacttattataaagctatagtaaacaagataataaggtatgggtttagagatgctcaaatagaccagaaaggaatagagaacctgaaaacactctcatacgtaaatggacacttgatgtgtgacagaaatagcactgcacagcaatgaggaatggacaggcttttaaataatgtaggacaattgggtatccattaggaagaaaaaaggaattggacccctcctttacaccataagcaaaaatcagttctaggccgggcgcagtggctcacgcctgtaatcccagcattttgggagaccaaggcaggtggatcacacgaagcaggagttcaagaccagcctggccgacatggtgaaaccccatttctactaaaaaaatacaaaaattagccaggcatggtggcacacacctgtaatcccagctactcaggaggctgaggcatgagaattgcttgaacctgggaagcagaggttacagtgagccgagattgcaccactgcactccagcctgggcatcacaaggagaatctgtctcaaaaacaaaaaaaaaacagcagtactagtacattaatacccaaaatgtaaaagacaaaactataaactttgagaaggtaatattggagaatatcttctgggacaaggaaggatttctttttatttttatttattttttatttctctaaagtcagggtctctgtctcccaggctggagtgcagtggtgtagtcttggctcactgcagcctggaactgctggactcaagtcatcctcctgcttcagccttcctagtagctgggactacaggcacgtaacatcacacccaatcacacccagctaatttttttttgtttgttttttgttttttgtttttttttgtagagatagggtcttgttatgttgctcaggctggtctcaaactcctggcctcaagtgagcctccctccttggcctcccaaagtgttgggaaatcccctgctaaggatttcatttttgttttttttttttttttttttttagacaaggtctcgctcggttgcccaggctagagtgcactggcataatctcaaatcactgcaacctccacctctcaggctcaagtaattatcctgtctcagcatccggagtagctgggactacaggcacatgccaccacacccagctactttttgtattttcagtagagatgggatttcgccctgttgcccaggctcgtgtgaactcctgagctcaagtcatccacccgcctcagcctcccagagtgctgggattacaggcgtgagccatcgcacctggctgaggatttcttaagatatcaaaaatacttcccattaaagaaaagactgataaatttgactaaattaaaactaataagttgtgttcatcaattgataccataaagagagcaaaaaggcaaaccacagagtagaagaagatatctgcaacacgtatattaataactaacaaaagcataatatctagactatataaagaatttctacaaatctatgagaaaaagacaactgaacagaggaacggtcaaaagacttgaacagacacttaacgaaagaggaaattcagtagccattaaacatatgaaaaaatgatcagtcttactaatgagtgaaacgtaaactaaaatgtaaattaaaaacacagtggtattccattattcatccaccatgatggctaaagttaaagacagataataccaagtgttgccaaggaaatggaacaataggaatgttcatacactgctggtaggagtgtaaatcagtacaatgtcattgtaaagcaacctgccatttacaatagcaccatatggcattctgatcgtgattttggactcttatatgtgactcacttggggacccttggttggcccccatgagcaaaatcattaggagagcaaagtcttctgtggcaatattctgaaaggcaagtatttgtttagactgaacctgaaagagcaactttttaatatcatctttatgttaccaatgctggatattatagatcaaaattataatttcctgattgtggttataactgtgaatttaatcagagcacactttttatatcttatcttagaatctccatgtagcagtagtgccatttgttaagcatatactgtgtgcctggtactgtactagggacattatttacattttttgttctaaacctttacaatagccatccaaaaggctccaaaagtttaaagacactgcggatagaatattctggctaagatcatgagctctggtgccagaccttccccactctttcacttattagctgtgtgatttggggcaaattgcttaacctttcattctttcaatcccctcatctgtaaaatggtgatgcaattccctgtgttgttagaaagattaaaggagttaatacatgtaaagttcctaggaaagtgtctaacattaagtgctcagtaccagctaacaagtgacaaagccagaattcaaaccaggcctgtgttgaaacattctactgtatctcatggccacatgtttaggcatctaatctgagttgtcagtatatgttcaaggaataccatgccattttaatataagcctatattttaaaaacatttctaggaaattgtcatgaaaaccaaagaatagcctttgtccaaattttttaaaagattaggatgagtatggttatgctgttttatataaattcttcaaatggatgactcttctattttatcaaccagaattataaattcattttattttatttttctttttgtatgtgctaggcgagtagcttgcattgccatggagaagaccaaacaggagcagcaggccagctgtacttggtttggcaagaaaaagaagcagtacaaagataaatatttggcaaagcacaatgcaggtagggaaaagcacaactgttactgaggctgggttaagcatctccaagacctaaaaagatgtaatattttaattcagtcttcagtgttctctatccaaaaaattctaccatatgagatcttcatcaactttcaaaacctttaagaaacccctacctccaattaatatgttgattatttgctagatattttacagagctatactttataggacaaaaatgttattttgaaatagtatcctctggaatgaaaagaatccaacacgttaagtcctcccctgagaaatgaaagcttgagagtttgctgagtagccaggattcttatctatccttggctgggattggtcttgaacagatctcctcccgcctggctcctgcctggcccttgggcgtggccctgagataaacatctgagggtagaggtgtgctcttatcagagaactgtgccacaaatggttctgtggttggtttgagagagtacaaatgacatggacactaacttggttttgtccatttctgtgagtcgtcttcttccctcatggtatttccaagctaccacaagagcaagaatcttatcttggccttccctttatagtatgtatgtttgcccatatggaagtttgtattcaacttaagtcaaaatgttcacttgtcttgttgaaaactggaattaataccaaaaaggcatgatctgttgttgcaatagaatccccagaagattcacagggtgcaacttaagctaaagaaaatgcatggtgatacacaggagtgctaatacaagaagttattttcaataacttcttaatacaactccttttataaggaactttttctgaggaattgaaagtcctgactggcattaggttagttcccaaggtttcagaaataactccaaaaattagaaatgtggcccaaaaaatcaagtgaatctagtcatgcatacccagattgatggcataatgtttctgacaagtatgaaatgcatttttctctgtaaatgttataacgtactctgaattgttcatttctcaatcagagattaaaagtaaacatttcaaactgctgtataatgtggaatgaatgtgagtggccacatgggttaagtttaaatggctcagttaaataaggaatcattcccttcgcattagttacattgtaccacatttttatttccaaaaacagtgtaatttctggttatgtactactacagagcagtagtttcataatggcttttttggttttatgaagggaagaaataaagcagactagttacacaaaatgtagcaactgttaagcaaatgctcaagtatactatttgaagaaatgcactgcagagccaggcacggtggtggtgcctgtaatcccagctacttaggaggctgaggcaggaagattgcttgagcccaggagttcgaggccagcctgggcaacagcaataccctgtctatacaaaataaaaataaactaaatagaaatgcacagcagtatcagcagaatgttgcttcacacaaaacgtcagtggttattaccaagtctccttagttgcccttacttctgtcagcttctaacagtctaacacaatctaataggctcacaaggagatgtgttgacatataaattgagaaatgtatgcatctcaccttgtaatttgtacagcagtgttaaatgatacatagatatagatgggattgaaattaacttacacctagaaaagcaaagaaatggctggttcaggctgtcagtttatcattagatttatgctgtactaatagaggtcatgtaaacatgagtattcagtttgccagtattctttaattcagctctgaggaaagtaagaaattcattgaaaaactagaattctctaaatgctgtcaaagagtcaatttaatcattaatttaagaattttgccagagaatcagcatccgatctggcagccagtgttttcactttttccactctttcaccaccagggtatcactgatcttcttccattgctcccattctctgattcccgttagatggtgcacagtggtcctgcaaacacacctgtaagcttaataggcagctggagataggaccaggaattagcacacctgagtaaccgtgcaatttgggcaaatcacttcgctcctacgggccttgaaatgagggaattaggttagtcaatcaaggagatcttttctaattctaaagatcagtgggtctcaggttctttcatcactgggcctgacaaatggcgatcattcaatgaagccaagtattcttgtactgtctatctcaggctcttgctctctggtagacattgcctatccaggttgaaagctatcacccttgacatagaaggcaggagcctaataggggtagaacagaattgctttttcctctgtcttttgacatttacctcctatcccaaaccattgacctctcttaagttcttgtcaacttagaatgaagaaaggaggggttgagaggacaggggagcctactgccaccacctgtttggtatcatcagtattttcctaaccagcggccgtctgggcatcagaaccttccttgccatgcttaaggggttgttctacatgtcagtgtgtgtcactgtgtataaggccctcctttgaaagaaagtctgagcttcttagatggtccttgcagagccccttaagtgtctttgtagaactttgtgtttaggcctatttgtgattctctagtcaggatatcattgttaggcttccctcacctgcaaaataatcactgtgagctctctttttagtttctctttttgggagaagattcccagcttttttccttgactttctgaaatacactgcctgcaaagcctagcattcctttctgtcaccatctcttcaggtttcttctgtgtcatcaaccaactcttccattttgttcattagaaagtccagaagaaccatttgcttagtattacctttgctttacaagagatcatagggtcaagtatttaatcagctgttctgcttttagctacgatgaaaggtcatcccaatatacagaagtgtccttataaagaattgctctaaaagagtgagaaacaaatactcttgacttccattggtgaggcagttgctttgagaacttagaaatatcatagcctttcataccaaaccagatgggctcatgggccacagatcaaacaatatctcaaaaggatttttctggcttttttagaagttgatggtaaaatacagtactctgttcttctgttactactcagtaaattaaaataagggctgtatgttttgtttcctgcttcaaatctttgagaattcatcatatattgatggcaagatccaaaccttatcaagttctgacattatttgtatttgtggtacaaatgaaggttgggaattttgtcattatctagaactggtgggaatgataatactagaattatttccatttttgtcgttaggaaattctacatagcttgttaaagtggaattctgttcaaactgtgttacctacaactcccatcataaagtgacagcctattcgctgaatttgacccataagtaaattttgtccctctaactcccacacacacagtgtttaagttttaataagtcatcacgtgtgaaagtcaggatatttaacataaaaatttgggtttcagagttcccttagaagaacaaggaatgcagcaataccaggtccactttctcttttagtaactctgggtggttaatatggcctttgaatggacgctcattctccagcacacactgtccgcaccactccctgtttttgcacctggcccacttcattcaaccacattagctacctgacccctgcgggcattcaagtatgtactccttaacccaatgctaccagtgtgcaatgctcttttgaattggaggtctttatagtatttgaagatcttgatagtgtttccagctgagacaaggattcaatgttaatggcttttttatggaaaaaattcaacctggaaagtagttacataaatacttaaaagaagtgtctggaatgttgagtagtttagcagaaaatcagggtaatatgagcaaactatgctagacagtatttctgaatccttgggaatagatttgattatggtgtgtgtagcttttacagcaaatacattttctgtaacatacagaaggtttctagccatgtatacttggtacaaaaagcattgtggtgtggctggaacaactgaactctagaggcattgagattcctcagcccccaggacttccaaaagtcattttagatcaagttactagtgtaaactttttaaaaatgtaggaagtcttcattaatttggtttcttaaatgttagagccccgaaatactctatttacatacacatatttgaacataggggatttctacagtaccattcataggtgtgcttaaattatgcttaataccacaaattagtactattgactttaaaagctattcttttttttctggaatacaagcaactctaaaggaaacaaaaagtagcccataaactcactgccctgttggcattaaaaataataataggctgtgcgcagcggctcatgcctgtaatcccagcaccttgggaggccgaggtgggcagatcacttgaggccaggagttcgagaccagcctggccaacatggcaaaaccccatctctactaaaaatacaaaaattagctgggtgtggtggcacacgcctgtaatcccagctacttgggaggctgaggcaggagaatcacttgaacccgggaggtccgcggaggctgcagtgagccaagatcccaccactgcactccagcctgggtgaaggagcgagaccctgtctcaataataataataataataataataataataataataataaaagtaataggcacacatggttagaaattacacatggtacaggaaggtacaaagtgaaaagcaaaaggcttccacgtctacactctctgaagaggttttcttgtaactattctcgataaaatgtctatgcatatgctagtatataaaatccgctggcttttatataaggatattgtcgaatttctattaaaatgagtttgtttcttaatgtgatttatttgccttgtgtttagaatattgcatgataaagtttattttatacatattatacttttattttactaatatatgaaaagccatatttcaatgacccctgtacatttttcatgctgtctcactcccaatggcctctgtgcatgtaagtaacctgttgaatgactatgcctctgtgtttttggtggttttcttttattaagtcctttttttaatcagcaagcaacttaaaacctttaaaagctcattctttaagtgctttcctaatattatttgtatctcttattttaaaataccctttttttattgtttctcaaccctatgaccgtgtggcaatttcatttagaccagagtaacctcttcatgctgctcatttatggttaagatattgatgtttaacatatctgtttcatttcattttcataacatgtctgtttgtggttttgatggttgacatctaactcattcttatgtgttttttaaaaaaatgacaagtcttaatttggtaggatcacagttagggctctatagagggataggtgtgtgtatataccattcggaaagcttgtgtcatcatcatcatcttgctcttttgtgagatgcttgcttatttttattaaaatatattaaaacatatctgcttgtcaatgcacttcttctgtaagcatactttttcttgatggaaatatcactcagagggcaataggtctaaaaaataatgccatcagcactcctgcttttatttttgcaactctcatcactccattactactgcagtataactaactagccctaccacagagagcctcatgttcattttaattttgtgagtctgccattctgaacacagaaaacatttcttggtttttagctattgctagaggatatgctttaaagactttcaatcaacctttataaatcaagttatcaaaagaaaacaaatgtgcaaaaacccattaatatacactaacctctattttaatatatcgtgtttctttttttatatattgtgataatggtgctttttgtttgtttgtttctgttctattctattcccaagtatcttattttgcattttaagtgattgggcaaatcactaatgttaagaactaaggtgatattcacagtcatttggccatagtgtttctaggagtagaaggttctcttaataaatgattggctaaagtaatgcagatttcggccgggcacgatggctcacacctgtaatcccaacacttcgggaggccaaggccagtgaatcacctgaggtcaggagttcaagaccagcctggccaacatggtgaaaccccatctcaacaaaaatacaaaaattgtctgggcgtaatggcaggtgcctgtaactcaggaagctgaggcaggagaatcgcttgaacctgggaggcagaggttgcagtgagccgagatcgcgccactgcactccagcctgggtggcacagcgagagtccatctcataaataaataaataaataaataataaagcagcccagattcctttattacatcatcaaatcaattttactgaatttattttaacccctctaaaatccagggtttattcaatattctttaaaaaaagaaatgtcagtatgtaactgacagcatttgggtatgaccatacaaaaaatattacaggaaacacagacatacaattttagccctttgtgagaatttccaaatgtgtgtgagaattggaccatgttgaatttcaacaggaatgggcatctgctcaggaaagttttgtacattgcttgaaattgcttttatcatagtgttaagaggcaggtttcagaaaaatatttgttaaagtatttctcctcagtctgtagtgattagagaactccacttttgcaaaggtttctgagctcagactctgcttcatgattctttccatcctgatccaccatacacaggctgcccatgtaatgggcgacaagttttcaggcccaggaaagcatgtaactctccttacatattcaagactttccattgagtggatatctgggttacagtaaagcttgtgagatgctcattgataagcttgtgcaatagttacagaacttgccttagaatctagcatgccaccttcatcaactctgttgaaagaaagaaccatgaagttaaagaccagctgtccatgcatttctcatccatctctagaaatgatctagctggcccctctcctggttaactttagttgcattcatgctatattcatgttggtcactgtctgtagactttttctttttagtattgctgacttcttagaattggaaaaatatgaacagcatgtggtttcaaattaattcatatgatttgttggatactacatgaaaagatatgtagtatcttttagatttggacattttaatgcatgtgttcagcatctttggatgcccctggttctaaagagcattttcatgggcttaaaaatgaaaatttctccctagatgctatatgacttaaattacatgtaagccatatatcataagttggattcatatttttaagacatggttttaatataactgtagttttgccagtaaaattataatttatgtacatgaaatagtcattctacaaatttacctttcttctaaatctttgcgttttagtgtttgatcaattagatcttgtcacatatgaagaagtagtaaaactgccagcattcaagaggaaaacactagtcttattaggtaagtttgattgtgtaagtgagttgcttattctcactttcaaaacattttgtgaacattattaagagttgtcagttttaacattctttttttctaaatgacataggcgcacatggtgttgggagaagacacataaaaaacactctcatcacaaagcacccagaccggtttgcgtaccctattccacgtaagcaatgtctcaatctcttttcattatatttttcctatcacttttttaactctataatttatgtatttttttctgattacataaggtataactgttcattgtaggaaatttgtaaaatcaaaaaaagaacaaggaggaaaatgagttaacagtaatcccaacccctctttccctataataagtgctataaatattttgttgtatacccttctaggcttctctgttgtatacccttctaggcttgtcttagtacagatatgtgtataaagtgtgtgtgtgtgtgtgtgtgtgtgtgtgtgtgtgtgtgtgttttaaataaaattagttttatccattctgtttgtaacaatttttctaacaatatgtcatacacattacctagatgaattattcttcagaaaaataagttttcatagttgtacagtttctgatatgacaatttttttcccttagttaatatttaaattgttgatttcttaccactttttaaacccaatcaatatgctaacagttgtttctgtaaagattttcaaatctgtaagatttttaattctccttattttccgtatcttattcttaacctcttgccctcttcattttctcaattgtaaaatgaagtaattcaggattgcagagaggatttgagatcatgtgtatgaagcacttagcagatggtggataagtagaagctatctaccactatcatttcattattatcatcattattctaaagtttaaaattttaggccaggcgcggtggctcatgcctgtaattccagcactttgggaggctgaggtgggcgaatcacctgaggtcgggagtttgagaccagcctgaccaacatggagaaaccccgtctctactaaaaatacaaaattagctaggcatagtggtgcatgcctgtaatcccagctactcagcaggctgaagcaggagaatcagttgaatccggaggtggaggttgtggtgagccgagatcgtgccattgcactccagcctgggcaacaagagtgaaactccgtctcaaaaaaaaataaataaaattttaaccccagaagctttctagcagctcagggttggaagagctaaaggaaaattattttttaagagcaacaggagaaaatgtgaagattggctccattctatagggccttcacatgccttcctgaagcaatgtcaataccacttacagttatctgtacacctcagagagccaggaggcttcatgagaaaaccttcatcccaaaaccttgtctgatttacacaagaaaagaaatgtatccaatagtgtctcatttggcactactggggttttctagtaaaacactttgaagtgttcttttaattctccttatgtctagatcatgagtacagcaagcttagctaacatttagcttcttcttaaccacgtaacaactgaacttccatgttattaaatggccagttaactagtttggttttaaaacttacctttgatgatgtcaatcatgactagtctttgaaatatttgaccctgtatgtgtatataacatatatctaactactgagatgactgaagatagtacaacatcaatatgttatgtaagttcttggctgggcgcggtggctcacacctataatcccagcactttgggaggccgagatgggtggatcacatgagaccaggagtttgagaccagcctggccaatgtggtgaaaccccatctctactaaaaatacaaaagttagccgggcatggtggcacacacctgtagtcccagctattagggtggctgaggcatgaaaatcgcttggaacccgggagctggaagttgcagtgagctgagatcttgctactgcactccagcctgggcaacagagtgagaccctgtctcaataaataaataaatagtaacgccggttcttcagcttttgatgtgcctagagaaagggcttctcttaaaatgtccacattttgatgaccacgagcactttatgttctaacaaacaggctagcaggaaagggggattccccattagtttaggctcatgtatacagaagagagtagcataaatttgttctttctcaaagaaagaaggaagcaaagaaattgagagagagagggaaaaaaagggaaggaagggagaaaagaaaggggggtagggagagagaatattaaaaccagtgttcctggctcatctagaaaaacatttcctaaagtgtgttttgcaggatactggtcctattagtatccacagaactagagcttattggcatatacttcagttacactcacttaggtgaggggtgggcaagccttttctgtaaaggaccagatagtacacatttgaggctttaaggccatacagtctatcacaagcacttagctctgctgttgtctcatgaaaacaaccataggcaatatgtaaacaaaagcacatggctgtgttccagtaaaactttgtttacaaaaacagacagtaggtggccaggtgcagtggctcacacctgtaatcccagcactttgggagactgaggcgggcagatcacctgaggtcaggagtttgagaccagtctggccaacatggtgaaaccccgtctctgttggaaatacaaaaaatagctgggcatggtggtacacgcctataatcccagctgctcaggaggctgagggcacaagaatctcttgaacccaggaggtggaagttgcagtgagctgagatcgcaccactgcactccagcctgggctacagagtgggactctgtctccaaaataaaaaaataaaaataaaaaaagacagtagaccatgtttggcccataagccagtttgtcacctcctgatttaggtcttccataataattatgggtatgtctggccacagtcattgtgttttcagtgtaacgtgtcttttgctgtatcctaacattctccttttgcaagatgttatagaacatcacttttcaatagaactttctgtgacaatgacagtacttgatgtctgtgcagtccagtacagtggccactaaccatacgtggttattgaatccttgaaatgccactagtgagactgagaaactaaaatttgaattttatttaattttggcttatttaaatttaaccatatgcagttttccatttttttattctccttttttccttctacacaagacccaactgcattaaggcatacagtgagttatattaatcttgggtcatttcacgtcttcctcctgtggtggttcatgaagggataaaatacatctcacctgaacactgaaagtttcaccaaaccagacaattcactggctactatggtgtgatgcacacagataaatatggtttctagaatttagttctgcaaagccactgggggtgagaacaggggatatgagatatacgctaaagaatccacagcttttaggaagagactgggtttgagtaaatctgttgggagtgtagtaagctcatcagctcagccttttaaacctcttgtgccatgcgactttgcagatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggtaatgcccagcctccccgaatgtctgacatcctgcctgcatgccaataagcacagattctgaaatcaaaaatgccatcagaaagtcacaggtcacataataatttcataaaccacagaaaagtatcagtaatggaggcgttgggggttcacagtctagaatgccagctgactaatcgttggactcagtgcacacaccatgtatttaagaagcagagattattctcttaagaggtttattatatgcagaagctcagtaaggttcctgattgtgtctacgcctgccagaaatcctacgatcatctgacctcaggatgaggctctggcactttgttatcacaacagccaccttccctctctgggtacagctcacgctggaccatcagagcctctaccagcacattatgttaatctccagtgagaaactgatcctggggcctgggtctgaaacacagcactagctttatgaaagcaagcatgagtgagcccagatgtcagagacagcagggatggaaacccatggtggctctcagcctctgccatttccttacctgagcacaatgcctgaccctgagcaaaaactaggagagagataaagacttggaagaggactcaaaagagagccagacacagagatgatgaaatggtttctagatatgtcttgcagtaggaattattaaacttgaaaaagagaaagctgaaggctttacatcaaaaatgctgacaagctgttttttcatctctgagtacaaaccaagtagatatgggaggcaaagtatagtaggaaggatttgggagttgtagacatcaaggtgggttataggagaggcttgtgggtgccatgtgactcctgggtctgccatttctaggactgatctgtaccaaatctcctttaacccttagaaatagaaccagtatgctacctgctgaaatagtagaccagcttccctcaagcaggctgtgtttcatcaggaggcttacctggctatcttaggcagggcgaatccctgttcaagggccactgtatgagacttggtcccctaaccatccctaaagcaaggacagaacctatatagccagagtctgtgtgacctgggacctgacagctcagtttctgggctccaggatcctaattcgtggccagtgggttcacccatttccgtttacaacacctgatggggttcttgaacttggaactttggaaaccacaaaaggatctgttcaaggggctagggaggaaagcagcagtagggtgaacactgccgtttacttaacaattaacttggacctatatagaactaaatatatgatgtgtaccacagattgatttttgtttaactactaatccctccttactagggattggaaaaatcttctggccaggggtggctagaggcaaagtctcaatcctggtcctggtcttcgacatcctctccttgggttccacactggtcttcacctgaacgtcgttttctgctggtagtaatgtctctagcagtatgctggctgcagggctcctcagactccctctgcattacctaagtccactttcgagggctttctgccttacctgcctccgctgctgccgccgccaccgccactgctgctgctgccgctgctgctgctgctccacccatagcgtccagctctccctttctccttgcccttgcacagccatgcattgctctgcactgctgagtgggagacacttctctcagcctcctcaggacacccacagcagttacttttacccattgcacttggccccaaagcacctcctcaccccggctgggcactctcctctgctcccctgagtgctggatgagctcacctgcactcttctctcctgcttcctgggtccctgcctctcagaactgtgatctctcagatccacctagccctgagggccggccataggcatcctggctgcctgagtctctttgggccagcggccctggggatagggattgcccaggtcctgctcctcctgttggtctggttgactacactggtcccaggccctcctgcgcaggccagcctcatgccagtcctggtctcacaatgaccattgcataccacagtacagctgagaatgcccgcagtctgcaccgactgggcttcactctcgggcttctctgccctcagcccagtctctcctcagctggacaaggccttcatcctgccttcaggatacccgtgaccatgaacaacttgctttcaggcagagcctcactgctccagggaggctctctccttaggacatttttctccatccccctttcccactccagcttcttagatgacccctctactgtatcttacagacaatttaatccaacaaacttgtattaagcccttattatatgtcaagcacagggtcaggagctaagaatacaattcagaagacaagatggtgaggatgaaattccttcctcattgtacatccaaaactgtccataacagaagggccttgtggcattttttagaatcctctcacttctgccaaactacatgtggaccataggaaaaccacctaacacatgtccagctcttttagtacaggtctaatactttatgccatcttatttcagacaactgaggcccaattgagcacgtctaataatactatatgataagatgttgtggtccaactttaaagctagaggatgatggtaaagacattaaactagaaagaaattaataacctagcttctcataaaatagtaatagattatgttcttatagtgctgtatattttgccaggcgttatgactccttacctaatccttgtaaccctatgagctggagatcagtatctagttttgtagatggagaaaccaaggcttaacataattgtgactcgattaaggctttacagccaattgaaagtgaggtgtgaagttgaactgtgttgatttttaaatttttattcttttacagtaaatccccacttcctttcactgtaccaccctagaagaggtaaccctgggaatccttaagatggttcaccttatccatagtagtacaatgtaaagcctcattttttcttaacattcagaaaaatctgtaattcagtcaaacctaagaaaagctgtagaatttatttctcatgaaaataaagctatggctcagaaaataatctgtgcccctaaagctgaaactgtaatagccccagtgtgtaatcagagcttaatgtgatggttttagattttaactttattctgatgtatccatttgtagcatgaaaaagttaatagtagcagaatatttgtagttttgcttttgcccacagcggaagaggtcatcatcaagaggcagcatacagtcttgttaggaatccatactttaaaacaagagccaggttctgaaccagagactattttgtgaaatcagttatctctcttgagatgggttctggggtcactgcactcttcctaaacccttagatttttgtacaaaatgactcagatgcttgcctctgtgtgccttttaagtttgcaaaccagaatagatatctgcctcttatacacttgggtcaaatgagtttctattccttgaggataataacctgagattaattattggccatagccaagccatagaatcaatttatctccacaaatgttagattaatgttactttgactatctgaatctagcatgctttcagtgatctttctagagcgtgctctttctctccctgtccatatctgtccctgtttctctctctctctctacacacacacacactctctctctctctctgtctctctctctgcctctccccctctctctcactctctgtctctctctctgtccccgtctctctctccgaatcccagagagattcggagagaaatatttgcccatgaacattaaaaaatgtgtgcctcatcctgagtcagaaaggaagagggtttagagttcatctttaagtcacctattaactgcctgagagaggggaatccttgtgagcaattccatttcctgtccctgaagtaactctgaacctcagccaggctaccacagcaccaaaagtggcacccacttgagacccgtaagtagtgcagagtatggcccaaagaccttcaagaacaagcgaggaaatgtgtggtgagtctgctgaaaatatgaggctgactagacaggaaaatctcaatcaggatttgaggcatcttagaatttttgaaagtacaataataaagtatagaaatagaaaaagctacaaaaaggaggagaaagcaaatatgctaaccacagggctactttagttactgtgataaacattaaatttggctctgaacttcctgacaaccagggcaaaaaaaaggaaatcaaggaatataacctgattcgtagacataagaggcatttggcaatgtgaggaacatggccaccattgatggttttatgcagtgagtgcagtctatggatatagaccaagggtgtgaatgcagtgcagagatgggcaatctgcaggaagctaaactaatgttccaagcagtttgttttctgctgttgtaatgtgatagctggaatggaaaacatgataaggactgggtagctggcaggctgggccactgagtgcagaaaaaaaccatttcatgcccagggtgtcattctctacttcatctgtgggttccgttcagcatccaggctgggtggacttccatctagcacttagagtagctttggggatagaagcaaataggattctttcccatctcagttgcccagaagcaggctatgggatgggtatatgtgtgtgaccgggagtaggggtgatgagaaaaccttgtctcagctgaccctgtattcacctgatctatgagcataggaaggaaggaaaaaaggcctaagataatactgacataaaggatatttctaagtgaagatccctgttagcttgcttgagctatatatggactttgtcataatgtttgttcctggcttaagtcttcagccacaaaaggattggcaaagaaattgccagttacctctttcaaaaattaacatatgcaagcttaaagagctttcttaccagaagaatcagagcctaggactttaagagttaaaaaactttgatggataaatacaatgtaccagtctccctcaacccacaagaagatgctgtgtgactaaaattcagaaatataatcctagtgaaagccaaccttgcactaaaaaaagaaagaacctttcatgtcaaatttgtctcttacatgcctgtatacacaaagaggctaagagagtcccttcagccaagagagtagagtgctctgtagatgaacctgccttaaaagacaagataaattctgtgcaaattatatctactatttttacattttaattttttcataagggcagtttatgctgggtgccatattgggcatgagtgagatagctgaacaagacacagtccctcccttcaaggagggtacccgctagtccctggggtcttgggtttcccacgtgatgggtacttcaggagcacatgggagggtctcagagctcacaaaggacttcccaaagaaaagagcatcagtactgagttctgaaggattactcagccaagcaaaagagtgagtggggaaggggaagagaggatgggaggttcaggcagagggagtagtaaatcaaaaggccaggaagccagagagagtctggccctttctggaactgaaagtagttcaggaaggctggtccatggagccaaaggagcagagagaaaggctgaagaggttaagcataggcatgcttgtgagggagagaggtgacattcatgctgaggagtatacattttatcctgaggccaagagggaactgttgaattctgagcaggggagccatgggttttgaatttcagaaagatcattccagtagcagggtagagtatggattggaaagcagcaaaaccagaggcagggcaaccagtctaattactattacaataagctgggcaaaagatggagcaataggaatagcgtgaagcaagcaaatttaaagaccatttagagagcaaaatatgtggggagcaggatagttaaattcttgtgtaagtgacagcaagatatttaccccagcgcatatgaattaatcacatgtcagtcacttgtgaattgggtacctgtatgtgttgggttttgttccttggaagggagtttgtaacctccaagataatcatatcctcctggggaggagctgaaacagtaatcccttagcagaatcaactcccacagcgtctgactgcagcgttgcagtatatctatccaaactagtagctggcatttagaggttttcaatgccttagaagggaactgaaagggatctcagaggcccttctgtcttgagtgcagcattttctcatgggcctatacattgcccacagccacacagtgtctttagcgacaggactaagacacaaagtctagggctcctaactccagccctgggcaaggttcccccttccccaggagtcccagggggcttttctgcagagcaacacacagttacagtggacagatttgctagcaatccttggctagcaatttgaaatttgaaatgtgagggagtggcctccagattagtggtaaaaccagccggcaggtccaagtctccccttaaatgcatttcctgttgattaaaattcaggctaaaactaatagccaggtttaaatgaacattaaccaacataatcagtgttaacttttatgaagaaaaatagattgattcatgagtcataagaaaaatgtccagtttgccaacttttattttctgatggctattgtccatcctttagaaaaaaagtaatataagttatgtataaagttggtaaatttaataataccttgccaaaaatttgagccaagagcttggaattttcagttgtataaaaatttttatagactcatttgaaagttacattagttatttcttcttttaagtcgggattttttttttttttcttaacacaggcactgaaggtcctgagaactgcagagtttgctccttttgttgttttcattgctgcaccaactattactccaggtttaaatgaggtaagaatcaatctgtttttccccaaataagctgtaaggatcaagccttactccccagcacagtcagaagcgtgtcagtctacatttgcagcaaggctgctctgatgaaatgggatgtggaatagaatgctacatgggacagtcttatcagtaagctgacttctaaaatctgaggacaaacaccctcactcccaccaggaccgaggcatcccaggtgtctcacaacctccagggctgccagcctattccctctccggatagggattgtgtggcccctggagtggaacctttgtggaatttctctccaggcccctgaagactaccaaacctagaaatcagctctgtccactgtcaagccagctcaagtcagaaactgccacagacatggtgctcatgagacttggctgctgacttagaaggttttccattgctgagcagatcaaagggtacttaccatgtgtctgctaagtgtagcagtgcctatcttctgtaggttccttagttaaggggagactcttataccaagttatcctgaagaccattgctttcacagcttctagaaatcatcagaggactcttgattgactctgttcagtcaacactgacctaaactcactcaagcttaaaatctaattaaatcatggcttggaaattttccctttgtgtacctttaaggaagattcaggattttgatttacctatgttactcatattttccgtcattatgtttttgtcatttcatctgcaagaggtatattcctttgtaaaattctaccttcccatcttatttaatacataagcatgtttgaaactccacattgtggttagcttttatccttcagttgccatgtatttttcttgaatcatcatctttgctttgtttttgttttgcctgttttcctgcccttttactaattttccatagctgccaaaatggtgcagaaaattgcctgtaagtaccagctaggaggtggtgaaatacagccgtgtttcttttaatagatttagaatgtagacactttgttcccacaaatccttgcttttgctgttagaataaaggcattttgttttcactgagttaaaccctgctcacgtgtgagtcaagcacacagacaagctgttgtcgaggaagagactgacaaatatagcttcgtcttaaaagattcttaagagggagctttatttttctgtaaagagacctacattaaaaatgtgatactttcagccataaattttcttgaatattttcatcagcccagcttgctgagcaaatcataaaccctgctagtggtttttgaagctcaggactatatattcaaatagaatcccgtgtgccagagagtgatgttgtaggaattgttccttttcatcctggtaggaagcactcctgtctttgggtgaatgcacatttgctaaaatggcgttttttgcattgtgttgattatgaagtaaagccacagtgaaaatactatgctttttaagtgcaagccgaactagaaggtgatgattaactggggtcttatctacactgtagtacttaacactaacattcaaagcatgccctgtcctgctttgaaatgccagtaaaagaggacaaaacaggtaggacattcttggttcagagtgccctgagagaaaagattgagttcctgtctgctgtggtgtctgcgcatgcccactgcagtgccaggacagaatcaagcaagtctctttatctcacttctagtcccctttcttgagagctgtacccagagagctgaggcttgcctggacctcccagcagcctcccaggaaaggtctcttgccaataacagaggggctttagagaagaggagaggaggggaggggccctaagccagtactgggtactacggctcctaggtccttgaaggtaccgcatcttttattttctctggagatctgtctctgtcacccagggccccaatttcctggaagaattgctcagtctcttgattttagatttaatacttgtaaaaccctataatgactggcactagtcagacaagtgcttgttcttttgacagcatttattaagcacttactatgtgtaaggcactatgcctaatgctggggcacagcaattacagggcacacaagacaagtttatgccctagctggagacatagccactaatcaaataaagaggtatttcgttatctctatgtatatttaagactcagcccaagagctcacccacctagtgtttggcaggtagggggtggttaatttgactcacaaagttccctagtgtcaaggttgaacttgccctttgggagttcagcatgacaaatatgacttgcgaagatatagaggcagacttctttctggtggctcttaagagacccctgtcttgaaagaactgccactctgtagcagaagctatacttgcatgacaaagctgggaccctaaactccctcctcctgttggatccctcttacaagagttcttaaaatctgtggcaagctgcagcttagggaacatcctttgttgcagcaaacctccctagagttcagtactccctagagttctcttccttctgtttttttcataagagatatgaggacctacgaacagtgacatttgtctagccacttctaatgcagaccaatttggggggattcatcagatgccaggtgctgtttattggggaaacagccttattccagccattatttgtaacactcaaagatcttttgcctctggcatcagctgctattgagtgagggccattatatgtaattgaattcctagaacgtgtggcacctttaagtagaagaggaaaaaatacaacttaatttgtcatccaagggcagggacttgttggtgcaaacacagctgggccctgaggcctggctccagtgagtgtggaggaccaaggggacgggggcaaagagctccagccttgccaccgtagccctctcgccaattgggagagtggcttgaggctagggcggggggcttcctgctggcctgtttgggccaccatagccactgtaacccacacctggcatggccctaccaagcctgactctggggacaggcacagctaggcctgagtgggggtggcatgtttcctgaagagtatctgttttctctggttcgtctgctttgtcatggaccctctgttgcatgttgagcaatcactgtctcctctgtcatggagcggacttggcctcatgctggcatatggcatatcagggtctggccttgactgtttctgacactgggatgaacaaaaatgtgaaaagagaacgaatccaactgatttctctcttctgtttgcttttccctcctctcatgcccacccctacctccatctcatcaccatttaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataac

SEQ ID NO: 5657 - DNA, 403686 bp, human
cggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgtataattacgctggggaaaagcagggaatcagattaatcacagtgctgattgagaattaaatctgcagttcctcatctaattgtccattccttaaatctattttgaatagtttccttttcattcttgtcaaacagtactccaagtgcacaatcctgctaatttgcttgtgaaggaaatgctggcaatctgaagttgatttcctaacacagcgtgtattctgcggctttagaagttgaggagataagatttaagagcaaatttttgcttaataaggatcgctagagctaacattgaaatatcttacctctttttttttttttttttttttttggaagcggtgctttattgtctattttaaggtccacagttgggaaatgaaaccaagaccttaaagcagttggccctatctcttttaagttgtctgcagtactcaatttcaatttgagtgctaatttgtttccttttctttccatattgaggtattacagtgttgcctcacatggtgaaattgtgggtagagcttgctacacactttactcagacccaattgatgtgaggacatgttactccttgccctattgttacatgaccagccagacttaaaaggaaagtatccaaatgtgtcctgttaaagtgcttgtggaagtgttctagaacagcactgtccaaaagatatattatgagccacatttgtaatttaaaattttctagtagccacatttaataaaaacatacaggtgcaattaattttaataaaatattttatttaaccctgtagatccaaacttaacatttcaacatgtaatcaatatgaaaaaatattaatgaaatattttacatcttttatgctaagtctttgaaatcccaatgtgtattttacactaatagcacatctcaattctgacactaagctacatttctgatgaaaatcagaaatacttaatctgtatttaggtttcataaaatttgcgtttgcaaaagtatattcacatacccaagttgttcccaatatacataaaagttttccaataaccgaatcaagtacctttttctaaatttaaattttaattaattaaaattaaatacaattcaaaattcagtttcccagtcggaccagccacgtttcaggtgcccagtagccacatgtgaatagcacagttctagagagaaaaatgcatcaaaaatctccttggtttcctcattcttaggagcacccagtgaagataaattaggtgtttcccaaaagcctccaaatgactgtatgtgtgggtgaatgatgtttgttgcatcttagttatagctgatgtaaatgaactaacaaagtcataattggaaaatgtgagattaaaatgttaattatattgtgaagatgtaaaatagccatctctgaatcagttttggtaactagttctgattccttaaagtctggaagggtgatgatgtgatctctttggatatcaaaaagaaatggtcagaatcacattaacacagtccatattctgctgatttgtaattgatagaatatttttcaggaaacacccctgggagaaaaaaattcatcttttctgactgtttcagagctgcataaagaggggcagcaagctaattttgaggtgataggtactctatggctaccttaactactatgaactgtgaaatctcattcatatcctacaaaatctgacttggtcagtgccaattataaaatgccattatgtgaaataatgaattcaagctagccttattgttaaagaatgtaataatagtgttcctcaatctgagtaaaggttgaaggtttctctagtaaattgtcttagtatatattgatctggaaattgaaattagcttgagattttcttgcagggaccttgacagcatacatttttaacttataatttgttcacctctgaatttgaacagaaagcccttgaagatattcacatgtactgaaaacctttttattgatttctatccaagttctatggaattttgattttcttttttaccaaattagtatcacaagttgtttttcaccactagatcttaataggttttaatttttactaaggtactttaaaatagatttcacttttcaagactaattgactacccactcactcctctacctacgcaaccacctactcactcacccactgtgtacttggccttacttgatggcataaatgaaagttctcgtttaatttagacccttcagtgtgtttttttcccccttggttgagaaagataacttacagagttaatgaggttttgaaatataagatcattatttggaatatgttttctttccagtggttgcagcctttacccttgttaaagctgtctttgagggaacatgtgcccaatttgttacaaatattggaaggatgccgtttccctttttaaaaattaaaactcttttccctgtgtttctcatttttgaaaatcttgcagaaactcctttgagtgactgttggttctataacattttctatgtaactatcttttaaatgactgaaacaaatctccaataataagaccttatcatagtcccaaaacttcttgtcttagcaaatgtagcgattactggaaaggaagggcgttatgcaaatgaggttaatgactaatttttatgtcatgatcatttactgtatcttttacaattataagtaagtgtacaaccggtaatactacatgaaggaaatttaagacaattcatcgaaattaaaacatagaaaaatgcctactttcttggtacagcagtgtgtatgaaagggaataacaaaatacataccatttttaccttgtgttaggtgaatacttgccctgtttagtagcctgtagcttcagactttcctgctctggtaggacatacactaaaattggaatgatgcagcatgacccttgcttaaggatgacgtgcaactttgtgaggcatgctgtatttgcttactcctcgagagcacttttatttaattacagttacttatttatggatctctctagttcactaataaggagcttcctgagggcagggaatgtttcttacacatctttctccattaacacagtgcgtgcaatgtaactgcctttcattagctgtggaatgaattgagtagttttaataaaatctcattaaaaggcaaaaaagcatgtttgtcaacctcagagcaattattgtccgaagagcctgcattagtttaaagtagtggttctccacctggctgcatattagaatcatccggggagcttttaaaaaagatcaacgccagagccctgtgtcaaagcagtgaagtccgagtttctgggactgggtcctggtcactgacatttttttaaagctctctgtgtgattctaatatgcagctataatgaggaatcattggcttaaaacttagattatgtatgtaatattttgggactggcttttcagaggcttacaattcttacaaagtagaataaattctttttggaaggtattgaagctaaatggctaaaacatggattttatcttctatgcacttgtgtttctcagccttattgtgtaaaaatttagttttagcttgtgtttggctttgatttcttgggccttttaagatccacattgatttatgacactcatctaatgctaacatggcgattgtctgacgtttggaacaacacagaacaaggattgcttcaataacagttgatgatggttttccactataatggcttgatttaatatgaagaaatttatcagtttagtatggattgtgtttgtacatacactctattaaaagagtatggttaagttgcttgtatgctttaaattacatacttgtgattccagtaatgctgttagctggagaattgagttaatgcagcctttatgtaaatactggattaataatacgtaaagtatataattcagcatacagaaaaattcagctttactaatttgtactaattactatgactttcacatgtattgattcatgcagtgatttgggtttctagtaccatagggagaatttcgcattgtgttgaaaaaatgtttcccggaaattttaactagactttgtaggtaaactagtttttaatgttaggaaaagatcaagtgtttgcctgaaggaaccgagaattttccagaaatgagtagatattccagaaataccagtgatcgtgaaagcagtgcatgatcacagtgacagccaagtaacaaggtaaaagaagtgatcagcagctaaattgttggtggcccagaaagaatgcaagccatgggagttaagctgtacttctacagaggaaaatccttttgaactcagggtgtggatgctacagatagcaggcctcaatgggagtggggaagcaatattgattcctgatgatcctaggatcatttggagggagaacagagctactccgttgcttttctgcatgtatacaaccttctctagtctcttcctgtctgctttttacagattgctttagggtgtgttgtttgaagttgtcttcataaatacttcctgtggactcccttaatttttatgtccgtaacacgcttctatgtacttgacatacgcagttcagctctctccattttttccttgtatctgcaacagtttcacctgatgaactacgtctcaagtgtccctaaattgtgtacctggatatttcctttaaactgaaaattctgtctccagctgtagttctactcaataaattgaaggagcagatataccttgcttcttgagattattcttgaattattacattttcttaaacgttttcacattttaaatgtggtaggagcactgcatttaaaggaactttgacataaggttgtttaaaaaacttctataacttaaagcttactttataaagggattgacatttatccctctaatgttaggcattttggatgtattatttaatcatacccattttacagagaacactgagattcagagggggtgatcagtaattcgcctaagatcacacagattccaacgcggttccatggttttaaagtctgttcatttcatgctgcattctgctgctaattcaagttgtgaaaatactgtgttggattttcttaaagacacgtcttcattttcagagtttctatactgcaaattttagttgtttgactttctggttaaatttcttatttcttcagtagaggttccatatactattcattctttcatctgtttcttttttatttttgtctttctctttaatgaaacatcagcatttgttaccaaactaactggtaaatctagcaatggaaatatagactcttggccatctgtccaaaatataatttgttttggaactttctctacttcttttactctccaaattttttcttccatttcccttgccccaacagacaggatagttgattaattacccctaacttgccaaaccagaagtaataaggtttcagaggtagatgtttgttggaagtggggtggagtggtttccaaaggatagttattcctttatcctgtgataaaaatacggagattgttctctctgattctgaaaaccgtgtagtgagctgcagccgctgagtctgtgagcttctagctgtttgccagcactgtacaccttaaataatcaagagactgagttaactattgcagagcaggtaccggaccccagccaacaagctgatgggatgtgctgttctcacattttttggttttattttttagttgcaactgacagtgaagattctagaagcaccaaatatggctctggatttatgctgtgggatttaagatgctacagaacttgctctccttcctttctgtcctggagccactatggtattggttgtagagcccaagtcagtatagagtctctgacttctaccctgggaaaatttcatttccgaagctagtttgttttgaagttaatgtttatttccaacattgagatttaataattttgtgttacttttctttattaattagtttttatacagtaaattataaaagtaatgatgcacgtagtaaattttattttctttttttgagatggagtctcgctctgtctcccaggctggagtgcagtggcacgatcttggctcactacaacctccgcctcctgggttcaagtgattctcttgcctcagcctcccaacaagctgggattacaagcatgcaccaccgcgcctggctaatttgtgtgtgcgtgtgtgtgtgtgtgtgtgtgtgtgttttgagacggagtctcactctgtcgcccaggctggagtgcaatggcgcgatctcggcttactgcaagctccgcctcccaggttcacgccattctcctgcctcagcctcccgagtagctgggactacagacgcccggctaatttttttttttttttttgtatttctagtagagatggggtttcaccatgtaagccaggatggtcttgatctcctgacctcgtgatccacccgccttggcctcccaaagtgctgggattacaggcgtgagccaccgcgtccagcctagttttttatttttagtagagacggggtttcaccaggctggtctcgaactcctgacgtcaggtgatccacctgccttggtctcccaaagtgctgggattacaggcgtgagccactgtgcccagccatacaatttaaaatataggtgatacaaagataagtagtgagtctgtctcaattctcctaccatccatatccccattctctagaggtaaccattgttcagtttcttctccatctttctggaagctttttgtttaaaagtgagatatttgtatactatgctgaaatattgatttttcatgaataatagtatatacttgatgatcttgtcatatccatcaatgtatctgtctgtctctatctcctctttagctgctgcccagtattctgtcatatggattgttactttggctttggattgagtgcaagccaattgtaattttacattgcttgaaatgctgagctggaatttgggtgagaggtatggaatggcagtgaagatttgggagtcatctgtgtggaagtaaaactgagtgaacaagttcttgggggttgactgctctagggctcgtggtttggagtataactcatagagttagaagaatcaggataatgggctgcacagaagtttaaaagaggggggaggatcaataatgtaaaatgccaatatactctgaggactaagaacacatgtggctataacagagaaacaatttaaagcacttatcaaaatgaatattatgtttaatagtcaattcatgatgtgtctgaaaagctaggtctggcttcttttctgtggatactagtaattttatactatctctctgtaaatctatctcagaaccaacatatttagggtaaaaacaaagtagatttctttttcactctaattgtgttttgcagatttctgatgactggcttttaggtaaaatcatttggttttcctaagattatgtccttttcattcccgagcttgtgcatgactgtcaattaaatggaagcctttcatgaagtgacaaagtaagttttagatactttacatttactttaagttcttggtatgtgtcaaaccactgttattgtcttatatctttctactataggaaactgaattctttctagcctcaaggatttttgtccacgttggatgaatgtagtactgtcctcctctttcacatttcttctcccatcacctcctaactaaatttgttcattggctatttttggttgtccacatccattcacaataagaaacgattgcttcgttgtacataagccagttttttggtatctaagtgcgtgctatttcacttcagcttcttgtattctatttattactgggctgttgtacattgttttttctcccaatctttgtgatttcttttaatatactttctttcctttttgctttgtaatcattgttttgagtatttgaatcatttgcaggtaagaatgtggattgttctgtctctcatgtagtttaataatatccaaaatatactatgttcagtctgtatttcaggcttttaacacttaagttagagtattttggtatatttaaatctaggatagaagtacactgtattaccattcaactacatgcagattttaatgttttcttaaattaaaggatgatgatattcattcagttacagaggtctctctctctagtccttccatggtgtgcagattaccattatactactgctatttcatagattctaatttgtgtttttagaaaacatcatcaattcttggccttctttcttacccttggtatgtgatttcccctaaaggtatggaatgcggttgctctgtggcttgttaggcagcccccttctgatctggtaacctttgggcacagtgtggctattttctccttatttataaaaggaatgatagctgcttcacaaaccatttgtgtggattagtgaattgtaaagtgcagcataagtattttttatttctagaatgtctctgagatactcaaattacttttggcagttatgtacgtaagtttcaacaatttccaaatgtgcacattctcagtgctaaacacaggctctattacataaataatatggtgaaatgaacattcttttctaccatgtgtgtaaaattgttagtggtgctaacttttattcattgttcatttatgtattcatttctagctatgaggtcctgggcaagttagttagcctctctgaccctcagtttctttatctgtaaaatgtggttaatggtatatactttgtaaggttgttgtgaggattgaatagcatgatctatgtgaaatgtctaaaggttgttattttaattgccattgtcattattattattttttaaattttattattattatactttaagttttagggtacatgtgcacaacgtgcaggtttgttacaaatgtatacatgtgccatgttggtgtgctgcacccattaactcgtcatttagcattaggtattgctattcaccaaacacttgagttctctggcctcagggagctcaaatgagttattcacacactcatgcacatatcctctgcgtaacttggtaaccaacagacacacatagtaaaatatttggtcagcagttgttgaatgagtgagtacattaactgagaaatccagagactgtgtgaccacctagtaggagaaggaagttggggaaatcattacagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaaagcgctgcgattacaggcatgaaccactgcacccagcctaagaaatatattgaagagtcctttctgtctttttaaaaactgtccaggccgggtgcagtggcttatgcccgtaatcccagcacgttggaaggctgaggtgggtggctcacttgaggtcaggagtttgagaccagcctgactaacgtggtgaagccccgtctctactaaaaatacaaatattagctgggcatggtggtgcgtgcctgtaatcccagctacttgggaggctgaggcaggagaattgcttgaacccaggaggcggaggttgcagcgagccaagattgcaccactgtagtccagctggggcaacaagagcaaaactctgtctcaaaaaaaaaaaaaaaaaaaaaaaacagaaaacaaacaaaaaaactgtccagtgagctgtaatcactgcactccaacccaggcaacagagcaagacactgtcttaaaaaaattcttttaaaaatgtcattgctctcattgttcaactcccacttatgagtaagaacatgcagtgtttggttttctgttcctgtgttagtttgctgagaatgatggtttccagcttcatccatgagaacatataggcacagggaggggaacatcacacaccggggcctgttgggggttggggggcaaggggagggataacattaggagaaatacctaatgtagatgatgggttgatgggtgcagcaaaccaccatggcacatgtatacctatgtaacaaacctgtacgttctgcacatgtatcccagaacttaaagtataataaaaaaagttaaaaaaaaactgtcattgcctcttatgtacatagaaaatacagtattgagttacagattttcataatttgtttccaagtctgttctagattataattccgtagtgttgtgaaaaactcccaagattgttaaaagaaggaattttgtatcacacttcttatgtttgcatttagacaattgacagattaattaattgttcataatgtgaaatttcaagactgaaaaaaggaaaatcccagaatatatatttcagaaacacccatatataggatttatgaatattgtagtgttcctttatgtaacttcccaaaattttattacaacagcaatttctacatcttaacagtgagcaaaatgaggtggaaagattctgaagttgtagtctctgacactactgggcactgaatctaaataacctaaaaccacagaacagtatttcatcttctagttcttattacattgtcaggtgtaagaatgatcatgttgaaattgagtggttggtctgtttagatcacttctatggaaatactgcttagattggtttcagaaatccttggacagtattatttatattgcattatttaggttagaaatttttgctgacttccatctgagttattagttcaaaagcagaatcatcagcctttatatggaatctctgctggtgctcatcttaggcttagtatcttcttaactgggtttttgttagcagtatagtgtggcattaaatttgagactatctttttaataaattttttaaaaattttgtcagttgtagaataattagatacttgtaaaacaagcaagaagctgttttcactgaggactttctttaattacatttcatataaatttaagagaactgttactagaatattaaaatcacaggttaaagtgagaatgtatttcacataatcaacatacataacatttttaacagcatgctaaagatggaaaaaacctttaccaaccatacatattataggcaaagctttaaaaaaaacaaaacattttgctcttatggatgtgaaagtaatctgtgtaaatatgtatttaaatgaaaatatctattcattatcattgcagaaggagtgtgggtatctggagagggagcattctaaacttgctgctctactttttggattatctacattaatatttctcccattgctgagtatttctgttatactgctggatcatcatacttccataatctgtgacccacttgctctaatggtagagtgggctttaaactgccatctgattaaagttcaggtttcttagttagacttgcctgggtggcttcagaattaggcccacaaatatgaatatggacttgaagatcttactagaacaatattttccccgataaagacacatccataaacatggtcctaaaaagatatgtgtaagttggatttgaaaaatgcaatttaagagttactaggaaaaagggattttaaggaaacattttaagtaatttgtgtgatatcaccagttggtttttcttcagtttcttcatcttgtaaaagaaggatagtaatggctatattatctacctcatgagattctcatgcacataaaattacataattcttaagtcttaaactaccttacgtatattattatttcaattttattgaaataaaacactttttttttttgtgatggagtctcactctgtcacccaggctggagtgcaatggtgtgatctctgctcactgcaacctccgcctcctgggttcaagcaattctcctgcctcagcctcccgagtagctgggactacacatgtgcaccaccacgcccggcttagtcttgtatttttagtagagacagggttttgccatgttggccaggctgatctcaaactcctgagctcaggtgatctgcctgcctcggcctcccaaagtgctgggattacaggcatgagccactgtgcctggcccaaactaaaacacttctaatggacttgtactttggctgggcacggtggctcacacctgtaatccctgcactttgggaggccaaggtgggtggatcatttgaggccaggagttcaagaccagcccaggcaacatggtgaaacctcgtctctactaaaaatgtcataaaattagccggccatggtggcgtgtgcctgtaataccagctacttgggaggctgaggcgggagaatagtttgaacccgggaggcatagtttgcagtgagccgagatcatgccattgcactccagcctgggcgatagagcgagactaagaaaaaaaaaaacaaaacaagaacatgggctttgttgacttttctttgattttgtaagaatcatttacctttgtctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaatcttcatttttcccaattcttactgcctttttacttcctcaagagaaaacccaccttgtgactgccaagtttagggattcatgtgagctgtttggaatgtttgtttgtttgtttgtttgacagagtcttgttctgtcgcccaggctggagtgcagtggcacaatctcagctcactgcaacctctgcctctcaggttcaagcaattctccctgcttcagcatcctgagtagctgggattacaggccaccacgcctggctaatttttctaatttttgtattttttagcagagacggggtttcaccatgttggccaggctgatcttgaactcctgacctcaggtgatctgcctccttcagcctcccaaagtgctgggactgtttagtgtgttctaagccaggggtccccaacccttgggccgctgaccagtaccggttcatgacctgttagaaaccaggccgcacaacaggaggtgagcagcaggccagccagcattactgcctgagctctgcctcctgtaagatcagtggcagcattagattctcatagaagcacaaaccctattgtgaactgcacatgcgcgggaactaggttgcatgttccttatgagaatctaatgcctgatgatctgagatggaacagtctcatcccgaaccccctacccccaccccggtccccatcgtccatggaaaaattgtcttccacaaaaccggtccctgatgccaaaaaggttaggtaccactgttctaagccattgaaatagtgccatcccttctggaaaattgttacccttgtcctggagtgctgtagtcactggtatttcaccaggatgttagggtatttcaccaggatgttagtgagcacatagatattgaatatttcgggcaatcttagaatgtttactgggagagttttaaaagttagccttcccacatccctccaagaatagctgtttctctttgtagctggaatgtcatgttgtactcttgattctcctttgtacctgttcttagccattaaggtgattggtggtcaacttcgtataaaatacaactcaattttaccattgttcttattgatgcacatgaatgtttctctttatgcatatcactgagggaagtatagtagcctttgaaagaaaggccttcttgtagtctcccctggctctggtagcaaggtcaggcaaaagtgttgtttttgcagttgtgactccatggttgtgtttttctttacataactgatgttttaagtcaggaaatatgactttgccaaatgatactgagctatattactggtgagtttgtttggttcctgatttatttcagtaaatctgggttgaatagtttagtagtagatgctggggaagatacaggaaatagtgagtttgagactagaaatgattgagttagacatttaatttaggctttcccaatcaacttacttcataccttttgccctgcttactcatcccagaggtgaggaacaatgagaagaggggtcaggcaaaggccatccctcagaatgtggttacttaggtctgtcgccaaaggcaacctatctactggaaaatttgagctttactgtcttctgcagtatagtgttggaaatgcagtattttaaaaactaaattgttatttatagcagtgaataaaatgtgaactctttaaaaaaagagcagtgttactgtcccagctagcacaatagccacccacatgaatcatctgaacaacctcctcatttctgttttatctacctgaaataggggtcagcggtaggtgatgatgaaagcttgggaaatcatgccatgcattaggcaggagaaatgctgtggtgactctttctgtgttgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatattgtagccactagccagatgtggctatttcaagttaattaaaattaaaatttaaaattcactgaacagacatttctccaaaaaagatttataaatgaccaataaatacacggaaaggtgctcaacatcaagtcattatggaagtgcaaatcaagaccaaatgaaataccacttcatgtgcactaggatggttagaatcaaaaagacaataacaagggttggcagggatgtggagaaattggatctctcgtacgttggtgggaatgtagaatgttgcagccaccttgaaaaacacactggcagttcctcaaaaagttaaatatagagtttccatacagcccaacaattccattcctaggtatgtgcccaagagaattaaaaatgtatatttacacagaaacttatacatgaacattcatagcagcatttcataatagccaaaaggtgaaaacaaccccagtgtccattaatggatgaatggataaacaaaatgtggtagttgcacacaatggaatatcattcaactataaaataaattaagataaagacgcatgtgtatgttcatcacagcactattcataatagcaaaggcatgtaattgacctagatgcctgtcaacagtggactggttaaagaaaatgtggtacatatatactgtgggatactatgcagccataaaaaagaataagattatatcctttgcagtaacatagatggagctggaggccattattctgagtgaagtaacacaggaagagaaaaccaaataccacatgttcttacttataagtaagagataaacattgagcccacacagacacaaagaagggaacagtagacactggggcctacttgagggtggagcattaggatcgaaaaattgtaggatactatgctgattacctgggtgacaaaattatctgtacaccaaacccctgtgatatgcaatttacccatgtaatatgtatcccctgaacctaaaataaaagttggaaagaggaaaaaaaaagatcactttgggaagaattgatagcttaaattattgtgtcatccaatgtatgaacaaggtatatctctattatttgggtattgtttaatttctctcagcagtgttttgtagttttaaaagtacaagtcttgtacatcttttgtcacattcttaaatatttcatatattatgctgtggtaaatctgtttttcatttgaatttctgattgattgttgttagtatatagaaatgtaattgattttttgtatgttactcttatgtcctgcaactttgctagattcacttattctagtagaatgatgtatattgcattggatagtctacatagatgatcatatcatctgtgtataaagacttcctttccccaaaaaaagaaataaagtacagatacatggtgcaacatgcattaacttcaaaaacattatgctgagtaaaagatgccaaacacaaaagaccacatattgtatgatttcatttttaagaaatggcctcagtaggtaaatctgttgatatagacactagattagtatttactagggactgggaggaggagagtgtgggcagtgactactaataggtatggggtttcattctgaggttatgaaaattttaatggaatttaggtagttcttagtgatcaaggcacaactttgtgaatatactaaaaaccaccagattgtatacttaaaaagggtgaattttatggtatgaattatatctcaataaatgttatttttaaaaattcagttccttagttactttagccacatttcagttgctcagtagctacatgtggctagtgactgcatggtagacagtgcagatttagaacgtttccatcatcacagaaagttctgttagacagcactgatctaagagtctcaatctgagaccaaaaaataaaggaagaaaaaccagtctaaaaaacacagggagtggagaacagattatgttctgaagaaatgttactttggggtaattttaccctttgttgccctttgactgttctactaggagtcctcaacatgattttcattttattctcaaaacaaatgcctgtggtaggtactgttatactcatgttttataattgaattatatgagttttaagatatttgtgtagtaagggtagagcaaaatttctaacctaggtacataatctctgttacattgtttacctctgtttatggtatttgattttcttaccaaccatccttcactcccactttgttgctagcccactagagctattttcagtaccctaaatgcacagttctttttgtgccatagcagatgctagccctccttcctccttctgccgtctcccaacactagtatgtgcatgtgcacacatttactggccccacttacctgaaagtgtggtgcacatctctcttcctttgtgaagctatctgataccacagttttaggggctactctctcacctggttaaggttacataatgtcgcaagatataagcaagaatgctgacaggattcttgttgtgacactatgacacattgagcccaattcatagctgctgtgttggtgactctaacagggaagtggtcttctagtccaggcccttggctcccatttatacattatctcctttccattcacagccttctttaatccccacccacactgctacagtacctgactgaactttgcctttctttgcctcttcatatgtttttctgcttaagctttttgaacctgatgagatactgccatgtttttatatttttctgctcataaaacccttaatggtaaaaagatacctgattgaattctgaagtgctttcatggctttgcctgattctgaggtcatattttctaactttatgctaacatcagtttactctctggttttatatggagcatgtactcctgtagcttctgaagaaaggtttaatgggaagcaaattttgagactacatgtagtaggctaaatcatggcccaccaaagatgtacacatcctaattactagaacctgtgagtatgttactttacatggtaaaaggatctttgcagatcttattaaatttaggattttgagatgggggattatcccagaatatttggatggacccagtttaatcacaagggtccttataagaggaaggcaggagggtcaaagtaagtaaaaggagacacgacaatggaatcaaccagagtttggagtgatgcactttgaagatggaggaagagggccacaaaccggggaatgcaggcagcttcaagaacatggaaaagcttctcccctgaagccaacatcttgatttgagatttctgacctctgatcagaactgtaagagaataaatttgtgttgtttaaagccactaagtttgtggtagtttattacaacagtagtaggaaattatgaatacaccatgtataaaaatgtcattatgccctttaacttgattgatagtttatgtagacctaatatatatgtacacatactagtctccatggctccatgctgcagtggacccaggacccaggcccaccatccatggactcaggttccaaacccaccccagcagacttggcctccagactcaccctggcggatccgggctccaggatcatccctggttgtctcagactccaggcctgcccctgcagacccagtcttcaggcctaccttcgtgatcccaggcaccaagcctgcgtccttgaatccaggtgccaggctcattctagcaccaggctagtcccttaagactcaggctcaaggcccagtgcagcaccagattgagctttatggacccaggattcacactggcccctgtgaatacaggctttaggcctgccctgcatgcccagctgacaggcttgacaggcttacctgagtggaccctggcactaggctgttccccatgcacaccaggattgagatccaccctagcaaactcaagccgtaggcctgtcctaatggacccaagtttcaggatagcccacctgaaaactccagcagcaagcccccctgccagacagccctccggaatttctggacaggctgactggtaaaaggcttttcctgccaaagccagtctgtgaagactgcaagtgcctacttcttcttctttttttttttttttctgagacagggtctcactctgttgcccaggctggagtatagtggagtgatcacagctcactgcagccttgacctctcaggctcaagcaataccactgcctcagccaatcctactgcctcagcctcctgagtagctgggaccacaggcaagtgccaacaggcctggctaatatttgtattttttgtagagacaaggtttcttcaagttgcccaagctggtcctcaagcaacccacccgccttggcctctgaagtgctgggattacaggcgtgaaccaccatgcccagccaagtgcctgctttgtaaaatgtgcagacactaatgcaaaactgcaaggatcaccgataatcagggaaacatgacatcaccagaggaacaaaatgaagcaccggtaaccagtcataaagaaatggacatctatgaattgactgataaagaattcaaggccaggtgcagtgtctcgcatctctaatcccaccactttgggaggccaaggtgggtggatcacttgaggtcaggagtttgagaccagcctggccaacatggtgaaacctcatctctactaaaaatacaaaaattagccaggtgtcatggcatgcgcctgtaatcccagctactcgggaggctgaggcaggagaattgcttgaacctgggaggcagaggtcacagtgagccgaggtcatgccactgcactccagcctggctgacagagcaagactccatctcaaaaaaaaaaaaaaaaaaaaaaaagatttcaaaataatcaaataatcatcttaaaagaagttcagtgagttaaaagagaatatagatggacaacaaaatcaggaaaataatacacaaacaatatgagaagttcaacaaggaaacctcaaaaaaaaaaaaaaaaagaaccaaacagaaattctagagctgaagaacacagtgtctgaactgaaaaattccacagaaagcttcaatagtagacttgaagtagaagaaaaaattagtgagctcaaagatggtcatttgaaactacccagttagaggaagaaaaagacaactaaatgaaaaagagtgaagacagcctatgggagttatgaggtaccatcaaacaaagcaataaatgcatatgagatttccagatgaagcagagaaagaaaaaggggaagacagcttaaagaaataatgacagaaaatgtcccaaatctggagacatgaatgaacatccagatccatgaagtccaaagaacctccaactagattaaagagatcttcactgagacactttataatcaaattctcaaaagtcaaagataatttcaaaagcatcaagagaaaagcaaaccatcacctacaaggaaacctctataagactatcagtggatttctcagcagaaactttccaggccaggagagaatgggatgatatattcaaagcgctgaaagaaaaaaaaaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataatactagcagattttaataccccactttcaacaatgcacagaaaatcaataaggaaatagcagatttgtactacactgtaggccaaatggatctaagagtcatctgcagaatatcttatccaacagtagcagaatacgatgttcttttcaagtgtgcatggaccagtctctaggatagatgatatgttaggctacaaaacaagtcttaacaaatttaagaagattgaaatcataccaagtgtttttttctgaccacagtggtatgaaactagaaatcaaaagaaaacggaaaattcctaaatatgtggaaagtagacaacacactcctgaacaaccagtggatcaaagaagaaattgtaaggaaaataaaatcttgaggcaaatgaaaatggaaacacaacataccaaaacttatgggatgccatgaaagcagttcgaagagagaagcttataatgataaatagcaatacatgaagaaaaaagaaagatctcaaatagacaacctaactttacaccttgaggaactagaaaaagaacaaactaagctcgaggccaaaaaaggaaggaaataataaagatcaatgcagaaataaatgaaatagagactagaaaaacaatagaagttatcaacagaactgagttggttttttgaaaagtaaaatcaacaaatctttagctagactgagaaaaagagaagactcaaaattataaataaaagagacattgcaacttaaagagatacaaaggtttataagagactactataaacaattatataccaacaaatttgatagcctagaagaaattgacaaattactaaaaatacagcctatcaagactggatcatgaagaaatagaaaatctgaacagacctataatgagaaaggagattgacttagtaatcaaaaacctcccccaaaagaaactcccagaacctatggcatcagtggcaaattctgtcaaacctgtaaagaggaattaatgccagtccattttaaactcttccaaaaaattgaagagggaatacttccaaactcattttatgaagccagcattaccctgatgctaaagctagacaaggacagtacaagaaaagaaaattacagaaaatacaagaaaaaaattcctgatggatatagatgccaaagtcctcaacaaaatactagcaagccgaattcaactgcatattaaaatcatgcatgcttggtacaacagatatatctgaagagactcttttctctatggttggtttcttcttgatcatcactacctcttagtgtacaggaagctcaaaatattactgtgtgaccttaacaaaataaatttacttctctggtctttaggtttttttcaatgggaaaatgggaaggttggctccattagtttctaaagtccctttgagctctgaaatgagtaattttataatttctaagtgtttaattcatcaactacatgactttaccttttttcttcattacctgtcaaattcacttaaaaactattatcacacttcatttgctttttaataaatttctgacagcatgaatgggagaaaaaaagggactatacagcatgatcaaagaagatttatccctggaatgcaaggatggttcaacatatacaaattgataaatcacattaacagaataaagtacaaaaaccatatgatcatctcaatagatgcagaaaatatgtttgacaaaattcaaaatcttttcatgataaaactctcaagaaattaggtgtagaaagaacataccttaacacaataaaggctgtatatgacaggcccacagctaacatcaacactcaatactgaaaagctgaaagccttttttctaagattaggaagacaaggatatccactctcaccacttatagtcgggataatatgggaagtctgtcctagccagagtacacaagaaaaatgcatccaaatcagaaaggaagaaataaaattttcggtttgcagatgacttaaaattatatatcaaaaactcttaaaactccaccaaaaaaacctgttaaaactaataagcaaattcactaaagtggcagatacagagtcaacctacaaaaattaatagtgggggaggagggagtagggatggttaatggtcaccaaaatatagttagatagaatgaataaaatctagtgtttgatagcacaacagggtgattacagtcaacaataatttattgtacatttgaaaataactagaagagtataattggaatatttgtaacacacagaaatgataagtgcttgaggtaatggatatcccatttaccctgatgtgattattgtgcctctatcaaaatatctcacataccctataaatctctacacctacgtacccataaaaattaaaaattaaaaacaatagcatttgtatgcactagcaatgaactgagaaagaaatcaagaaagtctgatctacaatagaatcaaaaatatataattcatttctaagaggtttttttgttctctcttcttgtatatagcttcaagattttgtttcttatatgctatgtctaatgtcctccaagagaaagagagggaaatggaattataattaacattgtcttttccctatattatctgttttctcttattttcttttttcctgttttttagctttggtacttgtctgtctttcatgttagaggtgtttctcaagcatcttcagctgtttgttgctattaaggaaaagtttattggaaactgtgttcatgactgtggcttgttcagtgatggacctcatgtggtgtgattgagggaaacctggctatttatggggagcctatcagttcttttttcttaagccagtcagcttttctaaataggatttctaaattgaatcttttgtgggagggagtttgggagtaataagctcatgtctagggctggatccttaatcattggctgcaaagacttatttaacccttgttttcagtaaggcatcccatttttgttctcagttatggctggtgttcctgagttcaggggctctgattcaacctctccagagagtaacttaagccctctgctatgtggagaaaaggcagttgccagatgctctggttggagtgagagtatgtgaaaatcttacttctcttttttaaacaatttttcagcatccccccaccacttgctttaaaaaaaaggattattttcttcaaatgtgcccataagctgcaattcctgagcttttaccttctgttcttccagggcactcaggagtgaactggcttacttgcctcaatttagattcccccactgcaggtacttggcacaaagaagaaagatacaatcaagtcagttacctcttttccaaatgcttttcattttaaattttgtgggcctatctcctttgctgtcatcatctccccacgctcttcatcttgttggtttatatcttttctaattcttcagtcttttgatttgtagagggagttagataaatgcttgtatctgatcagttatgtttaaacaaaagcgcctccctcccttgacaccttctctttttcttggacttctgtttcttagactgtttccaccattagaataagagcttgtcaagggcaggaaccagggtatttaatagctccagcatttgtataatgcctggagtatagtaggattattaaataaatgaacatacctttattttcaattatagatttctctgacttgagaaataatttcaaataaaacagtgaagtctctcttacagataagttcggaagctctcctctttcctcgattcttgcttatttttatccacagtgcgtctcgtgaaggaaaagaatggatcattctttcttgatttcctcgttggtaaagtatttggctttaagagctattcaaatgaatgtgcaaagtaagagtaagttgggtgtatttctagcactaagttgttgaggttctagaaaggtagttttgtgccttctagataccatgtctgcctttcctaatgagcctggtatgtatactattctgcctagcataactaggagcaataggatagagaagtgggatataccatttcaaagattcactgatgctgcttagaaacaaaaatctaaatgaaaaccaatgtacataaattagataattcacatataccattagaaattccacttaaagtcagtactgctagaaaccttgtcattaccttgctttaaatgctaagcgctttctgattaattctttttcagtttatttacctgggaggtattcgatctaagcaccagcatccctgcccccacttttatctattaatatttacaggtttttccctctttgaagctccctattgaattctgaatgactttgaacttggaattgctctgggtctgcttttcacctcctttctctacctcccaccccaaccttcactaatttgcttttttttttttttttttttttaatatttgggtggtttcttcttgcattctcttttttctatatgctccatgacagcctggactacatttctgttactcactgctgcatccagtgcttagcacatgctgggccttaagtcactgtttattgaaaagaataaatggattactcgttgaaatttttttaattatgaataacaaaaattagtaatctaactatatattatcaatcttttgctgtcttatcttacaggttttctttctggttttcatactggatagtctctattgacctagcttcaagtttgctgatttttttctactgtcaacttaaacttgctgttgagtccttctagtgaattttttgtcaattatagtacttttcaactcctcagtttctattttttttaagaattctttttctttattgatgttctctatttggtaagtcattatcctcatactttaaaaaacttctttaagtatagtttcctttaattctttgaatatatttataatagctaatttaaagtctttactaagtctaacagctgagccccctcaggaagtttctattggctgctttttttcttctgtatgggccatcttttcctgtttctttgaatgtctcataatttttctgttgttgataactgaacattttagataatatattgtagcaactctggattctgatccactcaggtagtggttattgtttttacttttgtttttccattgcttaatgacttgcctggactaattctacagaggctgtctttgctgaaatgtgtggccactgaagtttgtgctaggattttttgttttgttttaaattcttgtttttatttttaagcctggcttcctagggttttccccttggtcatccaatggttggccacaagttttccttaaacactttgagccaataagccttccatcttttgctgaaggaatctctgtgtgggttggggcatacgttgaaagttcaggcagtttaaaagtctgccttggctttcactttctgcttgtgtagggcctcacagtcagccaggagcagtagataattgggaatctttctggtctctcttgaacatgcatacatgcacagagccctccaaatggatacaaccttccagaacccccaagtatgtcagagctttaagctttctatggctgtctcattccccacatctaccttttacatgttggctagtgtcttgcttacctcaaccagtattgcagacttaagcagctgtgattgtttctaatgattgctattgtttttgacagtgcccctggccatggggctttctcttggagctccatatcaagtcagcttccttcagtggaactgtccacaaagctacaaggccagcgaattgtggtagaagcggacccaaattaaaatgtcacagaccctgctggtcttacctaggatcattagtagctgaggtcctcactccgccattccagaagtcctgccccccacctctgccttaggttttcaatgtgtttttatagctgtttatagttttgtggcttttcatttagtataaatattttctcatgttcttgataactcattataactaatttctactggctctcatcatttgaatgtctcataattgatttggtaatttcccctgttgttggacttcagataatcactggtgtaatttgcctttcccaacaggctctaacctgaatgaggcctgggactgctttgtttactacttcatcctcagtgcctgacacagtaattcttgttaaataaaggtcaccccacaattttttaaatgttataaataacactttgaggtggatcgtactgccaaaactgtattcagatttcagattttttttaagaatggagtttcagaaatggaattgcttggtcaaaggatataggcatttctaaacctcttgacataggttgccagattgatttcttaaaaagtcctatcaaaatagaaccttttggccgggtatggtggctcacacctgtaatctcagcacttcgggaggctgaggcaggtggatcacttgagatcaagagttcgagaccatcctggccaacatggcaaaaccctgtctctactaaaaatacaaaaaatttagctgggtgtggtgacgcgtgcctgtagtcccagctatgcgggaggctgaggcaggagaaccacttgaaccccagaggcagaggttgcagagagccaagaccacgccactgcactccagcctaggtgacagccagactctgtctcgaaaagaaaaaaaagagaacctgttttttcagcagcatccttatctgttgcattgtatatttggcgacatcagatgtgctagttgctcaagttttattgaccttattggccaaaaaaaaaaaaaaaaaaattctcgttgaactattttgtgtctttttttgagacagggtctcagtctgtcacccaggctggagtgcagtggtgcaatcacagctcactgcagcctcaacctcctgggctcaaatgatcctcccatctcagcttctcaagtaactgggactacaggtatgtgccagcagacccagctaattttttgtttgtttgttttagagatggggtctcaccatgttgcccagcctggtcttgaactcctgggctcaagcagtcctcccaccttggcctcccaaagtgctgggattacaggcatgagccaccatgcccagctattttgtgtctcttcgataaccaatgaaagtattagttttcctcatactttttaaaaaaaattctttctataaattggccatttgtttttcccccattttgctcttagttgcctaatgtttttcttgctaatttatgtaaactttatatatcaaagatatttatctattattgtcttttatatatttttaaaatttttcattttgttcctgatgagtttggatgtgcagaaactaaaaatcatacagaagaagcctctttgttcgatatgattggatattacaactggtctgctaaagagggaggagtataaaaaaagtctacagatatctcttcaatattttaacttgaagacaaaatatacattaagtagctaatcctttgatattgtgtgacccttttctttgaataagtctaattgattcgaaacctgctctatatttcttttatatatctcatccaaaatgcatcatcaacgatgtccagttttgatttatttaaaatggggtaatgacttaatgagctgtaatctgagtgcaaaatccttttggatattttatagatccttgctccccccgcccccccacccagtcttttgcagttttgtcacccacatttaattcagtatctcctttatctggtctttgaagccagttcttctcttttgtagtcacattcaattgctgtaacatatatgtaacatataattaagaattataggccggatgcagtgcctaacacttgtaatcccagtactttgggaggccgaggtgggcagatcgcttgaggtcaggagttcgagaccagcttgaccaacatggcaaaattccatctctactaaaaattaaaaaaaaatagctgggtgtggtggcacgcacctgtaataccagctacttgggaggctgaggcatgagagtcacttgaacctgggaggcagaggttgcagtgagccaaggttgcatcactgcactccagcctgagtgacagactgagactgtctcaaaaaaaaaaaaaaagaaattatagtaacacctacacaaccaacataaagaggtacacatttaggaacaaatacaaatagctcttggtatgtagacaacttaatttgtggggttcatgggctcatatgtactacacagtaccctgtcagcattgagcagtcagcatgcagcaggcattcattaggtttctacagagggaatggagaatggatcagtctgtgaaatttgttaagtggggtcaattaagagtgcttctaccatggtcaaaatctaatcagtctttttctttgttgtgattgtttccatgcttagaaagtccttcccttcttgagagttatgtgaaaattcacctacatttttctgtctttcttttgattcatacatttaactctttagttcatctgaaatttattttgttttttagtaagaagtaaggatgtaagcatctaaatagattttccaccttcaaataatgtgctgttttttttttccccagcatagccagtgcattcttcaaaggcaaagatcaaaaatgtaatttctagttttcaacaattagaataggggttgaatgggtctgggtcttgggagtggaaggtcagtatggtccttggggttggggaagggcaggcagagcatagagtggaatttaaaacacacacacacatacacacacacacacacacacacgcatgcacattcacatgataaggagaaaaagataactgagaaattggataataacagagctagtaggaagaggatatagtacaatgaaccctctttagaatgcaggccctttccaaaatgaaaatttgaagggtacttgggctctatttgatgaattatagtgaggtaaagtagtttattaagcatttgaataaacctaaatagttaataagctattgtttattaataaaaggtatgccaacaaggaagtaattatgcaaagttctacagagctgtcaaacttgaaagcatgtttttccccaccgattttgccagtctctactgggaaattatttatgatcattccctcagtcttttgaataagtcaacttctctcagtgcaatcattgctttttcctgggccatagcattaggtcaattagtgaaatattaggcataatactctttaaggctatgaatggccttgaagtactgtatgaaaaatatgagattaatattaagaagctgctatgaagcaaatgttaccagtggaaaattttattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatcaaaaaataaaaaaaaaaagatgttggcatggatttggtgaaaagggaacactcttacactgttggtgggaatgtaaattagtacaaccactatggaaaacagtatggtgattccttaacatctaaatagattttccaccctcagataacgtgcctttttttttttttccaggatagcaactgcattcttcaaagggacagatgaaaaatgtcatttctagttctcaacaattggaatagaggttgaatgggtctgggtcttgggagaggaaggtcagaactaaaagtagatctaccgtttgatccagcagtcccactactaggtatctacccaaaggaaaagaagtcattatacgaaaaagatacttgcacacacgtttatagcagcacaatttgcaattgcaaaaatatggaactagcccaaatgcccatcaatcaatgagtggataaagaaaatgtggggtgtgtttgcgtatatatacacacacacatatatatacatacatatatacatatacatgtatatatacatatatatacacatacatgtatatatacatatatacacatacatatacatatatatgtatatatatacatatattcacatacatatacatatatacgtatatatatacatatattcacatacatatacatatatacacacacatatatacacatatatatacatacatatatatataatggaatactactcagccataaaaaggaatgaaataatggcatttgcagcaaccttgatggaattggagactgctattctaagtgaagtaactcaggaatggaaaaccaaacattgtatgttctcataagtgggagctaaggtatgagaatgcaaaggcataagaatgatatattggactttggggactcaagggaaagtgtgggagggggtgaggaataaaacacattgggtacagtgtacactgcttgggtgatgggtgcatcaaaatctcagaaataaaaaaaaaataaatgaatcaccaaccaccaaccaaccaatatgggagatttgtttcagctggagggccttagtttcttaaagtagttttcttctcttgctctggaaagtactaattccaaggcctcttttctcctcccagttgtaggatattggggattcttactagaaagcgtaggcagagcacatgcagccagtgtccccaagttttttagaccatctggagctacctgtggctgctatgtagcctaaaacttcagaaggccttatgatctattggcagatggctaaactgggatccttgtgtcagggttttcttttatgttatttttaaattccagaatagaagagaaaatgaaatggagaaagaagacattgaaggttgtggtgttttctgtgaagttcaagaagtattgacatttctcagaagagtatgactatagatgatattgttactgtttggggttttttgttggtcatggtggtagtgatggatttttttttttaagagtcacgtttcttcacctagaattagctgaggaaaagtggcatctgtattgatggttttaatagatatgattttattggtggtgccttcagagtagtggcttagagtaattagaaagacatcattgctttgtataggtcttaaaaagattgttaaacttttaattcaatgttggctgagcctgctgtgcctgatacattaaaagaaaaaagtcttatgatttactgaaaagagtaaaatggtcctgatttcagttactcccttctactcatgcacactgtgttgcttactgccctttttaaatccaaggtgattcttcaacctcatacattgttttaacatttcactctatgtctaggacatgtctagaatatttaagtgcctttttcttggaaataatagagatgtatcatacccagttttatttgcttaggtagcagataaagacttcagaaatactcaatatttgagtatttgggttggaatttgacactgtgtgtgtgtgtgtgtgtgtgtgtgtgtgtgtgtgtgtgtgtgtggactcaactagcctaaaagaaagataaatgcctcttagaagctagaggggaaaaacctatgaaaacttagtttgggatgtacctatgatgaagaatttgccctctgatttctcttccatgtggctgattttgaaggttgtatagtattttgtttttatgttttgatacagctgttaattcttgaccattttcctcagaaattggcatttccagattggcaaaatctagtatcattgtaggtagctctttacagataaatttgtacgggagagtatgcaatatattttgaaacttctgtttttgtgtgtacaaatctctaaatcagcccagatggtggccattatggattagtaatagcaagaaagaaagctgttaatatcacagcttctaacatatgtctcctgattgtgggtatatatgcctggtgtcaaagataacgctacagcatacctattacggcttttaaaaagttactaaggcatttctatctgtatcagccaactagaaggatggattagacaacatgatatatgtagtgcttttatctctggcaggtagctaagtctttgaaagaagatatatcttctcatctggccagaatgttttgattttaacttgaaatttcctaacaagagttcttatgtgtttattattgcatgttcttatgtgtttatttttaaaactatcctttagcatttaggcacattaatttatagcacctgtagagcaatcagttgcaatatctgcatatatgccttttattttctgtaattgagatctgtattatatttatataatcagtgtgtaagttactctaaaagttatctagtcaagcttgactttaaagatgtctttgtaacttgttctacattgttactgtttccttcagaaagttaagtttccaagcttctttaagttacattctagacgttccgaggggttccaaagtgttgaaaaggaaattgaagtaagctttggaatatgttaataagcttcaactggaaacatgtatggtagcagctgttttaaaggccgctgatagtgagatgttaattgagtactttttaaaatatattacccaaccttctctaagctctgaagcttcaattacatttatcctaggcactaagacttgaatccaaaggggttacttcactgctcttcttgaggttgggggtcctatgttattcactattgtaacagcaacagattataatgattggtaggcaaccaaatgcttgctgatttaattaaacttgcctagttatttttaccttattgtaaattttggtctatagagctgaagagatttctccccttttctttgaattaagaaaaagccacatatgtgtggtaaactccccttcaccataatgaaactactttttcttcattctttgtaaaatattaacccagtagagtaaaaactgaattcttccatgaatggtggtatttcttctatctggcaaattaaagcaatggagaccattagggtataaccctgaactttttgtgctccctccaccctggtccgttatttctttggtataaaatcagaagaatgaaatcttagtagagttctcgtaccactacacaagacaaggtaaccatgctcttgaaatagatttaattttagatgttgagtgttcctaatgggtggcaaattatttatgctaattgtgaggaataaattacttatagatttattaataatttacacatagtaacttaaggttcaaagtttgttaacacttattttatatatgacattcacatcaactgtatgaggtaactagatttttctttttccatctcataaatgaaaaaaacaggttttttgtgaaaatgcaacttgcccaaagttgtagaattagatttttataaacagatctgagttacttaatatgtgtagaaatctttacttgacaaattttcgacattgtaaggtttgtaattttatctcagaatcctagaattctagagctgagagaaacttaagttgatacaaatggaaaataggttctttattgagtgccaggttaatatcaattgtagctgttgagacttggagttgagacatttttattgacttatttccagtttattggcagagagtgccctaattgattaaccatgcctgaagtagacatggggcaacatatagatgacaaatatgtggcagtcagactcagtaacttgatatagcattttgaaagtacctaatatagctttttacagattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaattaacagcgggaactgcggccactgattgggaagcctaaatacaatgagggtaattggatcccaggatggcaaggaccagtagcacttaattgccaaaggaagggcaggtatggttactgaaatggacagcagagtcaaagcaacaattagaatgaactgactagtacagggtgatttcttttgctccaagcaggcccctggctgttctctggagattctttattgtccattcttctccatggccctatctgaaatgctctttggggagcacatttttcttggggactacacagctttcatagctaacatattactgttgagggtttggagccatgaattattttagagatttaatagctattggctgctgcagggcagttttggggtttccatgacaatatcgtttcgtcaaaaaatgtcgatatttttcttcttgtttttagtaagctccacgggggagaagccacatctagacatagtttcttagcctgaaaattcttctacttactggcctctgtgctctgcccttttctttcagcttttgagttaatagccagctgcctcgaggtaggcaacacccttaatctgatttttgctggctagttttctttcctgtcctgaagggaactcttaaaacagcttggggttgtggtttcatctcctgctaagacagccacttctctgagttactgcttataatcacctcagtttgagagtacaggagctgttgatgtttatagtcctccaaagcttcaaattatgtgactttcagtcgatttaaattgaaggctgcaggcacagaatggctggctcaagttctatttggtctctcctaggactgggctcaaaagctgcaagaggaaaccatcatacatccatatcccgaaaatgtcctacatttccataaactgtagcctcatttggcatatggtattaccaaatgttttgccactacctaacaagagtaaccagctttaagagtcactgtgaattggttagagactgatgggattagttaagactaattttccttaaagtcttttcttttccttgatataggtatattccaagtgttgatgggcagcttggggtttatttactttttagacttataaattgggagaaattaggactaagggaaatgattttttctaaggacatgaacatttataaaagacaaggaaaaagtatgacggaagaaatatgtggatgtaattgccaagaaaggagttcatcagtgatgggtaaatggtcaagaaaaaatggacagtgtgatctctgtgtgatcctgttaatatatattgtgccagccattttcctatttcagccaccaagtgatgcagtttacccagggtctgggttccagtcctcattgagaggaaccatggttaagaagaaagtgaacttacaaccaggagtttatatgttctcccacatttacccttcggatggtatctaatcattttctcctctaaatgaaatgtattacattctcttgtggctgatttctctagtacttatcttatatattcttaaacttacctttatgtaaatgtgctcaatcaattttagtaagacttaaacttcctgagctctaccttttaacagcatcctagactgagagttagtctcaaaagtcaagttctacaaaagaatcctttatgctgtttaacttaatatgttgtagtgttgtgacttctctacctttcagtgtttcttgattaggattcttcaaggtatttcttttgtttttaatcttaaaaaaattaacatgtcaaataagagaataaatagtacctggcctttattagaatcttattttccataatgttttaaatattttcatatcctatgagatatgaagggaagagttatcaaacaataaacttttgaacaccaactatcagccttttactacaccatgaggcttaataatagtaaatagtagttggtttttattgagtgcttattaaataccaggcacagtggtaaacattttatcttatatatattcattttatcctgacaacaatcccaagagataggtggtgttatcttcgctttatggatatatgtaaaccaaggctcagagagttgtaagccacttgcccagggttaccaggctattgagtggtaaagctaggagtctaaggaagttcaactccaaagtccgaactgtgtagctaccttgctataattgtagatggtccctgccatttgggaacttggtttaacagaggaagtaaacacggaaataataaattgaatgatttccctttcttagtttggccatagttgttatgatcatttcataataatcatttctataaatgtaagttggcacatatgaagcacctttggtatgatgtcagaatatcatttttgaagtagtgaactaaaatggcatatcaagtgacccaaaatgtcatgaagctttttggaaacattcactctacgaaatttattgaacaattattatggtccagggtcttctgggcccagagggtacagttgtgaataatatagaagctgtcctttctgtcatggaacttgcaagttagagagggagagacaggttaaataattctacaaacaattgtttaaaattcaatggtggtgagtgctgtgaaggaagccatggaagtgctgcaacagtataaaaagggaactgaacctacttcaagagtaagaatcaagggagtgattcaccttgagtagagctgtctttcaaactccataacatactttaatattttatcagtgagtcttgtaattcttgatcgttattctttctactagtatactgcagtcttgtgctttgtgagcaccaaggggaagagagcttaacttggtctgaggggaaatgaaaacaattcttagatacttaagctaaatcttgaagggacagtagagaggaattagaccaggggaagtatattctaggcagaggaaacagtttgtacaaagtttacacaaaggcattgggggcagatgagaacataatcctttaaagataattatggttagtatagctggatgcggtgtgtgtctagatggtattgagagatgaggctggaaagatagatagaaaatgtgaaatatttatgtaaccaaatctggtttctgtagagttggtctattaacttttccccatatttcagaggatctaagagatatgagattttcttttctcccccatattttaattgttagcattgttaaataaagtgtaaggattggcctaaatagatgtatagtgagatatcttatagttttaaaatgtatgtaatgcagtaattttaagggttgcagtcagatacccaaagcaaggcaattaattagtgaaatacatttggatctcctggctagactgaggcttgagtgttgtagaaatacatattactgcatgtgtataagattgggtctgcctgaagagaaggtttaagtgtggtgttccaggtatattccaatggtgaggcagaatattttgttaatgatcaaaggagaaataagagatcaagtgggaggaaattattaacagtgaaagcaacatgggcagtttgatgtagagcactgagaactatgtaggagacacatggcttgcatctgagctggcctctaccactgaccataggcaagtctctgggtattttggaatctgaatccaaacttcctattgaagtataacatggcatacagaagagtatataaattataagtatgtagcttgatgagcttttacaaactgaacacattcctgtaacagcacccaagtcaagaaactagaatgttaccagaagccctctttgtgctacctgtacttccatttgtttaatctttaaaataggggtaataatgtcttcttcacttttagaagtgctgagaaaatgacaacttgagaagtgccttgatctctctcagtgttgttatacaagtgaaatgagatgctaggaagtaggaccagcttccaaaattgtagaagtacatagagcttacttatagtattattagtaaacctattaaattggggatgcataaggagataactctgaaaaccacaaagcaaaggacaaaacagttgtctaaaatgaatcataaggatgcatgggcatagtatatgtgatgtcttttgttcttataaggtgtcattcttgggattcaggagagcaacttgtgtatttttacctgttcaaaaaatgtgaaactattctcattatttgaggatgctggagaaatggtagcttcctgaaataaaagtaagttctgttttaaaaatagccataagtcttgaattcaccaaatatttctgtttgggtttcaggaggtctgatgctgagtctctttttgttaatctgaatgcttacgaatacttttagaatgggaagtcctccttcatgttcttaatgccattagctaaattgatttttttcaaagtaacaaagtcatcataaatgaaattacatacattagtccccacttatccaaggttttgctttccatggtttgttacgtgtggtcaacagtagttcataaatattacagtagttcaaaaataaagtattttgagaggggggagccacatttttgtaacttattatagtatattgttgtaattattctattttattattagttgttagtctcttactgcacctaatttataaaataaactttgtcataggtatgtatgtatgtatcagaaaaatcatagtatatatgggatttggtgctatccacagtttcaggcatccactgggggtcttggcatgtatcccacgtggataagggtaggggactgctgtactcttgtagtactttttgaaaaagtttcaattttgtttagtgtaataacagattgatgcataccatttcttacacgacactagctgtagtcaccacaataatctgcatttttctatcaggcctatttgctttccaattctccatcatctccctgtacaggtatcttattagatccccttaagatctattctgtcctttacctgtatacagtgaactaagacttttaatttctataaggtaagatcattttattagcatatttttgtctttgatatataaaattatctctgctgagctcaaaagtttagtaaattttttgattgataatttaagaaagtctttaacataggcagtacagttataagggatagacaaatagagcagctttatttataataaacatttggctcttttgcaggatttccagattttaagatacactgaacccagtttatagccttttatccctcacgcccccgacctttccctcccaccagtccccaaagtccattgtatcattcttagaaacattctaagaacttcatgttacagttctgaaaactgttacatttacacttgttgtatttctgaagactttgttacatgtgagttacaggtgaatgaatttgagggaaaaactgacaaaactcagcttgaaaaggaacccacagtgatttctctacaagggtattttttgaatttgtgaataatttattggcagcttgctttgcaaaaaatacacaaaaacctatggaaataaaattttaaaaaaaaagtcaggaaagactgcaaaaaccatgaccttgcacaaaggccattgcaaccgtatacaaaaaaaagaacacttctgttgaggacatctgcccagccttggactggcatcacccttattattgatccttgaagccaaggacaatgacctaaaaacaattatgtaatcttcctcattttatctttgaaaacctttgtcttcctttacttccctaaatacacacatagtttactgtggcacacatattttcattgcaatgccctattcccaaataaataccattttctgtttttttttttttaagaatattttgtgctattatgtgattgatgttggttagtgctattagtgaagaagttggtgctttaaaattgaagcaccagagtctacttatttcgcttaaaacacgtgctaatttttaaaacatatcttcacacctcatgaaaataagaggcattgtgtttaaaatgtatttttttttgtttctttcccattaaaaatttaattgtggtaaaattatataacataaaatttgccattttcaccatttataggtgtacaatttagcggcattcattgcatttacaatgttgtgtagccatcaccactatgtctatacctttgtgctatattaccctacgtagatattatgggaagaaggaaaaattcttcccataatatctacaatggtatagaattgttaaatgatttcttaagatagttttattattttagatctggattaagaaaatcctttggtaaatgttatagttggatctgattggccagaattcaaaccagcaagtaccttattcaatagctgcttttgtaggcacaggtattccagtaccacagggtaatgagtatttcaaacaaaagagggttagagatatgtctaatgtttattgccataccctcaccctctgggctttgatctttctggtggtcttaagttactactatagatttcttccttgctcataatatctatttggcaatgggactgaaatctggtaacttctattgggaacaaaccattcctctccactgtggaaatggctgttgtctcataagtattctccctcctgctcccgactgttaatactaaatctttgggtaaataaagttactcatctgtacaaagagattggagaccagtctaattcccctatttgaaggaagccccagagagttggaactaatagttaagtgatgcatttagaattagaacacacctgttccaatctccaatcagggaagttgattgtcttgtggtggttgaagaaacagagagggacggggtcagcagaaaaacctatgaataaacctccagtgccttatggtttttcctgaagtcagaatttagagcttgacaaaatgaaagtatttatctagttctaacccactctattaaaaatgaggaaactggcgcagagtgactgtaacttaaaaatatataaccagttagttgcaaagctagaactggacacccgtatgtcttgacttttgccctagtgccaaatatatgagagtgtgactctggccctgcctctaatagtttatttgcctacaagatatttagtggaattgtcagtgccacattactgtagaattatttcaaaagaaatatttttgatattctggttttgtatccccttctaaccaattaggaacaagatatttttagtgccagttaatagtgcagtctttcagcagaaaggaatctaaatcaatatgcagtgttaaattcactttaataaatgtgaaaattgtttttaaagtaaccattgattataaagagagatgctttctatacattttggtgggtacatatacagtatttttctcatataagtgaatacttactatatactattttttaaaagcctaaagtcctacagaacataaacatataaggcaactgaaatctgtacaccttctcaatatataaaataagtgaatatttgcttctaatgaaagagataaagattagataacttcaacaggggaccttggcatatgtctgataatagatatgagacagggatagcatattgattaaaaaagtcatggactttggatctggaatttttaggacccggattctcactgaaccagttacttgatctggggctatagccaagttatttaacttctctgaaactcgatttccttatctgtaaaatggggataaatatgctaccttagagagttatgagaattaagtgagttaataccagtacctcttagaaaaatgactggcatatagtaagtactcaatagctgtaataataataataatataccaatacatactaatactaataaagtatctgttactaataattttatcattgctactgttgctcttgttggaagattatggtaaaggtgacatgtgaacagataatccttttatgcttctatggtaagtataggactttttacctgtggatgcttttgactacttggatttaaatacaaatattttaatcataattaaacaactattaatgaaattttttgttaagaaaatatttcccagtccagatggttccactaagccagctccttgatcagttttctgtaccatgcagttaaactattttttccattttcatgtttatgttcctgaaagtatattcattgggattacttttttctgtttaaatactaaaaccaggctttttaaagtatcaaattgtattaatcatggtttccactattttaagtcttcttttgtactggtattgaagtacattttttttttcttcatcattatacactaatgtactaaccaatatagcttttttaaagaagcattgttacacctccctgattatgcttcatttaaaatgcagtcccctacagtcctctccaccaatccccacccccaacctttatattgttcttaacatcactttcttcaataactctggagtgagggagcataaacagtaggttatgggtgaaagtgaaatggccccatagtgctgtttctgatgactagaagagtagcatggctgagtcttgcagtacaccaagatgttctgcatgagaggataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgctaactggactgatcactacaactgtctttattttctgatgattataatgcattttatctactagagttgaggttttagctgagtgatcactttcaaaaagaatgattagtcttgatcaatagtgtattacctatagatgagacttttagcataatgcaatttccttagctggtgttgagatccatttcatctgttcaggaaatgaaagcaggagatatatagtactttggattgtttgtattgcagattagctaaatatttgtgggaaatcagaggtctaaaacatgcttaaaattctagtctgatatctggataaagaaaatgcagtacatatacaccatagaatactatgcagccataaaaaggaacaagatcatgtcatttgcagggtcatgggtggaagccattatcctcagcaaactaatacacgaacagaagaccaaacactgcatgttcttacatataagtgggagctaaacaatgagaacatatgcacatggaggggaacaacacacactcgggcctgtagcaggggagggagagcattaggaaaagtagctaatgcatgctggacttaatacctaggtgatgggttgataggtgcaacaaaccaccatggcacacgtttacctatgtagctaacctgcacgtcctacacatgtaccccagaacttaaaatttttaaaaaaaaatctagtctgttatatggtagtaacagactattagattggtgcaaaagcaattgtggtttttgccattaaaagtaatagcaaaaactggctgggcatggtggctcacgcctgtaatcccagcaattttggaggccaaggtgggcagattgtctgagctcaggagttcgaaaccagcctgggcaacatgctgaaaccccgtctctactaaaatacaaaaaattagctgggcgtggtggtgtgcgcctatagacccagccactcaggaggctgaggcaggaagaattgcttgaacccaggaggcggaggttgcagtgagccgagatcgtgccactgcactccagccttggcaacagagcgagactctgtctccaaaaaaaaaaaaaaaaaaaaaggaacaacaaaaactgcaattacttttgcactaacctaatacaatctcattaagcacagtaactctgcattgtgtattgtagaagcaccagaattttcttacaaatgaaatgataatggctttttgatgtgttccctagaaagaattgtggtccatcatcttttcagtagatatactttttgttatttagtgctttaggtgttatttgctaatattacagccaaaataaaataggaatgtgcagtggaactcatttcttctctgttatagctggctctttgaaagttgtttgaggaaactctaattacctacagccctgcaatgaattgcacaacagatgtactgttttaaagtcttgattcttgcatgcatttttcaccttttacttcagttttagtctttgatttggaacacttaatgttaagcagtataaatgtgtctttctaggtgacataattggattctctctctctctctcttttttttttttttttttttttttgtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgaaattttgcattttaggtaatattcaaatgacatcatttcagtccttttgtttgttattacttctgacaaaagcacttttctgtaagcttttcatttattttactcttcagctatgaagtatttgattatatgaggacacaggaagaaataaggagtagcccatggccccagctaatgtgttagacatcttatacaggattagtgctagattagttccatgaggtgatttgaactgtcaaggtcatcaaaaacaaggtaagtctgagaaactgtcacagccaagaggagctgaaggagaatgatgactaaatgtaatctggtatgctggatgggatcctggagcagaaaaagggcatttaggtaaaaactaaggaaatccaaataaagaatggacttgagttaatgctgatgtatcaatattggtccattaattattacaagtgtaccattctaatggaagatgttagtaataggggaactggattcagggtatatggaagtctctgtactatctttgtaatttttttgataatccaaaactattctgaaaaataaagtttattcttttaaaagaacagcatcataagaggtgatctttctgtttagatgacctcttggtagtaaggtataagataactgtttaataaaagcacaaggagcataggtaggggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatactttcctggacttttgtagtgctattgttttagtttgttctatttctttttaaggttaccttctgtttatggcaagtgatactgtttcctgttaatgaaagtggtataataaaaaaaaattacctaagtaaagagagtcaacttaaaggagatttcctgaagaaagagattcagattatgagaagaaattggtatgagagagattctccattgctggcttgaagatggaaagggttgtggcacaaactgagtggcccctggctgatagccaacaaggaaatggaccttcagtcctacagctgccaacaacttgaatgaggttggaagtggattcttccctacaacctgtagataagagcccagcccaagtaacttcttgatttcagcattgtgagaccctacgcaaacaacctagctgagacacctggactcctgacctacagaaactgttagataataaatgtgtgttttaagccggtaaatttgtagtgatttgttgtgcaacagtaaaaaactaatacagcctataggctttgttcttactgctcttcaaacagagaccatgccctcctccaccaccaccaccagttcccctaacactgtgtctcagttcttttagtggttacccttaaaatagcaacatgtattatatacttaccaagtataatattagtcagtctcattagccttatctcagccaatgcaaggatcttaggacattttaactttattccttcctgatttacatgttaatgtctatcatatattttaattctttctgtacttgaaaactcagcaagacattattattacttacatagtcagtttacttaggttcattcacatatttatgttttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggtacatcatcattctgttgtcttctgatttctattgtccactgtcaaactgtcacttctttggagatactctgtccttttattacctctggttattttcaggtttttgctttgtctttatttttctgtagtgtgtctaggtataaatttcttttgtttatcctgccatgattcagtggaatcttgaatttgtagatagacacatctgatgaaaattctataaaaagatcctatgaaaaattctcagccatttcctcatagattttctctaactcattctctctttcctctcctgctgggaccccagttgacatacattaaatcttctcattattttatctaagtttcttaccctaattctgtgtttttcacctttttgtttttctccatggtgtattctggatcatttattttgacctatatttctcttcattaattttattcagctttcagttcctctgaaacccatccattgagttttaaattttggcttttttttttttttttttttttttgagacagagtcttacttcatcacccaggctggaatgcagtggcgtgatctcggctcactgcaacctctgcctcccgggttcaagcaattcctgtacctcagcctcctgagtaactgggagtacaggcgcgcgccactgcacccagctaatttttatattttcagtagaggcatggattcaccatgttggccaggctggtctcgaactcctgacttcaagttatcaacctaccttggcctcccagatcgctgggattgcaggcgtgagtcactgctcccagcctgtattttttgtttgtttcaatacctcatgtattttgtcttttatttttgctaattctaagatacggtatcttttcttgagagcatctgcctaccaggtttaggggataggacagctcatggccaggactgctttaatccaactttaagatttaaaattccatggaccaccagataaaagagagccaggctccaagtccatgcgaggccaggtttgttttgggttcacctccaccctaggcgtagcctttcagaacaaaacagaataaggtggaggttggtttatcaaatggactgtaggtattcactcactcattcattcctatgaggccctatgagtcctatggggcagttgcttcccaggggtggagaattaccctccaggcaaaagtagttttatgtgattgaactcactactgtgagttccctttttctcctagatcatcaactggcaaaatttaagtaccttataagatatttgatactttcaaaaaatgatggagaggggaaggttttattttgtttttcagtaggaaggctagtgtaggttatctatttcatgatcattggaagcagaactttctctggcttcttccttgtttctttgttttggtagtgaaagggtacccttttggtatggcagacatgatactttttaggggagaagtaatgaagaagtacttgtacaatagcagatgagccccagaagaagtctcctgttgttcgtatgcgccagacacaaccctttatgccttgttatttcctgtactgctgagaaccctctaaagtagctattatctccatttcacagtataaataaagtagccccagagagattgaataactggcctctcattatagttagtaatgagtaatgggcacatccaggatgcagccccaggtcttttgagctatcaagcccttgctctgtttatgttgtggtggctttgattcaaagaggaaaaagttaaagtctatcaggggctaaagtgcattctctcaaggggactttcccataattatggggtgtttgcagctggagtgtctgtacgtccaggttgcctgggcttgccaaaaggaagttgtaagttcattgtaaaatattaatgtgcagggattcttggttaatagaataaattattttttctttaaaaagttcaatggtctctcagtggagctgcctaaaaaaattcatgttaaaacatcttgttcttttacatgatctcaagccatctgtttgcatctatgatagatattcttcatgcttcattccctatttcttccctactggttgatataaagtaaaggattccattaaaggacagggcatagtaattgcatatgtcttgatttttaatgaattgataaacagtcattggccaaaatgtttctaattttatgatctcatcctgtgtctatttactggtttaaatttgtgctcaaaattgtcagtcttcagtccagcattaattaggaaccatgaagttttctttgtcatctgagtcttaattgagtttatatacctctaacttcacaaaaaggtgatcatgtggataatataagtagtttatttccatttaatgatattttctggtggtaagctattatagtgattgagtgtcatatttcatcttgccagatcatacaaactgaaatttttaagcaaactattaaaacatccaaaccaacaaaaagcttgaatgaattctgagctaatcattgtcacagctgattttgtaaacctttaggttgaaaagctttctgaattttaggagctatgtttggttcagttctctgctattacaaaatactattttgtaaaatgcctcaagtttataaggcctattttaaatcattaaagtatttaagaacagatgttattacatggtaaaagttaaaaagtctgctttctgagtcttagttatggtatcactggaaggattttgaattagcaatcaatgtctctagtaaaacaattatttttgaagatgtgtttaaaaaatagttaacatgttatatgattttacagcttttgtttacctttcagtaattggcattgacaaattaacatttttatttgtattagataagtgaaaatctcccccaaggtatcagagagctatagcttcaaattaacttaaatgtaactatgctaatgtaagtgtctggaagatggcacccatgtttgtgcatcctaaaatggatttatctatttgtccatccagtagcatttactgggtcttcattagcacagtgtcaggcacagttctatatgttagagactcaggatggataagagaaaattcctgccttcagagaactagtttagtcaactggtaggtcctttattaagagctgaccttcagttatgcataaccgtgtttgtgtagaatactgtaacccctaactttcctatttgtgtaatatggaaggccaagtgatgaaattgttattaaaaacaccaattcccaaacagtgtgccatgattttaatatgctaaatagactgtggcaatgttagatttcctttttgactcaggaagactgtgagggtgagtgagtgagtgagtgaggatgtatatgtgtgtgcatgaggagacaacagagcagaacccctagtctagtatgctttggttagttggtattcatcaaaccccaaaagattgagaaacatcgttgtttgagaccctaaaattctaaggtagagtgaggaatcatggaagactacattatggacctgatgagtttaatgcctgccatttttaactgagtatgttgatcataaaagaactgtagcttgtactctcattttaaatagactggactccttctgtaatagggattgtcaacaacaacaataaaaagaatggactcctaatgctagccagaataaaataggttgaaaatgcacagatttccatttccagaacaaaaaggcgtagacttacttttcactgccccttccttcctctataaatataactaaatgtcctggaaattattcaactgacagcaataaagggattctgaaagttgggaagaaagcagagtagcttggaacctcaggactagaagtttgaggacaatgagtataagttcactgggttttcttttaatctcccattttctcctagactgggtgctggagagacctacaacccagaatcaccagtgggcaaagaaagcagaacaaaaagcctgctttctctggctagaagaccaggaaagggaaagcccaacaaagacctaagtgggagtgctcatccccactgtttcacagtgggtcccggtgggcactctgatctgtccccattatggccccagttgctgcgggagcagcaaagcccctggccctcccacccactgctctacaactggggccatgacgggtggtttgttctgccaactacggtgaagaccagaccatttcagcccctgtggtctgctctgtagacagcagcagcaacagcaaagcccaggctatactgcctctgctcccaactggccccagcaggtggtctcttctgtagggagcagtaagcagctgcagccgcagcgaagccatgtgtcttcctgccctccacctcatggcttaaggagacccaggccccagtaggtgaccccctccccctcaaggtttcccagcaatagcaagtggccctgggaagtaccttttatccctgcagatggcatcagcagggattgagtgggagtcccaacatcaccagaagaatgaagcacaccaaaatagcattgtgagggctcagaaaactaaactgtcattggaactgaagcccacaaaagtagtctagaacctacacactaaacctaagcagggtgaccaccctgctaaaatagaagatcctgtcatcaagtcttctaacaataagcaaaacatccagggtacaattgaaaaccacttgtcatagcaagcaccacaaaatatctaggatacaatatgaatgaaaaaagacatcaactgatgccaatacccagttgaatcagatatgggaatttgataaggtttttaattcagctgtcatgcaatttatccaacagtcagttgcaaattttcttgaaacaaatgaaaagatagaagatctcaggaaagtagagccaagagcatttcctaatgaactggaatgtcagagaaaaaaaaagggtcaagaatggtgccataatttttggctaagctatcagaaggaaatacggagttgccttcaactgagatagcaagaggagagattagaaagctcagttcactcagatgttttgggggatctgattgccctttctcttgtcttccatgctctcttgtgtgccttattgattagcaggagtcattacggagactgagaggttggtccatccatgggaaactcgttaaaagtgagcattactaacttgcatactcacatgcagggagtttggtttcttacctaacttgaaaaattccccaagtgtttagatgtttgattttactatgtcgcctaaacagttacatccactatactcttattttcaaattttttcccctaaagcaattattttccagatcatctactttatgtctttagacctagaaactgattactacaattatgattcaaaacctattttctgctgccctgcactgagctgagtaattgggtgtaaatggttatttcgtttgcatgctttgcctttgtgttaagtgttttttggttaaaagaccagaggttgcattattgcctgctgaatatgcttatattaacaattgtaaaaaagtaaattacttttgggagtattaatgaataggcacttaaattgcatagttaaatcttttccatcctttactaagcaaacaattggattaccccccataagaatttaattgacaatttccatgccacatttgggtagggaatatttcttacagacaaaagttgtttgaaatcagaaggttcttagccatttcaatttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaagaggagtgttcctgtttagggcagaccctgctaggccttcctgtttgttatctccacaagatattgtaccttaagagcttgcctttagcactttttctttttcctttctgggcttcttacagtctttctatggggatgtttccagcagccccttggggaggggtttggggatatattcatgttttctggggctctgtcctctgtatcctgaagtgctgtcattagcagcaatggcttcaattacctctcattcactcatgctacctagggagtatagaggttaagaatttagatttcaaagttccatatgtttaggctccagtcctagctctaacatccactaactgtttgaccacagacaacctcttagcctcagtttcctaatctataaaatgaggctgatattatattagctatgatgacaaataaattatgataaataacaagaatctatgtaaacttcttagcagcatgcttgctgctgacatgttatattataaatgacagttgttgatgtcttcattatcatgacccgttccttgaactttatactcctatctatatgccctctataaatctctgcctggatattccatggaaaccaatattttccaaacatagccatgtgcttcgtttctttctcagccttctatcagttctttctcttgtaattcctttctcatttggtggtatcattcacccagtaactgttgccagaaatttgtaagttttcttacaactcaaccccaaccaccatctagctaatcattcactgtgttatcttgtgaatttattttcttaagtatctctctgtcgcctttactttatcacctcttgcttgggctaatgcaataacttcctgagtggctcccacccactccacaacgtctctcactctctgtcatagtgatctttggtccccttttccttttccagccacttctcaccctccagtttttcatgctagcagtaccaaatagcttgaagtgcccagcacacacttttttttttttttttttttttttctgagacagagccttgctctgttgcccaggctggagtgcagtggcatgatctctgctcactgcaacctccgccttctgggttcaagcagttcccctgccttagcctcccaagtagccgggattacaggcatgcaccaccatgcctggctaatttttgtatttttagtagagacagggtttcaccatgttggccaggctggtctcgaactcctggcctcaagtaatctgcccgccttggcctctcaaagtgctggagttacaggcatgagccactgcaccctgccagggcccaaaacaccatgccctgtgttttgacttggctgtaggccattgcacaggctattacttacctctggaatcctctcctttccctgcttagcccaacaaactcctattcattgtttcaagccctccaggatgtccgtgtgtcatagaggccttctctcagtaccatgctatccacagatttttaaaactcatagtgttatactatttctatactttataactttacactaacattatatataacgtatgtatacatacataatgtatatatgtatgtgtataatgtatatatacatatgtatacatacatatatagtatatatagtatatatacatataatgtatatatactatatattatatattatactatatatactgtatgtatattatactatatattatatgtatatattgtatgtatatatacatatatacaatatatacattatatatacatatatacatgtaatatatatacattatatatgtgtatatatacatgtaatatatatacattatatatgtgtatatatacacgcacacacatatgtcaacagcagcctactagattggaagttccctgaggacaagaattgctttattaatctttttcttgtttattctttatattctttgtcttattttcattggggaaatgaggtaaataagataaaatgtgcaaatgtcaatagaatttttaaaatcttagtgctttaatatttatttttgatttagctaagattgcctaaagtgtgtaaccaagtcagaattctcacttttgtaaggtttatcttcatatgttttcttgcttgtttctttccatgcatgtctaatctccttcttcacatttcttatgttataaaaatcttttttcttctctattaatagttcttgatatatcctccatcaagtgtgagctaacaaagacctagaatcgatgtccctctacattggctctaaccccagcccttctcacacacgcatgcacacgcacacacgcacacaaacacacacacacaccaatcaaattttccagaacctttgctttgagcagaaattgccttatgtgactggcagtcctctcataaaagtagtaaatgatgagtgtattatagttagactcagaccagaagatggtgtgctacatgaaatctaaagtgaagtctactaaacttcactgaagtatcaaggtgtgacagaggtactaattatgtcaatataagtactgagttagtaaatgctagtcttaactctgaattgttcagctttgacaggtgagctagatttgttccattagcttattggagattcattgctagctgtttcaaataaacctcccccttctattttcaaggaatgatctgaatcatactcctttgtcaagtctttaattgttaacatttaggcaacagttcctgagacttttattttaataattttccactccgtgtgtgttttttgcggtagcaatgagtaggaaaacttttttttctttggtttaatcactgtacctaaagcaactcagcttggtgaatgtatgtaagcatatgtgttggagctggggatgggtaccagaagtgttaaaaagtgtcaggacagcatctctgttcccttactgctatcacattgattaccgcgataatcattgtcacagctgattttgtaaacctttaggttgaaaagctttcacaaagctatcacaaagcacaggaagacaaggaaaggatttattgatgaaattatatgcataagctcttctttagtggcaatgactacactaaatagtgttgaaatagggaacagaccatcgttatctttaatcggtagagtttttatataaatttatatatgtctataattttcaagattttattcttactgctaatgttgtcatttatagttattttattttagctttgtttcctttttgcctacccaccatctatgtccctcaattcttaacgtcagaactgtataaaaagtagtaggaagacacagatttagaaaatgggtagagaaatatctagaagcaccatgatttctcaaaattttatgtacttacataaaattgcgttacttaataaatgtatcaatggcttattcatttctagtttgtcatttttcttatatcattcaccagatattttttgagggcctaatgtgtactgggtactcattaagtttatattttaatatgaatacacacacataaatataacattacatattataagtatatatgaaataatataaatacatgtatgtgtgtatatatgtgaatacacacagtttattctcattattcatggtagttgtgttctataaagttaccatgaatgctgaatgaaccaatactgaaccattgctcctaggggaagtacaaggttgggttccttcaaacctctggtcacaacattttcatcaaccgatcaatacataaccttgttttatgtgtgcttctgtttaaagatactgcatgtaatatatactgttgattcattaacattgaactcacagccaacattgttataactcatgcctgaaggaagcttccctaactcacgtattttccccataaggcacatcacagccttcttgtgcttaggaacactagacagtcccttcagcactatgcttggtgaccatattaaacagcaaaatcaccaagaaaaagcgcaaaatgcaaaaaaatgctctaaatagactttgaaaagatgacttgttgatggcatgagagctgaaacaagaaggcagagcatcatcttgtttgccctcagctggcatcatgcacattgggtgattcaaatttttcaccattacatgcgtgcctgtaaacgactgaaagtgccatgactgttgatttgggggttataagtgaattttaccaagtaggcgaatttacagacatgcactctgcaatgtaatgaggatcagctgtatatcaactttgtgtgtgtgtgttgtgtatatatgtgtgtaaaaatttgttcttggccttcactttccccatctttgtcttttcttttttaaatcattcacggttttcctacgtatcttgtggtacattgcacaattcattataaatgtaatggggcttctaggcctgttgttatggacagaaatttcattgcgtttattaaaggtttcctgagacatgatgtgtttttgtttatagacctctcatagggtgaaaatttaacatgtaactccaaagtttatatgtagcaactcaaagtattattttaaatttattacaattagatataaaattacaactgacaattcatattgactttattatgtttgagatgcagtgtttttttgaagtgccttcaaaagccctttgtgctcctccccaatcacaaccccctccccctcaaaccactatcctgccttttatattaatctttttaaattctctttatagctttaccccctatgtttgtatctctaaggagtatattgtttaatcttttagaactgagtagcaaacacaaacttagctgggtaaagaaaggacaatattactactattgtatgaagacttaggagaagagaagctgaacaagctcttgttcatagtctggcttcagatgttctgagagtggttaggagcccattctgggaagtcggttggcaaggtcatgcacaaataaatcccgagacaaggggctcttcacaggcaggacatttccgctgtagtgcaggatagggggaggtactgagcacccagcaggaatttggtggggggcactggctgccctgcatttcctgctcttcagctccctgatgcctgcctcccattctcaggaataggtcaaagcaggcactgctgtagggtgaaattaagagtcctctgctagtctaggcagcagagaaggacagaaatctcctcagccaattgtcaggaaaagaaaaacagaagaatctggatgcagctcacctacctattctgttttcaggttaaaaaggtggcccgtggcagtggaaaactgatggctctcagtctggattggttgtcctctgtgcctgaggcacagctgtcagcctgagatttcccttccttgcattcctggggattcccttcatctctcttctgtgttggatctcctatttgctgtctccaggcatgctttttattggtctattcttgttttagcaaacacgtcctacaataatttcttcagaaagtgtgcatggcaagtaatttattgaccttttttgtctgaaaatgtccttatggttaatgatggtctggctggatgttgaattcaagattagaaatcattttccttcatgattatgatggtgttgctctattgtcttctagcgttggcattgagagatccaaagctattctgggtgaattgtgtcatccttcctcgctgcacatctttacccccacttctggaaacctgacaatctccttgtccacagtgattttaaatttcacagcagtgtgtgtatggacatgggtcatttattttgctgagtacttggtgggtccttttaatttgagctccttatgatttaaattctgggaagttttcttggattattcccttaatttcttccccttcattttctttgttatttatgctctgcttttcccaaattatcggccaacgcttctattgataaatttctctgtgtgtttttcaagggctcttttgttttctgaaagttctggtttttgtttcacaattgtgatatctttctgaggatattaatggtaatttgaagtcttattgtgtagtgtgtttcctctaagttgctctttttgtttgtttttggttctatcttccaaattagagactcttcagatgtcttaggagccttggttgttgtatacttatgattagaaatagagcaatgattctcaactgggggcaatttgaaccttccgtaccccaggaggatatttggcaatatctggaggactttttggtggttaaagctgcagggggtgctatgctactagtatctagtaagtagaggctagggatgttgctgaacatcctacaatgcataggacatccctgcacaacaaaaaattatctagctcaaaatgttaatagtgctgatattggaaaccctataatagagggcctcaaagctgattaagagagctccgaaggtgcaggtggaacgtgttgactttgggttttgctggaggatgatctagttgagtagtttggagaacctcttcattatctttaggtcttttcttctgagctagtcagatattcaatagaaaagtctttcatctcctgccttaagggtaaagatctggcttccaatattccccctgttagtcaaaaagggactcgggctgtctgcgttcagtgtatatgtgaccacataatacccttgcttttcatataatacccacttcctcaacagccttgtgtttccagttgtgagaccctacagtttggttttttttttttttttttgagacggagtcttgctctgtcacccaggctggagtgcagtggtgcgatcttggctcactgcaagttccgcctcccgggttcataccattctcctgcctcagcctcctgagtagctgggactacaggcgcccgccaccaagcccagctactttttttcagagaccctatgttttatttactctttccagataattaacctgttgggatgagggagcggcagttatccatggtatggagtacaggagaccacctagggctctaactgcttctctaacacatttcattcaaaccttgttactttaactctaccctctcttcacttccagttccagagttatctggaacccattcatgagtttcttggggattctacagtatagatgggtttggttctgaactttccttattatctctttgcagttcagcttttccaggtctgccaagtcaattaccactctccatctgctttcttggattccaaatttaattattactattatctcctctcttgtactcccaatcctttttaaaaacccctttggtatcattgtagtggagtttggatagggaaataaattagatacattgtgctcaatctatcccatgatcctggaaaccaacatgctgtattctagcataatttcatttaattctagtcttattttggtatatttacctttgttatcagaattatttcctagacttaggttttcttcacataaatgaaaactagaggatattagtctgtgtctgcatagggacataattgaattcttttcaaaaccttaggggatattgtagtgatatattcacttctaacatattctggtttaatttacctttttgcttaaaaacatagactgctgtaagcagccatctgcctcaagtagaaccttgttttaccatcccaatcaatattcagaatttgtaaagagttgaataaagaatatatatttcattaaatctgaaatgctgtcaattatctttttccatttttaatacggtcataattagtggaaatatgagaaagatagttgtttatgatgacggcttataactatctctaccagtattttcccccacataaatattcaagaattgactgtaccttagatttaaaattttaagggtgatttcaaacatcaataaaatgtacaggccagactgaaacctatacctcctgaatttttgctgttccctaaactgtcatccaagcataagtaataagtgtaatatagtaggtgtgttacactactttatcactcctccctttttaagatgggaaaccaagccaaattttaaattttttatcagtttctgctgagtttccagttaatgggttaaatcgcaaaaacctcaaaacgtattttagtatctttttagggtgttaaatttggtttaccattgttaaccccctggatgtcattgacggacagacccttaaaatgctttacttgtaacctgtcttcaggtcttcagtagttcatagatataattattttctttgcctcgtactataaaattaaagaattggggatttgatttgatttttattcacagatttttaaaagtttgtgttttgttgtctaagtattctcttttctccctagctctattaattttattgttactaaaagaaaaggggggagaagatatgctttcttcctcacctttgttcaagcaggaaaaagtaaagaattgactcgattgaccatgaacaatcaaccccacatacagatgttgggaagtttccaaaaagatacagtgaattgaagcagactattcaaatgtatcataaatagagtcccaagggtttatgtgtggacaaaaaccaattacatgaagcatttcctgaaattgcttgctattgtcaggataagtaatcagaagtaagacatccaggttgagaatgaaaacgtttgtccctcagtttgtaatattgtcttctcacagaggaaaatctttgaacagttttgagggattatcaaaaggatcctctttctgtagagttttgaaagatatattattaccatttcttttcctcccaggttagcttttttaggttgcttgaaaagagagatttgaagctgtggtatagttgatgtcctcatgatgtcatcttggataaatgtttaagtctaagattaaatttagtagttcgtcctgtagttgaaagaagaaaaactttaaggccagcagtatcacaagtgtagtactgtaaatgaagaacttttctctatctgctaattgagcacatgcatctaggtgtactgtttgtacctgtaataagcgaatgaaggtggtttttttgtttgtttgccttctccccaggagggggaaaatacacgcatgtatacatgtacacatgtatttaatgaccaccatattaaccttcaaataaaccaatcacattgctattgcattctgtattttatagtcaattcacacacacacaaatctatatttggattatcttaactgagttcagatatttcttttataactggtaaccacagggaaccgtgtgtgtgtgtgtgtgtgtgtgtgtgtgtgtgtgtgtgtgtgtgtgtgcgcgcgcccgcgcgcgcgcgcatgttccctggaccagggtatgggcatctttaaatcatctcagctgattcaactgtgaggtctgggtcagcaaatagctagaccagtggctgtgctcatagaaattacttcctttcctctagtaatttcaaacaattctaatttgaagtttgaggaaaattaaggatttctctgtgatttcaggtgaaactggagagggttggagaccaaaccacgcaggcctttctctttgtaaagtgtttgttcaagtcttttgcccagattttattggagtgtgttttttttcttattgtatttacaagttacttatatattttggttcttgacttggactgtatattgcaaatactttctctctctctggtgttttaaacagggatatcatatcagattttcattttttaaatatcattacaagaatgaatgggagaaacaagtttttcagtggttctagtagaagatggtaggatgtgggacatggagagaagaggacaggttcaagagatatttgagataaactcagtaggatttgttagtgatgattaggtaaatggtgggtaagatgagagggaagtgtcaagaatggcttgggtttctggttcataagaataccaccattactatggacttcacttattttgtttaagatgttgataatctatatagaattgtacagtcattatttgccttgagcataagactactatttagaatttttaaaaaattactgcaaattgcaaatttattggtcatttttatggttttggtaatcttttaaaattatctcatgaattatagaaaaatatgttggaagttatattacttaaattttattttgaaaactgtgttcaatttggagtctaaagtagaatggcaaacattatctatattatatagataatgaaacagtaagacattaatgggaaataggaacttaagagaatcaatgaattaaaattgactttttgttttataggggtcccttcagtgttgtacgacgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattgttataaataattaaaataaatattaatagcttctttttcaacccaaaattatcaataccagagttttgacttatctcattgttgtaccaaattctaaatctccccaggctaaagacattctttcgggaaacaattacttaccttctcattggctgaggttgtttattgacagatttcttcagccagatctcttgagctacagactcagaatgccaagctgaacctgtctcttgtcacttggtcagggagtcaaattccaaatttacaaaaggggaaagtacttagtatatagttcatatacctggtattaagtcctgtcttcatttaatataatatatgggagtctgttgctgaagttatagctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccctagccttatgggacctatgttttaatagtctccaaccattgtttataacatggtttttattaggaaaacaatgtgtaataaattcgaagtaaatcatttacaaattaattttttttgagatggggtctctctcttgcccaggccagagtgcagtggtgcaatcatggctcattgcagcctcgacctccttgggctcaggttatcctcccacctcagccgcctgaatagctgggactacaggcatgcgccaccacacacagctaattttttgtattttttgtagagatgaggttttgccatattgttcaggctgatctcaaactcctgagctcaagtgatctacccacctcggcctcccaaagtgttgggattacaggcatgagcctccactcccagcccacaaatttacttttgaaatgaaatgtgttgatttgttgcagaccacctgtacgttttaatattttaaattctcattgctctaatgaagatgagatattataattggtgaggctaaagatgagacatttcataacagatgagatatttttgaatatctgttctctacttttgccatcaaaatcataatttttattttatagggcttcttaacttgcaggttgccgactattcaataatcccttgaaatagtaagcagaattatgtttatttttttagagagtccatagctcttattagattcctaaaaaggcatattattcctaaatgatttagaatttctcctttcacatgtatgaaaaaatgaaattcatgcttatgaacatgagatgaataagaagtttctactaaatcaaaactggatgaatttatattaggatatgacttctgattgggggattttttatacttacatatacagcttccattaatgaatttcctagattattatcttgaacttttaattaatatactttttgtctcttactctactgagccactaatttagagtttttgtcttaaaaatagatatcaaaattaattcagacaaattataataaggaaactaaaggaaagtaagatgtatagaattggaaactaaattatcaaagttctgagttcttgataggactcaattctttatggtttattataaaagtccaaaattaactgtttttatttgggagtattataaattgtgttctagaaagagtatattttgggctccagtttgcttagtcttcaagaatgtctcattctaaagtcccagatagtaggtgatatcagtgaaattgaagaagtaaggaccttgacagttctcacttttcatttaaaaaaaagagaaaactgacagaaatgtcagaatcaactttttcagggctctggaaattgaccaaaggcttacagctatccaggaataatttattcaagaaaactgactgattcttagtaacaacagtgaacttcatagcattgtataataatttgtcccattcacatccccctttcttccagttctgtagtaaccttgaaaacaaacagttcacaatcacgatgaaaaccagcaacttgacagccatcaaaggaggctgaatggggatggagctcctctaaggccgcattcccataatattgtcatttttttacttgtctggtagttccctggaagacttgtcttagtacatttgtgtttctataaaggaatacctgagagtgggtaatttatgaagaaaagaggtttatttggctcatggttctacaggctgtacaagaagcatgacaccagcatctgcttctggtgagggcttcaggaaacttccagtcctggtggaaggggaaggggaaccagtgtgtacagagatcacctggcaagagaggaagcaagagagagatgggaggtactaggttgtttttaacaaccagttctcatgataactaacagagtgagaactcacttgttactgccaggatggcaccaaggcattcatgagggatccacccccctgactcagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggggataccatcaagcataccaacatatgcataatgagaatttcaaaaggaatggagagaaaggagtagaaagaatatttgaagaaataatagtccaaaacttcttaaatttgatgaaaacataaatctacacaaccaataagttcagcaaactccaagtaggataaatgcaaaaacaaaccataatcaagttgtcaaaagctacagacaaggggagtatcttgaaaatagcaagggagaactgaatcatcacatacaagggatctataaaaatattaacagcagatttctttcaaaaaccaaggatactgaaaggcaacaggataacattcaaagtgctgaaagaaaaataatatctaccaagaattctttatccagcaaaaccatacttcaaacatgtaggataaatgaagatattgtcagataaagaaaaacggatagaatttgtcactagcttccttgtcctacaaggaatactaaacgtagttatttatgctaaaaggaaaacttatttttttaatttttaatgtttatgggtacatagtaggtatatatatttataggtcacatgaaatattttgatacaggcatgcaatcacatcaggataaatgaggtattcatcacttcaaacatttaacctttgtgttacaaacaatccagttatattctttcagttattttaaaatgtacaattaaattattaaattatttttgactgtagtcatcctgttgtgctagcaaatactaggtcttattcattctttctattttttgtacccattaaccatccctactttccccaacccctactagccccccgcccccccaactaccctttccagcctctggtaaccactcttctacctgtatcctcctgacttcaattattttaatatttagctcctacaaataagttaaaacatgcaatgtttgtcttcttgtgcctggctcatctcatttaacataatgacctccagtcctatccatgttgttgcaaatgacaggatctcattcttccttatgactgaatagtaccccattgtgtatatgtaccacattttctttatctattcatctgttgatggacacttaggttgattccaagtcttggctattgtgaatagtgctgcagtaaacatgggagtgcagatacctcttcaatattctgatttcctttcttttgggtatatacctaggagtgggattgctggattgtatgatggctctatttttagttttttgaggaacctccaaactgttctccatagtagttgtactaatttacattctcaccaacagcgtacgagggttaccttttctctacatccttgccagcatttgtcactgcctaacttttagataaaagccattctaagcatagtaaaaggaagtgtagtaaaaggaatgacaagaaatcaaagtagaacaccataaaatatctatttaacacaaaaggaggcagtattggaggaatacaggaaaaaaaagacagatagaaaaccagtagtaaaattagaaacataaattgtaccttgtcagtaataatattaaatataaatgaattaaacactccaattacaaggcagagattggcaacatggatgaaaaacaggtgagatggtatctcatgtcgttttttgctgtctggaagagacatacttcagatttaaaaaatacatataagttgaaagtaaatgagtagaaaatgatatactatgcaaatagtaaccaaaagagctctgaagtggctattactaatatcagatgaaatagactttaataattaaatcagaaatttaatagtcaaacaaattgttactaaagaaggacattttataacaatagcagcattaatccatcaagaagatttagcaattataaacacatatgcacctaagaacaaagctccaaaatacatgaaacagaaaaaggcagaattggagggagaaatagagaattcagcaataataattggagacttcaatacctgacttaataatggattcaacaactaaacagaagatcattaaagaaagagaaggtagatttgggcaacactagaaaccaactagacctaacagacatctgtagaacactccactcaacaacaggagactatacattcttttcaagtacacatagaacattatctaggatagactgtgcattagcccatcaaatatgtctccatcaattttaaaatatctgaaatcatacaaagtatcttctctggccacaatggaatggaatcagaaatcaataacggaagcaaatttgggaaattcacaaagatgtggaaattaacatagtagccagtgggtcaaagaagaaattacaagaatactttaaaaatactctgagatgaatgaaaacaaaaatataacttaccaatatttatgagatgcagcaaaagcagtgattagggggaagtttattattgtaaatgcctatattgaaaagtaagaaagagctcaaatcaataatttaacctttcactttaagaaactggaaaagaaaactaaacttgacaggcagaaataaggaagtaataaggattataggagacatagagactagaaaaacaatggaagaagtcaataaaaccaaaagttgtttctttgaaaaggtaaaaataaaattgagtaggctttaaactgaccaataaaaagagacaactcaaagtaataaaatccataataaaggaagggacattactactgaccttataaaaatgaaaaggattataagagaatatgctgaaaaattgtatgccacttaattagatagcctagattaaatgagctaattcctagaaagaggcaaactaccaaaactgactcaagaagaaatagaagatctaagtaaacctgtaataagaaatagactgatatgtactcaaaattttcccataaagaaaagcccaggcccagatagcttaatggtgaattctactacatgtttatagaattcatataattccttcacacatatttctgaaaaataagagagggaacacttctcaactttttgtataaggcctgcaataccctgataccaaaaccagacaaagatattgtaagaaaggaccaatatcccttatgaatgtaaacacacacattctcaagaaaatactatcaaactgagtttagcaatttaaaaaatgttctgtagttcttcagaaagttaaatctaaggttatatgacccagccattttactcctagacatatgcctaagagaaatgaaacatatatccagataaaatcttgtatatgaatgttcatagcagcattattcataatagctggaagatagaacccaaatgtctaccaactgatgaatttataaactaaatatggtatatccatacaatggaatgattttttcaaccataaaaaggaatgacatactgatataagctacaacatgaatgaatcttgaatatattgtgctaagtgaaagaagcaagtcacacgagattacatatgttctattcatgtgaaatttccagaataggcaaatctatcagaaggaagtaaattagtggttgcccagggtatggagaaagatgagatggggagtgtctggtaatgggtatgggatttcttttcgaagtgattaaatgttcaaaatttgaacacagtaatggttgcatgactgtgaatatactaaaatccattaaattgtatactttgtggacaaattgtatgataagttaattgtacctgaataaggattttttaagtaccacgagtaagtagaattataacagaaattcaagcttgtttaaacatttaaaaatcaacgtcatacaccttattaatagaaaaatgaacaacagtccacatgatcatctcagcagacaaaaagcatttaacaaaattcaaccccctttcatgataaaaacactcaacaacctacaaatagaagggaatttctttaaccttttaaaagacatctaggaaaaaccaaagtctaactttatatttaatgttgtaagataatgctttcctccgaagatcaggaataagataagagtatctgttctcaacatgtttattcaacattgtactggaaattttagccaaggcagttatgcaagaaatagaaataaaagcatccagattgaaaaggaagacttaaaatgccctctattggcatataacattatcatgtatatatgaaaatccaaagaaattcacaaaaagacttagatgtaataagtgagcttagcaaggttgcaggatacaagataaatatacaaaaaccaattgtatttgtatacacaagcagtgaaaaatctaaaaatgaagttaagaaagcaattccatttaccacagcatcaaaaagaataaaatacttaggaagatatttaaccaaggaagtgcaaggctaataaatggaaaactatattgttgagaaaaattaaggaagtcctaagtaaatggtaagatctctcgtgtttgcctactagaagacttaatattaaagtgaaaatatttcccaaattgatctatagattcagtgctatctctatcaaaatccctactggcgctttttgcaaaaattgacaaactaatctaaaaatttacatggaaaagcaaggtaccccgagtagccttaacaatcctgaaaaacaatggacaaagttggagtactcacatttttcaacttcagaattttttttttttttttcctggagacagagtttcactcttgtcacccaggctggagtgcaatctcggctcactgcaaccttcgcctcctgggttcaagtgattcttgtgcctcagcctcccaagtatctgggattacaggtgtgtgccaccacacctggctattttttttgtattattagtagagatggggtttcaccatgttggccaggctggtcttaaactcctgacctcagatgatctgcccacctcgcctcccagggtgctgagattatagccatgagccactgcgcctggcccagaattttctataaagctacattaatacacatagtgtaaccctggcataaggatagacatatagattgatgaaattgaattaacaatccagtagtaaatccatatatttacagtcaaataattttcaactgtggtgccaagacagttcaatggagaaagaatagtttcttcaaaacagtggtattgggacaactggaggctgacatgcaaaagtttgaaggtggacctctaccctacaccatatacaaaaattaactcaaagtagatcaaagatctaaatgtatgagttaacaccatgcaattttaaaagaaaacataggcataaatctttgtgaccttggattaagtagtggtttcttcattattacacctaaagcacaagcaaccaaagaaaaaaatagataatgggattcatcataatttaaaatttttatgcttcagtagacactatcaagaaagtaaaaagaggctaggcgtggtggctcatgcccataagctcagtactttggaaggccaaggcatgcagatcacttgaggtcgagttcaagaccagcctggccaacatggcaaaaccctgtctctactaaaaatacaaaaattagccaggggtggtggtgcatgcctgtaatccaagcttcccagctactcaggaggctgagacatgagaatttcctgaactcaagaggcagaggttgcagtgagccaagatcatgccactgcagtccagcctgggtgacagagcgagactgtcccccccacccaaaaaaaaaaaaaaaacaaaaaggaaaaagataatacacagcattgggggaactatttgcaaatcatatatttgataatctagtatctcagatatacaaagaactcttgaaaatcaacaataaacaaaaacagataacctgattaaaatgataatggatttgaatagacatttcttcaaataatatttacaaatggtcaataaacacatgaaaagatattcagtgtcattggcttttaggaaaatggaaatccaaaccataatgagataccacttcacacctactaaaatggctgtagtaaaaaaacaaaacaaaaaacaacagcatgtgttggcaaggatttggagaatttggaaccatcataaattgctattgggaatacaaaatgatgtaaccgctgttgaaaagcttggcagttcctcaaaagttgaacttagagcaccctatgacctagcaattctcatcctaggtatatacccaaaagcattgaaaacatatgtacacacgaaaactggtacatgaatagtcattgcagcattatttgtagcaggcaaatgtggaaacaaaccaaatggtcatcaactgatgaatgggtaaacaaaacgaatattacatacaatagaagatttattgttcaaccttaaaaaggaattaaaggtatgcaaaactggttcaacatttgaaaatcaattaatgtaatccatcacgtcaacaagctaaagaagaaaaattatttgatcatattagtagatggagaaaaggcagttgacaaaatctaacaccctcaacttgataaagaagtctacaaaaaaaaccctacagctaacatcttacttaatggtgagaaactgatgtttttcccctaaaattgggaatgaggccaggatgttcctgttccctactcctgttcaacatcctaccagaaacccttgctaatgcaataagacatgataaggaaatgaaagctatacagattggggggaaagaagtaaacctgtctttgttctgagatgacatgattgtctatgtagaaagtcccaaagaatcaacaacaacaacaaactcctggaacaaataagggattatagcaggttgcaggttacaaggttaacatataaaagtctatcgctttcttacatgccagcaatgtgcaagtggaatttgaaatttaaaatataacacattatattaacaccaaaaaattgaactgcttatgtataagcataacaaaatatatacaagatacatacaaaggaaatttctaaactttgatgaaagaaatcaaaaaagatctaaataaatagatactccacgtttgtggataagaagactcaatgttgttaagaatcagttcttaccaacttgatctgtagattcagtgcaatcccaagcataatttcaggaagttactttgtggatattgacaaattgatctaaagtttatatggaaaggcaaaagattcagaatagacaccatattattgaagaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaaaaaaaagactcctagaactagtgagtgcgtttgtcaaggatatgagataaacatacgaaaaatcagttatttctctatactcgcaaagaacacctggaaaccacagttaaaaacatagtaccatttgcagttgcttaaaataaaatgaaatgcttaggtataaatcccacaaaacatatacaaaccttgtatggtgaaaactacagaactctgatgaaagaagttaaagatctaaataaatgaagagatgtactctgttcagggattggaagactcaacatagtaaatatataatttctccccaaatctatctctagatttgacccaatttcaattaaaatcctaggaagattttttatggatatagaaggcttatcctaaaatatttctggaaaggaaaaagaataagaatagctaaaacaattttgaaaaactatgataaagtgggaggaatcattctacccactatatagatttatatagctataggaattaatatagagtagtactggcagagagatagacacgtagcttgatggaacagattagattacccataagtacccccacacaagtacagccaaatagtttttgagaaagattcaaactcaattcaatgaagaaagagtaatttttttctacaaatggtggtggagcaattggacatccataggccaaaaatgaacctcaatttaaacctcatgccctataaaaaattaactcaaaatagatcatagatttaaatataaaacataaagctacatagcttttttttttgagacagagtctcgctctgtcgcccaggctggagttcagtggcgcgatcttggctcactggaacctcccatcccgggttcaagtgattcttgtgcctcagcctcctgagtagctagctgggactacaggcacacaccaccatgcccggctaattatttgcatttttagtagagacggggtttcaccatgttggccaggctggtctcaaactcctgacctcaggtgatccacctgccttggcctcccaaagtgctgggattactggcatgagccaccatgcccagccaagatacatacttttgaaagaaaatgtaccctaatatcattaggacatggagggagatgaagaattcttagacatgacactaaatgcacaattcgtagatgaaaaaagaaaaacaaaaaacctcaacagtaaaaaataaaacaaatagtccaattggatagtggttaaaagacatgaacatttttcccaaaaagggttatacaggttctaaacaattacatgaaaatatgttcaacatcattatccattagggaaatgcaaattaaagccacaataagatatcgctccacacttaatagaacagctacaataaaaaggtgaggccaggggcagtggttcaaacctgtaattccaccactttcacaggctgaagcgggaggattgcttgagcccaggagttcaagaccagtctgtgcaacatagggagaccctgtctcttaaaaaaaataagtaacaatatgacaataccatattctggcaaggatgcagagaactggatctttcatatatctggtgtgaatataaagtggtacagtcactccagaaaagagttaggcagcttctttaaaatactaaaacatacatttgccatacaacccagcaagtgtactcctgggaaatgtacatcctaaggaaatgaaaacttatgttcacagtaagacctgtaatcaagtttttatagcagctatactcgtcatagctaaaatttggaaagtaccaaaatatcctacaatgggttaatggttaaacgaattgtgatacatctataccatggaatcctactgagcaataaaaatgaaaaatctactgatgcatgcaactacttggatagatctcaagaaattctacttcgttaaaaaaatctcttaattgtcgtgtactgtatgatttcctttatataagtttcaaagtgataaaattatagaactggagaacagattagtgattgtcaggtgtgggacactgcaaagtttaggtgaggattgtgagatgggtgagtgggtgtgactagaaagggttagcacttggggtttttgtgggggattattatgtagcagttctgtatctctgttttggtggtgactacttgaatttacacatggcgataaaattgaatagctgtgcacatagacacatgagtgcatgtaaaactattgaaatcgaaataaagtctgttggttgtatcaatagtcagtttcctggttttgatattgtactactgttatatgctactatgggggaaaatgggttaaaggtacacaaaatctctgtactacttttgcaactttctgttaatgtacaattattttaaaattttaaaaaattgtaaggtttcccttatgaactgtatgctcttccatgaaagagataattagcccacaaatatttaggagtataggtaaaagcattttaactacaggttttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaatgagagtcaattttaaatacgtctgtttcttaatgattaattttgctgtattatgacaagcatttctggataactatttacaatgagatacaaatattacaaatgtaaagtttatacttgtcttgctaatcagatcctgctattctgtgaaaaactgctgatgaatctctaaacctaagacaatttatagtgattatgcttgagatcaactgcatgggaaaagaaaacttacttctttcatcttgttttttgccttttaaaaaatagtgtagattacctacttctgaaagtatgtggctatttgttaactaaaatgactcatacttgttcaatataattctaggtgtaaacatggcttgatattacatgtaacatgttggccataatccccaatatcaacgttttatttgtaaatgtctcttaacctgaatttctcatcttatatgacttcagtatgtagatgaggaggctcatgtttatataatagagctctcaaagttcattggctcatatattcaatttttcttagtatcatcttaatgttacattcgggaaatatagcaatatgaaaaaaatgtgagatgagtttctctactcattttttattctgaaataaagcagcttttaaaaaatgtttttccaggccaggtacagtggccaggcatggtggctcatgcctgtaatcccagcactttgggaggccaaggtgagtggatcacctgaggtcaggtgttcaagaccagcctggccaacatggtgaaaccctgtctttactaaaaatatttatttttaatgtttttcctctactataagtggaatttgtgtttcacaagttaaaaatgatttttatcattgttttctctttttctatacaaatagctacctattttctttcaaatctgcattttgctagcttttacattatgtgacgtagagaattccttaggaagctgtgggaatagaaaatagataaagacaggaatttggtgggttgacataacccttgatatatgggctacagtagctggaaaattcagtctgtacactaggtacaagatgaattttggagtatacttgctaattaaaatttgagtctgaagaattagatgggggtgttcttagatgtattgaataagttactgttatcccatctatatgaataacctttggaaataacctaagaagtgtcttttgttaagtttgctctgtaagaaatttgtattacacaattaaataatacatgtcagatagaaaatataataaattctaacttagcagacagtttattcaaaagaattatcgcaagggggagaaactattgcaatagggagtggggtctattttaatagaacactctcaccataagatctatgagtatctcaagggttaggcaaaaaatatttttcttttatgggaggaataaacaagactagaaagaacttggtgggaggaagtgggaaggcctgggggaaggagagaagcgtaaccagtttgattaacaggcaacttcaaattgggtacaagagctcctaattgttcacaaaaacttctatacaatatcaatcacgaatagttttaagggaaccacttttcaaattcttacttctatatatactcttcgtaaagttgatatgcttaagaaaatgtctgtaatggacatagaagttctcctttcttatatcccctttcacaaatttttcttctctcattttactattgtccttcctcctacccatccagaatcttaattgtggtgcgttacaagatctgttgtaatatgtatcaaaatctccagggcgccaaacaaaaggacagtttgaaaattggcatcagtgttgagaaagtgaatgactctgaaagaccaataacatactttttcaagttagatctattcttgctttgctttcaacaaaattgatggatgaccttatcaatttgtaagttgatggattattaagagtaatttttgtggctcactcctgtaatcccaacacttggggaggcagaggtgggcagatcacctgagcctaagagttcaagaccaccctgggcacaacatggcaaaaccccatctctacaaaaaatacaaaaaattagctgggcatggtggcatgtgcctgtagtcccaactacctgggaggctgaggtgggaggatcgcctgagcccaggaagtcgaggctgcagtgagctgtgattgtgccactgcactccagcctgggcgacagagtaagatcctgcctcaaaaaaaagcataatttttattaagtcattataattcatggtgtataactcaaaaagagattgctttaacagaactccatctattcccgtatacttggtttttttcaaataggtttattgagatataattcacacaccataaaacactcctttaagttgtataattcagtggattttagtatattcagagttgtgcaactgtcattgctacctattttcagaacattttcatctcccccaaaagaaaccctataccttttcatagacacccactattttcccccctcccagcctctggcaattaccagtctactttctatttctatggatttgccttttttggacattttgtataaatggaaccatagaatatgtgttgcatctggcttctttcgccttacatattttcaaggttcatccatgtagtagcaggtatcagtactttattccttcttatgactgaatagtattccattgtgtagatatatatcgattcattagttgatgtacatttgggttgtatcagttttttagctgttatatataatcttgatatgaatattcatgtgtagttaagcctcgttattcaaggattctttatttaaaaattcacctacttgataatatttataacccccaaactcatactcttggcgtcacgcacagacaggtgcaaagtgacaacaagtttgaatcattcaacatgcacattcccagctaaggtcggacaacgcaacactcttctatcttgttgtttgggctctcataccataaatgagttcccttttctatgtctacttaattccatattttttcacatttttgtgttttttgctggtgattttgcttcttaaagtggccccaaagcatagtgttgagtgctgtctagtattcctaagtgtgagaaggctgtgatgtgccttacagagaaaataaatgtattagacaagtgtcattcaggcatgagttatagggctgttggccatgggttcagtgttaataaatcaacaatatatatgaaataacatgtctttaaactgaaatacacatgtgataaggttatatattgatctgtggacaaatatggtgcaaccagagattcacagtaacctgtattttccctaaggaacagtgtttctgtgtttcctcagtcagtgtttgtgttgactttatagaatataagtactgcaaataatgaagatcgactgtatatggtttcatgtaaacatacgttttcagttctcttgggtgtatacccaggaatagaattgctaggtcatatgataacattgcttgttttgtgaacaaggtttctcagcgttcacatctataaaagtgaaaataggaatagaatttgtgttgagccctgtcttattctaccacatgcaagaaaatgagatccttgttggactggtgtggaactggccccatgacacacaggaatgtcaccttttgtgacacttccatagacataacttccaaggacccctgaagagacatgcccaagtggaagaaatcaccacattcaggaaagtccaaagctgttcaattgtaattttcctagagtagattgttttctttgttattataccagctttccaccatctgtctcactttcctctttcccagttcctagatggccgctttatgggattgaatctagagagtttaagccttacatagaaagttgatgagcctacaagtgggttaaagcttagtgtttttttttttaggtttcgtgttttttaaaaaagcattttcatatgaactgttgcttttttatttatttatttatttatttattttgagacggagtcttactctgtcacccaagctggagtgcagtggcacgatctcagctcgctgcaacctatgtctcctgggttcaagcgattctcctgcctcagcctcccaagtagctgggattacaggcgtgcaccacaatgcccagctaatttttttgtatttttagtagagacagggtttcaccatcttggccaagctggtcttgaactcctgacctcaggtgatcagcccgcctcggcctcccaaagtgctgggattacaggcatgagccaccacgcccagctgaactgttgctttataatatctcaattgtttacttcttcaatagcatgaataatttactatataattaaaagattttagtgatagtacatcaaaaagagtagtatctgcaaacagaagcagttttgtgcttgtttgtagtaaagactctatctataactgagtcagtaagcatattctcctttttaattactgccatgtactaatcaaacactatttaaaatgccaggcatgttgctaggtgctgttcatatctgttgtcttatcttcagagaaaccctgcaaaaaaatactttatctacattttgcaactgaagattaaagaagttaaataacttttggattgatgcacaggaagtggtagagccaggtgaatccaagttggtctgtcttttggactgcaaaagctgtatttttcccacatctgaagctgttagccctcaccctttatatcctagtgcccagctactttatgtgtcctgcacccctaaacccaaaagcggtatgtgtgtgaagtgaaggtagagagttttgtttttctggatttgttttttcacagctttactctgaccacctagaaccatgcctggcacaatataggtaatacttattgagtgaatgaaggaatgccacgtaagttttgtgaatttactgaggagtctcgggatggtgcaataagagaacagtgtgacagttgataaacaaaggaaggtttctgctttttggcaaagattacatctgtaaaaggtaaataggctgagtaacactttcatggtcaggactacaaagctgggctataaaaacacattattctaatccatgtttatctatcacttcttttgtttttttttttttttttttggcagagtctcgctctgtcgcccaggctggagtgcagtggcgcgatctcggctcactgcaagctccgcctcctgggttcacgccatactcctgcctcagcctcctgagtagctgggactacaggcacccgccaccacgcccggctaattttttgtatttttagtagagacggggtttcaccgagttagccaggatggtctcgatctactgacttcatgatccgcccaccttggcctcccaaagtgctgggattacaggcgtgagccaccgcacccggccatctatcacttcttacctggctggcacgctagtttatccaaactactttattgtacacgcttgttgtacagcttgctattaatataatgaggtcatataattagttatggtagtagatggtgacccttctcaaactatgaggaagatgtttaggtatcctcaaagtaaattctgcagtgatcccagagacagattaggaagtctcagagatggacaaaagacttgaaaggtatttcagaggctgggcacagtggctcatatctttaattccaacactttgggaggccgaggcaggaggatcatttgcgtccaggagttcaagaccagcctgggcaacatagtgagacccgatctctacaaaaaataaaaaaattagccaggcatggtgatgtgtgcctgtagtcctagctgcttgggagggtaaggtgggaggattgcttgagcctgggaggctgaggctgcagtgagccgtgattgcaccactgcactcagcctgggcaacagagtgagaccctgtctcaaaacaaaacaaaaaaaaagatatttcagaaaaaaaatgtatccacatgagcagtaaacaaggcacaactccattagtcatcagagaaatgcaaattaaaaccagataccactgcattcctaacaggatggctaaaaaatgaaaatgacagttgtaaagtggcagtgagaatgaagagccaccagaactcttactgctaatagggatgcaaattagtttaaccactttgataaactgtttgggaatatctaccaaagctgacatatatatatatatatatatatatatatatatatatatatatatatatatatatatatatcttgtgacctagcatttgcatccctgggtatatacccaacagcaatgtcttaacatatgttcacccccacccccccaaaaaaaaaaaaaacaaaaacatgtacaagaattcttttagcagaattcttcataatagccctaaattagaaacaacccaaatgtccaacagtggcggaatgacataaataaataccactgtattcatacagtggagcacaacaaagcaatgagaatggatggaactttgttacacaaaaaacacagatgaatctcacaagcataatgataagtgaaagaagccgggcttaaaaaactaccaactctatgattccatttatataaagtacaaaaacagtgtaactaatatatgaagtttgaggtcaaagtagtggttaccggtgggggaaggtagtgaatgggaggggacatgatgggagctacggaggtgctggtcatgttctgtttcttgatctggatgctggttgagttcactgaaaattcatcaagctgtacatttatgatatttgtaggaaggataggtatacattgtccgaagggaaagagtggagcagttttattttgtcagctcatgtggtctggcataaagatctgtctgggctatttaaatatttatattttgcataatggggatctgacttgttcacaaaagtattcattcagtcttggggagaaaagggtgatgacatacctgttctgtgccaaatgctaagtactgggatatgtaaaaatagaaagaaaacatagatatctttaaatctaataatccagacataagattctcttcctcagtagtaaatgctaaagagacagagtgactccatgtacaggtgaatctgctttgttatccttattggttactttaaaaataatgacagaaggcattggtgcaaaatgtatctaaagttacaacgtaagtgccatttctaaagcgtttgggagaaaattccactagtctatttgaactggccttgtgttgtctgtggtgtttggctttctcttgggtagcttaaatttcctccccatcagtatagtagattttatctattttgtttactcttcagaaataactgccaggggatttttaagactactgattgaggaatgattgccaaattacccatttttaagtgtaaagtcagtaagcaatgccaggtttctgaggagcttcaccaatttgtctctataatgtgtagtatttttttaacagttttaatatatgaatgaaaatactaccaagtttctcctggatccccacttttgttcattcagtgattttttttactgagctttggaaatgaaccttttgtctttttagtatgatcctctcccctcatgtcgtttgaaaatacccatctcttgcacgagactaagaacaatgctgtcctgttgagttcttataaaatccaaagaaaatttaagtactaagtggatgatagttaaagggtttacagcttttcttacagatccatcaaagtgggaaaatcatgagaagagttggagtcagacatgccagacattccaaatctgtcctgtacaatgtgaccttaagtagttccataaacctcagctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaagtaaatgcattacattgtatttttaaaacattttttgccttaataaactgctagcatttcagttaagaggagttaataacagtttcaccaatgcacattgaaaacgatgggttccattaaatagtcaataattattaaaattaagccaagaataatgaaagggatacaattacactaaagtgatatttatgtcttataaagatttctcttaaatgaaaattgacaattattagactagccatacacaaaatctggtattttaaaactaatcttggctgggcgtggtggctcacacctgtaatcccagcactttgggaagtcgaggtgggcagatcacttgaggtcaggagttcgagaccagcccggccaaccaacatggtgaagccctgtctttaccaacaaatacaaaacttagccaggcatggtggcatggacctgtagtcccagctactcaggaggctaaggtgtgagaattgcttgaacccaggaggcagaattgcagtgagccaagatggcaccactgcactccagcctgggcagcagagtgagaccctgtctcaaaaacaaaacaaaacaaaacaaaaaactaaaccaagggccaaagcagtatggtgacagggaaatattttatattttcccttagagacttcagagtgctgactcaccccttccacctaccatgtgaggacgcagtgataacacaccattgattaatgtctaagaatatattgaggaaaatactctatcaggctaacagggaaactggcacagttttgtttccactatattttattggttagagaagtcacagagccacctggttggaaggagaaaggatgtagatcccacctctggatgggagagatgacaaaaaaatttctggccatctttaatctgccacatcaattaattttaaacttaaactttgttgccttaatgtttgagtgagattgtagtagttgatgctactccattccgaggcagtactaaaatcctaccagaggatccaatgtcctcattaagtcccaattcaggatacatatgacagcagtgaataatttgtcactgtgaataggagactaaaataaggacataccatgttgcacaattacagactatttgaaatccagtctggcactgtttgttaaaacagaattttaatatttttgtaatcaaaagatagggaaattatttcaggcaggctgtttttataatttcgttttggcattcttctcttaagaatgaataataatataaggaaacaggtagtgattgccttttgaactataaagtgcttttcatttttagtaagaggttttatgtctataaaattatctgaaaagacaggtcatctgctaaccagtggtagagtatccactgcaaggctcaggactcctgaaacacatcataaaattgtcatgtaaggaaattcttggagctgagtgcagagctagtttgatttcatcataataggcagatattgatggattaactttgagtatttcatgaaataaaacatactttgctgtttttggtttataatacattttaaaacgtttgagtctgaaacaaaaattgtgaagctgatatttgtctttcctttcattctatatgtgaccagtttaatttttgtgattcggggcaatcaaagtatttgctgggtatctagagtgaatattttatcactttagataatctaatctaaaagcccagtaataacagttttggttatttttttcacaggtggggtagtatatcaaacagggtccagttaggagacagaaaccaaacagtaatttaatgtgtttcttttgactttttaaaaatttttgttggtacagagtaggagtatatatttatggggtacgtgagatgttttgatataggcatgcaatgtgtattaatcacatcctgtaaaatggggtatctgttccctcaagcatttatcctttatgttacaaaaaacccaaaaatactcttgcagttatttttaagtgtaccattaaattattatctgctgtagtcaccctgttgtaatatcgaatactaggtctttttcaatagtaatttaatttgaacatgcaaagtttagtataaggaattattgccaaggggttggggtaattggctagtaaaagttagagaactgtgaaaaatacaggcataaggaacagctgctattccaacggctgagatagaatgctcaaggaagaggtttggccttcctcctggcagcactaagatctgaaccttgttgaagaaaatatggccatgactcaccggatcacagtgaggttcactgagacaccatgctagtgggactcattggaaatctgccctctggagtccaggggaagccatccttagggacagaactctgaacatgcagcaagctcactgaggggctgctggaggaagccagtaacaaggagagtaccttgccagcagcgctctgctgtaaaggcacctgaagggggttccaagagaagctgcacatggaaagatgcatgctgctggccactgtgcactgcagataaactgcacacactgcaggagcctgatgagaaaaacactggaactgggacaacagaaccctttctcctccagtgcccctccagtgcccttagtggacaaagcttaatgttgtgccagttggaaaaatattcacagtcaatctccagtagtgcagagcaggcaatgaagtgtggatttggagctgacagacaatagattgataagtggcatgaggagtggagagattgtgtatatgacagtgagtatagttttgatgacatgtatcaagcaacctcattcattatacttggcaatgattttatttcattttgcttttttttccccctcctttaaggagattcattcaatacaacttagtggtatagggcttaaggaaggaaatgcccacgtttttgcttcatatgactagttggatagtggtgctacttattttattcaaatggatactatcaaagggtcagggagaataaatgagtttttgacatcttgcatctcagtaacttttgaaatataaatgttgatcagttaaatattttagtctaaaatttaggaccacaatctgaacaaaagagaaaagatttgaaaatcttcatcgttttggtaatagacgaaacttcggaaatacctgtgattgcttaaagaaagtatattaagaggccacaatgaaaaaaaatgatcatgaggaaccatttttggtcatgaaaaatggtcatgaggaatgatcctgacgaacacctaaatttaaagaaaggatggaaagagacagaggaaaccaggagggggaaagagaagtacaagaattattatcagagaatgctgtcatagacgctgagatcaaaaagattttctgtgttgtcaaatgctataaagaagccaaatgagggaacaactgtaatgtctatggaatttggcaacatggaaaccagtgtgaactttggccagagcaatttcggtattgcactggggacaaaaacaagattgtagtaggcagaggaaggaatggggagtgaggaagcagggaaaataaatataggataattttcaaatggctagactgagaagaggagagagaaacagtcatagatgcaggggcatgtggaggcaggggtagcgattaaaatgggaaggattccagtatctttttttttttttccttttttgccagaagagagagctaagaggaaagaaaagggtgcactgatggactgagatcttcgataggcagcaggtggagggtgggcccctcttccatcaagaccaaaagaaagtcaaggtactgatagagctaggcctgcaggcaggagaaggaaccagaggatgtccctcagctgatggcctgattttcagcaggtgggaggcagagccacctgctgagagtaggcatggtggtagagagtagagagataagagagttagtaatagcaggttaagagagataagagacattgctaggctgcctcaaggcccctccccccacccccgctgaggctaaatgcaaggaatttgtagcagcgcttatcaacatgcagatatgatttctctcagcaacactaagtagcctacaattgaggaaaggaaaattgtatgggtagattgtgctagagtgagaagtattacacacagcagacatgatggacaaaggaatcaagagagatgaaagtaatagtaatagcaagagaaaagaccatggagctggatggggaggaagattttagaggtgcatcaaacatattctagttggtcagtctcctcaccagtcacaatagttttcacgacatcaccgtaagagggacaatagtatggtaagtaagaaaaggaagttaatttcaggagacttgggttcaaataatgatcctgccatttatttattttgaccttgtgaaagttacctaacttctaagcaagcctgcatttttctttctttcttttttctttttttttttttttttttttttttgagacggagtctcactctgtcgcccaggctggagtgcagtggcgccatctccactcactgcaacctccgcctcccaggttcaagcgattctcctgcctcagcctcccaagtagctgggactacaggtgcacaccaccacgcccagctaatcttttgtgttttagtagagacggggtttcaccatgttgcccagtctggtcttgaactcttgagctcaggcagtccgcccgcctcggcctcccaaagtgctaggattatagatgtgagccaccacgcctggccacctgaatttttacacatagtaaatgctcaacaaatatttaatatgaagtgatatttcaagaaataagaaggtgcaatacaacacattagagatgccattctggcacaaagaaacaagtcagtgcctgctctaattttaatttaatgttacaatagccagttttgattagaatattttgcttcaccacatggtgctcaaggtactgtggctgcataacaaattaccccaaaacttagtgtcataaagcaactatttaatatactcacagcttctggggctctgcagtttagacagggcaaatctggggtgtgagtcagaagactcgagggctagggcaggaatcttctaaaggctcactaactcacatctggccattgatgctggctgttgactgagagactttacctgggaactttggcttacacttcatgtgacttctctctgtgaaaaggcttcctcatagcatggcagctgagttccaagggcaaatattgagagagacatccttttgctcagaataatggtattgagattcatccccatgtctgttgtattagtactttttaaattggttagtaatgttccatttcatgcatatagcaaagtttttaaatccattttcttgttcttagaaatatatgttgtttccactttggggctgagtaaagccgctttgaatgtttgaatgtaaatcttttgagttggacatattgtcacttctctcacataaatgcaagagtgcagttgctaggtcattaagaaactgccaaactattttccatagtggttgcactattttatgttattaccagtaatgtatgagagttacagcttttccacatccttgccaatacttggtattgccatcctttttaattttagccattctggtgggtatgtcatgatatttcttgtggttttcatttgcatttaccttatgactaaaaatgttgcacttattggccattcatatatctttgttgaagtatatcttcagatcttacaccgatgtctatttttcattgaggtgtgtgtcttttgtattaagttgtaggagttctttgtatattctggatacacttccttggtcaaatatacatattgcaaatatgttttcccagtttgtaactttcccttttatattcttaatggaatctttaaaagagtagaagtttttcattttgatgaagtccagtttacagtttttttccttcatggttcctgatttttgtgacctaagaaaatttcacctacgtcaaatttgtgaaaattttctttatattttcttgtataattgtagttttggctacgtttatgatgcactttagcataagagttgtatatcgtatgaagtgtaagggttgagattcatgggtagccattcgctccagcactatttgttgaaataaccctattgagttattttagcacctttatcaaaaataatgtgttggtctattttctgcactttctattctgatctgtatgtctatccttatatcagattcacactgtctagattattctatattaagtcttaaaatccagtagccaaaatcctacaattaggattttgtgtttaggctattctagctacttaaattttcataaacaatttagagtaaatttgtgaatttctgcaatgaagcatgagattttgattggtgttacttttaatctatatattaatttggggagaatggaaatcttaaccatattgagtcctccaatccatgaacactactccatttatgtagatttttttacattctcccagaaaatatctttgtagttttaagagtagatattttattcatatttcattacatttattgttagggcctcatgtttttgatgctatggtgaatagtattatgttaaaatttttaatttaatgattattgatagtatatagaaatacagttgattcttgtatattgatctcatatttggcaaccttgctaaatttacttattctagtggcttaaaaaaatccttaagattttctatttgaacaattgtgttattttatttctgtccattctgtatcccttttatttctttttcttacctttatgccctagctaggacattcaattcagtgatcttatattgatctcatatttggcaaccttgctaatttcacttattctagtggctttaaaaaaaatccttaagattttctatttgaacaattgtgttattttatttctttccattctgtatgacttttgtttcttcttaccttgatgccctagctaggacatacaattcaataatcttagggagcaaaccagtctcttaccattaggtattgtctgcaggtttttcttaaatgccctttattagattcaagaatttgttttatcgtcctaatttgttgaatttttattatggataagtgttgaatttcttagaatgctttttttctgagttgagtttttgtatagttctcctttattctgttacttacattgattgaattttgaatgctaaagtaaccttgcattcctgggataaaccctacttggtcatggtttattaaattttttatatacccatgtggtaaaaatactaatattttacaagatttttgcatcagtggttatgatggttattgctttctagttttctttttaaagtttctactggcttaggtatcagtagagtcaggtttactggtctcatataattagctcattattttctcaaaatgtttgtattggattgctattactttttcttagtgtattgtggaattcaccagtgtcactatctcctgggcttgggattttctttgtggggttattttaaattatacatgtaatttctgtaataaatttagggctattcagattttctattttttcttgtgatagtacttgtaatttgagtatttcaaggaatttgtcagtttcattttatttgttggatatattggtatatctttattatatttcttataattttcttgtctgacatatctgtactgatgtctcccctttcattgctgatattgataacttttgtcttctctcattttccttgatcattaaaatctttccaatggaatctttcaaagagcagaagttcttaatattgacaaactccagtttatcatttttagctagaggtttattattttcattgatcatacattgaacaagcttttggtatcattaactttattgtttgttcattttctgggtaatttctatcactgttttaataaagtccaatttgtcgacgtattgttttatgaattgtacttttggtgctccttctaagaaatctttgcctaatccaaggttggaaagcttttctccttttttttaatagaaatttaatagttttaggttttacatttaggtctttggtccattttgagttaatttttagatattttctgaagtctggatacaagttgtctttttttttggtcttgtcttttttttccatatatatagttgttccagcatcatttgttgaaaagattatcttttctccattgaatttccccttgcaattttgttaaaatttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtcttacaaaactcagaacacattgagctctctagtccaaaaattcagaatgctccaaaacctgaaactttttgagtgcctatatgacatcacaactggaatattccatagctaatacctaaatccaaaacacttctggtcccaaggactttggataagagatattcaacctgtagttctaatagcttttttgtagactctctctgattttctccatggatgattatatgtcagttatgtcatcttgaatacaatcagcattaattacatcttcctttccaatctggattcctcttgtttggttttctggccttattgcactgactggctagatgtctcctccagtataatgttgaatagaagtcatgacagcaaatgttttcttattccttagagaaaaaacattagattgtttaccattaagtattaatattagctgtaggtttttgtggatgacctttttgaggttgaagaagtttctttctattccaagtttgctgagaattttcagtaggaatggatgttggattttgtcaaatgctttttctgcatttattgagatgacctttttagtttattgacatcatgaattatattgattaattttgtagtgatcaaccaacctgtattctaaaaactgcatattggcctctagttttcttttgttataatagtctttaactggttttgatatcaaggtaatgctgagctcatagagtgaattagaaagtgttccttttcaattttgggggaaaggtttgtgtagatgtggtattatttcttcatgtttggtagagttcatcttggcctgaagttttctttgaaggacgatttttaactaaaaattctattttttatagttataggaatattcagtttatttcgtcttaagtgaggtttggttgtttctttcatgaaatttgtctgttttacctaagtgggtaaatttattggcatggagttgtttgtaacattcattattcttagtatatctgtaaaacctttagtgatgttacctttctttatccttaacattattagttcatgtgttttctctctttttttttttctgagcagcctggctagaggtttatcaattcattgatctatttcaagaacccattttttgtttcatttatgttttctgttgatttactttttcctattctatttatttcaactttggtctttatgttttcctttcatgggcttattttgctttaattttctcatcttctagtttattaagttggagactaagatcaagttagttaatagtattgttcaacttttctatatcctcattcattttctgcctacttgttttatcaattataattttggatttgtctgttcatatacttttatcacttttgtcttttatgtattttgaagttctgttattagatacttatacatttaggattattatgtcctcttgatgagttgactgtgttattatcatgaactgatcttttttctttgttcttcctttatgcagtgtatccttttttctgaattaaaaaattttgtttttttagctgggcacagtggctcatgcctttaatcccagcagtttgggaggacgaggtgggtggatcacttgagctcaagactagcctgggcaacatggcaaaaccctgtctctacaaaaatacaaaaataagccaggcatggtggtgtgtacctgtaatcccagctacctgggaagttgaggtgggaggatcatttgagtgtgggaggcggaggttgcagtgagccgagattacaccactgcactccatactgggcaacagtgccagatcctgtctcaaaaaaaaactttgtttttatcactggttttatgcaatttgttgataatctgccttagtgcctttttttatttgtattttaatttgcttgagattctttgagcttcttatatctatgggcttatagtttacataacatttgaaaattttttgggctttatttctttagggtatttttcttctccatttgtctcttctctcctttgaagggctccagttacatgtatgttagacccctttatattgtcccacatgtcattaagcttctgtattttaattttatacttttcatgcattgtctaatctgtttagttcatccagtgactttttcatttgagataatatatttttttaattctagaagctccattttgttcctatttatttttttgtatttcttttctcattatgtccatgctttcttttaaatctttgagcatattcataagctattttgaaattcctgccttgtaatgcctacatagctatcatttataggtctatttgtattgactagtttttcttttggttatattttacaatttgctgctttcttcattagactatatctagaatagccattattttagtgccaaatttagctccactacttaggtgtgaattatccttagcatttcagtgaggtctctctactgtgtctggttagaactgcagtatctccctgctctttttgaccagcctcatggagtttcaagttatgcaaggacaaattattattaaagtattgttgggactttttttatacctcagtcccttcttttcagtaccctctcctgaacattccatctccctcatcctccccaaaccataatctctgttttctctactcagtgacactgcatgcactgctttgcttcccctccctgtgctgcatactggaaattgcttccaggaagaagccaggctctcatttggtactcattccattcatttccctttccataggaatcacaatcttttactgcctattgtctcagtgcctgataatatttgtttcatacatcttattcaattttctagttcagtgggtaaagaaagtcctattccaattaaatttgcatgattagaagctctttttttcccttcaaaatctttatttgcatttctttttttttattattatactttaagttctagggtacatgtgcacaacgtgcaggtttgtaacatatgtatacatgtgccatgttggtgtgctgcacccattaactcgtcatttacattaggtatatctcctaatgctatccctcccccctccctccacccaacgacaggccccggtgtgtgatgttccccaccctgtgtccaagtgttttcattgttgaattcccacctatgagagaacatgcagtgtttggttttttgtccttgcgatagtttgctgagaatgatggtttccagcttcatccatgtccctacaaaggacatgaactcatcattttttatggctgcatagtattccatggtgtatatgtgtcacattttcttaatccagtctatcatggatggacatttgggttggttccaagtctttgctattgtgaatagtgccgcaataaacatacttgtgcatgtgtctttatagcagcatgatgtttaatcctttaggtatatacccagtaatgggatggttgggtcaaatggtatttctagttctagatccttgaggaatcgccacactgacttccacaatggttgaactagtttacactcccaccaacagtgtaaaagtgttcctatttctccacatcctctccagcacctgttgtttgctgacattttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatccttcacccactttttgatggggttgtttgtttttttcttgtaaatttgtttgagttatttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcatttgttgccatggcttttggtgttttggacatgaagtccttgcccatgcctatgtcctgaatggtattgcctaggttttcttctagggtttttatggttttaggtctaatatttaagtctttaatccaccttgaattaatttttatataaggtgtaaggaagggatccagtttcagctttctacatatggctagccagttttcccagcaccatttattaaatagggaatactttccctatttcttgtttttgtcaggtttgtcaaagatcagatggttgtagatgtgtggtattatttctgagggctctgttctgttccattggtctatatctctgttttggtgccagtaccttgctgttttggttactgtagccttgtattatagcttgaagtcaggtagtgtgatgcctccagctttgttctttttgcttaggtttgacttggcaatacgggctcttttttggttccatatgaactttaaagtagttttttccaatttcgtgaagaaagtcattggtagcttgatggggatgccattgaatctataaattaccttgggcagtatggccattttcacgatattgattcttcctatccatgagcatggaatgttcttccatttgtttgtgtcctcttttatttccttgagcagtggtttgtagttctccttgaagaggtccttcacatcctttgtaagttggattcctaggtattttattctctttgaagtaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctaaacatacaatcatgtcatctgcaaacagggacaatttgacttcctcttttcctaattggttaccctttatttctttctcctgcctgattaccctggccagaacttccaacactatgttgaataggtgtggtgagagagggcatccctgtcttgtgccagttttcacagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgatggattacatttattgatttggatatgttgaaccagccttgcatcccagggatgaagcccacttgatcatggtggataagctttttgatgtgctgctggattcggtttgccagcattttattgaggatttttgcatcgatgttcatcagggatattggtctagaattcccttttttttgttgtgcctctgccagcctttggtatcaggatgatgctggcctcataaaatgagttaggaaggatttcctctttttctattgattggaatagtttcagaagaaatggtaccagttcctccttgtacctctggtagaattcggctgtgaatctgtcgggtcctggactttttttggttggtaggctattaattattgcctcaatttcagagcctgttattggtctattcagggattcaacttcttcctggtttagtcttgggagggtgtatgtgtccaggaatttatccatttcttctagattctctagtttatttgcatagaggtgtttatagtattctctgatggtagtttgtatttctgtgggattggtggtgatatcccctttatcattttttattgcgtctatttgattcttctctcttttcttctttattagtcttgctagcagtgtatcaattttgttgatcttttcaaaaaaccagctcctggattcattgattttttgaagggttttttatgtctctatttcctttagttctgctctgatcttagttattttttgccttctgctagcttttgaatgtgtttgctcttacttctctagttcttttaattgtgatattagggtgtcaattttagatctctcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtcattcaggagcaggttgttcagtttccgtgtagttgagcggttttgagtgagtttcttaatcctgaattctagtttgattgcactgtggtctgagagacagtttgttataatttctgttcttttacatttgctgagaagtggtttacttccccttccaactatgtggtcagttttggaataaatgcaatgtggtgctgagaagaatgtatattctgttgatttggggtggagagttctgtagatgtctactaggtccgcttggtgcagagctgagttcaattcctggatatccttgttaactttctgtctcgtttatctgtctaatgttgacagtggggtgttaaagtctcccattattattgtgtgggagtctaagtctctttgtaggtctctaaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgtgtctcctgaatacagcacactgatgggtcttgactctttatccaatttgccagtctgtgtcttttaattggagcgtttagcccatttacatttaaggttaatattgttatgaatgaatgatcctgtcattatgatgttagctggttattttgcttgttagttgctgcaatttcttcctagcatcgatggtctttacaatttggcatgtttttgcagtggctggtatcagtttttcctttctatatttagtgcttccttcaggagctcttgtagggcaggcctggtggtgacaaaatctctcagcatttgcttgtctgcaaaggattttatttctctttcacttatgaagcttagtttggctggatatgaaattccgggttgaaaattcttttctttaagaatgttgaatattggcccccactctcttctggcttgtagagtttctgctgagagatctgctgctagtctgatgggcttccctttgtgggtaacctgacctttctctctggctgcccttagcattttttccttcaactttggtgaatctgacagttatgtatcttggagttgctcttcgcgaggagtatctttgtggtggtctctgtatttcctgaatttgaatgttggcctgccttgctaggttggggaagttctcctggataatatcctgcagagtgttttccaacttggttccactctccccatcactttcaggtacaccaatcagacgtagatttggtcttttcacatagtcccatatttcttgaaggctttgttcgtttctttttactcttttttctctaaacttctcttctcgcttcatttcattcatttgatcttcagtcactgataccctttcttccagttgatcaaatcggctactgaagcttgtgcatttgtcacgtagttctcgtgccatgattttcagctccatcaggtcatttaaggacttttctacattagttattctagttagccattcgtctcatcttttttcaaggtttttagcttctttgcgatgggttcaaacttcctcctttagctcagagaagtttaatcatccgaagccttcttctctcaactcgtcaaagtcattctctgtccagctttgttccgttgctggcaaggagctgcgttcctttggagggggagaggcactctgatttttagaattttcagcttttctgctctgttttttccctatctttgtggttttatctacctttggtctttgatcatggtgacgtacagatggggttttggtgtggatgtcctttctgtttgttagttttccttctaacagtcaggaccctcagctgcaggtctgttggagtttgctggaggtccactccagatcctgtttgcctgagtatcagctgcggaggctgcagaacagcgaatattgctgaacagcaaatgttgctgcctgatcgttcctctggaagcttcgtctcagaggggtacccagccatgtgagatgtcagtctgcccttgccggggggtgcctcccagttaggctacttgggggtcagggacccacttgaggaggcagtctgtccgttctcagatctaaaactccatgctgggagaaccactactgtcttccaggctgtcagtcagggacatttaagtctgcagaggtttctgctgcctttcgtttgtctataccctgcccccagaggtggagtctacagaggcaggaaggcctccttgagctgcggtgggctccacccagtttgagcttcctggccgctttgtttacctacttaagcctcagcaatggcgggcacccctcccccagccttgctgccgccttgcagttcgatctcagactgctgtgctagcaaggagtgaggctccgtgggtgtgggaccctctgagccaggcacaggatataatctcctggtgtgctgtttgctaagaccattggaaaagcacagtatcagggtggagcgcagtatcagggtgagagtgacgcgattttccagatgccatctgtcacagcttcccttggctaggaaagggaattccctgaacccttgcacttcccgggtgaggcgatgtctcgccctgctttggctcacactcggtgggctgcacccactgtcctgcacccactgtccgacaagccccagtgagatgaacccggtacctcagttggaaatgcagaaatcacccgtcttctgcgtcgctcacgctgggagctgtggactggagctgttcctattcagccatcttggaactgcccccctagaagctcttatcgtgagttttaatgtgattttaaagaatcttaattctaatgatattactttcaaatagagacagactattacagagttttatctaacaaagctaacatttatttagcatttcagtgatgtgagacgccttgctaagaggtgtctcagttcccattataatcctattataaaggtgccatgttatgcctattttacagaaaggaggactgcagcttgaaaacagttaagtgacttgttcaagctcacatatcagtcgagtaaatggcaaaacctagattcaaactcaatcttgtcaaactgccaaggccttgcttatcatcaccatgtgctatggtttggatgtccctgccaaaactcatgttgaaatttaattgccgttgtaacagtattgggtgctggatcctttaagaggtgattggcctggcacgatggctcacacctgtaatcctggcactttgggaagccgaggcagatggatcacctgaggtcaggagttcgagaccagcctggacaacatggtgaaacccatctctaccaaaaatacaaaaattaactgggcatggtggcagacacctgtaatcccagctacttgggaggctgaggcaggagaatcgcttgaacctgggagatggaggttgcagtgagctgagatcatgccactgcactccagcctgggtgataagagtgaaactccgtctcaaataaataaataaatacatacatacataaagaagtgattaggtcatgaggaatcctccgtcatgaatggatttatgttgttatcgcgagagtgggctagttattgctggagtgggctcctgataaaagaatgagcttgggcccattttctctctatgtcttgtgcttggttgcccttctgcaatgggacgaaccttaccagatgctcatgccatgctcttgaactcctcagcctccacaacagtgagccagataaacctgttgtttataaatttcccagtctgtgggtttctgttataacagcagaaaacagactatgataccatagtatgctgctttgaagtgggtgagcagctgggacaattaaggaatcagcttcagtactaagtgtctgggatgcaatgctttgggggccattttcaggttttgtacagcagtctttcttgggtcacattttcactgctctttacttcaaatggtcaagtcagacatcttttaagcaacatttatgggtaggttctgatggcatcttccttatatctgcatatgattggaaatctaagagcatttgggaaccttgtcactgaccatctttttttattgtaactctacattaaagtggggtgttttttgttgttgttgttgttgttgtttgagaatgataaggtaccatgggagcagaattacattactggaaaagtggtggctaggtttataaaagcaaaacagtcaatgatgttctcagtctcaaattatttcaaaataaaaagatttttaagaaaaatttacctaaaataattagtctcttttcagtttagccaccagcttcctatattcttagattgttttattttgatttttgggggttttttattgtgatttaattttttataatcatgtaaaacatttacgtggttccaaaggcaaactataaaagaaaatattttcaaagaagtatgttttctatccctgttcccaccctccttcataagtaatcattttcattagctttcagtttatactcattgtctttgctttaaaattgtaaatattgtagctgtgtgtgtttttacatacacatacatacacacacatttccctcttccttggataaaaggtggcatattctacacactattctacatcttcttgttttattaagtcgtagatactctggagttcactcaatagcatggtattaagattgtccttttttctttttaaagctccaggatattccactggatttaaatttttcaaaatctcatttgataaacatttattgtctactgtgtgtgtcatctgtcacgggtagtgcatagcattgtagggcaaacagaaatgaacaacatatagtcttcaccctcaagaaacttacagaattttaaaatacttttacaaatgtgtacctctcacagtagctgatccagtaacaattatttttatttttacccatctcctttttagagaacagagtaaaaatttttttgccatctattgtttctgttatatttaatgtcatttcagtagtatttataagcagtctaggaacacgtcccaacatttaaaatacttagatatatgattgtaaagtgtgaggcagagaagtacatcatatgaatgtatgctatttctaaatacttgctattaattttagtcactctaaagtcagaatataccagacagtccaaattactgtaattataccatccttttaaaaacttggcacctctttattcccaatattactccaaccattatcattataacaggttcctgttctgtacctcactcacatctgtactcttctccaatatttcttatttctttaatgtctgtacctcataagatgctgaacttttctttgaagacttaggcattggggctgtgggggtactagcctagacttattgaaagcagctcacctatggtactttgtcacgggagtgggtatatctgtgctaggtattgtccttcctatctctttgttggctcttaggggcactccgtctctcagggtcctgagtctgactttgcatctttgaatatggtgtctctccttaaagtcatcttggttacaccttgggtttaccttttctttgcctgtcctccagtagtggccctgaagcctatccatgttatcatttggctactcctggctcttccatcctggagctgttaacctagttgctcttgaactctgcatataaggcccccttccctttctctttcccctttccccagttgctctctaggttttctaatttctttcctgacactatgtatggctttagtcaagcgtaacccttgtccctaaatccacaaatataaagctaagacatgttacttgtctagttttcttagagaaggaaacttctcaggtctttgtatgcttcctcatacaattgtaggttgcagtaaggttaaatggctgaaaagcggtgaaggaacatgttcaagaagtttcatatgatttcactacatgaatgtagatgtggtaatctagcacctactgtactacttaaagcatttcctacagtgaaggcttctgagaaaataaatactattcctgaagtagtctcacaaaaaaaccttttttaattcagaaaattgattccaggttcactaagtcagcattttctctcatcaggcattgcaactaatgacattaatgagagccatgccatattttttaaaacaaaggataaaaagggcaaaactgagaattttaaaagggagttgtttccagtagtctgtttgaacattgtaattaaccaagaaataaaacaagaaaaggccattttaattgtgttttttagtactccattaacagtgcatcaagctccttatgaattgagacagtataaaatgagtgcttacgttaaagtaggaaagccatcagtctgcggtacagagcattgtatttattagagtatcccagacctgaatgagtattaccaccattaggtaatgcttaagtgtctattttaacaaaaggcatttttttttgttattatagagaacaaacactaaattgactaaataaatgaagtttaaacaagaaataaaacagctagaatttgcttgcttttgttggtggtgatatgctcttgtagccccagcaaattacatcagcattgttaccctcgacagggagctttataatttgtagcatgtaaaataacccttcccaaaaaagaagagagccaggacctgtgttgaactacttacaaagcaagcatgtccctggtgtcaccttagtagttttagtgagaaagatgggatttctaaggacagtagttcacagttgtgctctctctgttttctgtctttcatgctttaaggtttttttgctctcttattttaatgtgtgtgtctctatgtatgggcatgtaaataaatatgcagatggtggcacctatgtaagaaaatgtttgaacacagccccaatttcagagctcaatatggcatggggaattcttgggagaatgtgacctattgagggttggttggttgtttgtttttaagatggaatctccctctgtcacccaggctggagtgcagtggtgtgatcttggctcactgcagcctccgcctcccgggttcaagcagttatcatgcctcagcttcccgagcagctgggaccacaggcgcccgccaccacacctggctaatttttgtatctttagtagagacagggtttcaccatgttggccaggctggtctcgtactcctgacctcaaatgatccacccacctcagcctcccaaagtgctaggattgtgggcatgagtcaccgcgcctggccaattatcataaatatatgctttttagtggaccatatagaaagttctattctggttctttatatggttgggttttacttttatctaagtaatgtaagcacatggttttaaaagtcaaatcatgctacttctaacaacaaaaaagcagtgtctctcctaatttgttccaactccaccactttaagcatttttgctgtttcttctgtaaccagcaacatatattactatttcttgatttcatagtttcagatatcatcagttattgcctttttgctatgaaagatgtagctgttttatgttgctaccctcccaccccacttcctggtccctacttactttcccttccccatttttataatattcatatttcagttattcatataatatgattgtatttcttgtgtaatttattgttatatctggggtgaatcattgactcatttctttgattgcttagttttttgttgttgttgtttttgagacagtctcgctctgtcacccaggctggagtgcaatggcgtgatcttggctcactgcagcctccacctcctgggttcaagcaattctcctgcctcggcttcccaagtagctgggattgcaagagcgtgccaccacacctggctaattttttttaatatttttagtagagatggcgtttcactatgttggccacgctggtctcaaactcctgacctcatgatgtgcccacctcggcctcccaaggtgctgggattacaagcgtgagccaccgtgcccagcccgattgcttgttattttatgtattattgctaatttatccctaggctgtcccactaaactgtgtaactttcctcggtacattcaaccccattggataatttatcacattcattgtttttcttggtgacagagggccccctgcctgtgagcctttcatctgtttcattgtaagttggttgctgtcctggcctgctgggctcgtcatgagaattccttttgcctttcatctgtgctagagtctttgttccctaggtttcttgtttttttgcttttttggtttttttggcttccttcttcattttgataaagtatgccctctagtaactttctgagaagaggtgcttttttgagatacctgaaaatgtctttatattactctacaatttgatagtttggctgggtgtagaattctaggtgacaattttgaaaatatatagcatatgggtgaaagtttatatgatgcaacgagactacttaggttcatatcacacttaaccagctgtgtgtgacatgggcacatcacataacccttctgtgcttaagttttctcatctaaaaatcaggcataatatcttacctgcccttacagttattgagaggattgattgaataatgtatgtaaagcacttagggcagtgcctggccgtttttctcccaaagctttaatgatattctctttaccccagtgccctaaaattttacaatgatgtgctttactgtgggcctttttaaaagtcgttatactgattgcttagaaatatttttaaatctggaaactcattgttctttagtttagaaattctttaaaatatttcttagataacatccttttctccagtttctttgttcttcttttcaggagttgctgtgattcaaataacataagggcttataaggtagggcttcatctctaaccttttctttcctgttcctctttctttatctttttgctctactttgagagatttcttcaacttgatcttctaacccttctgtttgagtctcgtggtttagctctcattttttattttcaaggacttttttctgaatgtttttcttttaaactattatatagtttcatactcttgtcttcataggtttcatattcttatctatctcaaagtagtatatttttgaaattttctttgccttatacagggaacagtttcctcagaaaaatattaagagggaagtgttaaataggtgcctgggaacactctgtatatgggtaaattcattatcagtgatcagacaaagactaggccattttttgagcgccttatggatatccgttatctgtagatcttttgttcttaagcaggtcagtttgacagaagaatcttctgatcttctgccttgggctaagggtatgtgtattagggggagaaagggtacgtaggggcatttaagtctgactgcagtggttctgagagataaaggctgagggtctttattttaacatgtttaatacatggaactttccagttaatcctcttgtttgagtacagcacttcagtttgacgtgagctaggggtctggtgtccaaagtctccaaaaagtggggtaaggataatttgcttggccaaagatatccaaggtcatactgcatacctataaaggttcagccagtcctcctgttatctgctccaccatgcaaccctgccctcaaagatacctggtgcttcctattgctaaacctttcttagggacattttgacaggcatatcagcgtgcttcttactggctcgccttattgaaagcttgtgttcaggttctacagaaagcttgtgttcaggttctacaaaaagatgtcaagaagggatttgatgtgcaagaaatttattgagagtgaaaatgaatggtagggagctggaggaggctgggacagccatcacaggtcatgcaggtctgaccccgttggaggaaaaagggaagaaaaagaggaggattgggtggggaaattatttgaccaaggtgcagtttcaaggatgttttggcaaggcgtattgggagtccttgagccaaagttgaccatcagagacccatatctcacaggaattagcctgcttaagtattcctgctgctcttagtcaccagctgagagtatttataatagctgctttgaagtcttttctgctaattccaacatctgggctccctcaaaggcagtttctattttctgcttttttttcccctcctttgtaaaggtcacacttttctgcattttgcatgtctcctaacactttgttatagcaactgtggatactgacaccttcctccactccagggttattcttttttagttacttgctggactagttcagtgcaacctctgatgtccctcttcaggacaggtgtggtccttatccatgcatttctctgctacctctattggtgttaaacttaaccaatcgatagctgattgctcccttctttttgacaatgccttgtggtataaattgctccatagtctgatccaattaaaattgggtcccttcatggatgaaattggaaatcatcattctcagtaaactatcgcaaggacaaaaaaccaaacaccgcatgttctcactcataggtgggaattgaacagtgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaagaaaagaaaagaaaaaataaaaataaataaaaataaaataacattgagtcccttgtcagggacaagtttttctagtctttgagacttgctatacccttccctgagcagaatctctgcactatagagtaggagctggggaaaatggggaactcactcctcattggctgttccacccagatcctccctctgaagcagggtttttgtgttgccgggaaggaggaggtatgaactgtgcctccttttgcctctgctgctactcagtgtggatcttccacagctcaaaaccagggagtatgatatctgtcagtgttcaccaggtgctgaaagtactcagaatagttctttcaccctaggaagttgaaggagatgggagctgccactcagctgccaaacacatctctgtagctctcttgacaacacagagctgtgtgggcaggggggactacactgtttaccagcttcctcacctgattcctctgtttttagctggagttcaggggagagaaatggctgctgccatcagcttctgccgcttgctctatataggccttccacagcatggagccgtggaaaatgggatctgccaatgtttactagctgccaaatccaccccgagtagctcttccatctcaaggggcggatctgcccttagctgctgaactccttaaaacagttctttggcaaaacagagctgtggggggacaggtgcagtccctgtgtggtccctatctcgaatgctacagcctcttattgttcttatcgaatttctgtagattctattgaataaatgcttctctatttgttgtaagccctttgatcagtctccagggactttgaatgattgtgatttttgaccagctaaatatatgtctctccaggggagagatatccctgagctcctttatacagccattccagaagtcccacctagtcattgtgggggttttctgggttttttctgagacagagtcttgctctgtctcccaggctggagtgcagtggtgtgatctcagctcactgcaaccggctcactgcctcccgggttcaagcgagtcccctgcctcagcctcctgagtagctgggattacaggcgcacgccaccacacccagctaatttttatacttttagtagagacagggttttaccatgttggccagggtggttttgaactcctggcctcaagtgatctgcccacctcagcctcccaaagtgctgggattacaggcgtgagccactgcacctggctgtcattgtgtttttaatgattctgtcttaatagaaaactagttttacacaaatataatcaagtgacttaaattgaaaggactaagattgaaaactgaattgaaattgaaaattgaattgaaattgaaacctaagatttttttgaaaggtatgattttattacggaaatttgcttgattgagctttattttaatcaagactttgtatttccatttttagaattaattcagagaaatagctaacctataaagttcatcttcagaattgagtcattgtagacctaagaagcaatatagcagagttattaagagcataggttctggggccagactacctaggttccagtctttgctttgcagcttattggttctacctgggttccaatctttgctttgcagcttgttagttctttttatttttatttttgagacagtcttgctctgtcacctaggctggagtgcagtggcatgatctcagctcactgcaccctctgcctcccaggttcaagcaattcttctgcctcagcctcccaagtagctgggattacaggcatgtgctaccacacccagctgatttttatattattagtggagacggggtttcaccatgttgtccaggctagtctcagattcctgacctcaggtgatccacctgccttggcctcccaaagtgctgggattacaggcgtgagccaccgcccctggccgcagcttattagttctgtgaatgagttacttaactgctctctgtctattcatatataacatgagcatcatctgccccttagaattattgcgaggttaaatgggtcaacacatctaaaatagagcctgactcatagtaagtactcagtaaatgttagctgatggttattgttgttagacacattaaaggcaaataatcatctcatctttgtattttattattgagaccaataatattgtctaaagccagagaccttggtgaaacgctgggtgcccagctagctataatatgatctttagttccctctagtggaagaaaattagataggctctttgcataaacatgctgcttttggaattgtgatcatttaacctaataaaattacccctgaataattaaccaaagacaatatccacatacataaatggatttaagaaattgttaaaacttacaatcttaaatattctttccaagtgaaacttttttggggacgtgtaatttataatattaaataatatagtatataaaccatccagtgacataaaaagttaggcatatattacttttgtttaaaacaagtgcattcagtagtagtagtaccttgaagttttccattttaacattcatacccagttatctgcaagtagatggcatttcttggtcattctctgagaagtctttaatcattgtgatatgccacctggagtagatttccttgaagttttggcatttttagtatcctcttccacacagcctatggggtaacagaaagattgctagattgggaatctgagacctgggttcatcttccagttctgctatgaaatatctgtgtgacttcgggcatgtcttactagggcctcattttccttctgagtaaaatttgaggatagagaggagcatgtgatgatgactgtcttgctgtcacttctgtttctaacattctctgattcagtgatacatacactttgatgtgagacaggagatgtataatagatgttgagtctaagttgggtaaatgggtcctgtatgcttgatgttgccttctagcaggattggcaggaatggaaatcaccagcagtggaatgatttggtaaatgccaagatcttgaggcatctatggaggcggttgctagattgcagcagggtatgcctccctcagcttgggagattgttaaagagaactttgaggcaacgtctaagtgggatcttgatgaacaagtaggggtttaccaggcagagaaggaagcacgtggagtatcatacagagggaacaacatttgtcaggggacagagagcagggggccggtgcacaagctgcgggtggttcaggattggggtcagggaggctgaaggaagaagctactggaaaggaatgtataaatgtgtgacttcaaaaaaaaaaaacaagagctaaattgtttgactaagaagccggagagctagcttctatttccagttatactgttaaataggtctgtgaaccctagttaagttgttggacttaaaagattttttggaaggctttcaaagccatgcttagggattataatgtcttgctgtatggaatggagctcagtgaaggttttggaataatataatatctgttttagagtaaaactatgatgacactttaatgagtctaaagagaagaaactagaggcaaagaaacccatttaaagatctttgctgtgatccagtcaagaattgttgagggctgaaactagggtaaccgcagtaagggaaagatagttttgacaggtgttgcagaaatagaatggacaggttttggcagctgcatataggaagtagaggagaagtggtagatggtgtgaagatgactccaagggctgtctggaagattaataattttggtaatcagtaggccacacacatacagctacatgggttctgttttacttttcttaactagtgtccttattattaaacattttgagtgtgtctagtttttttcccaaataaccctatggtcatcttgaggttttttacgaaatatgtgatttcccaaaaaactgtagatgaaaaactgcaaagttaaagtaggcatagaactacactatatatagcagtgtggtttactaatagatgttcacattgctgccttcttggtgtcaaactcggtttgattgacatttgttaaacatagaatgatttccaccaaaaatgatgaaaggaaaagaaaacaaaacttattgtgcatgtgcactctcacatactttattaatcatccaggcctaactacaaccctgtataggagttgttatcttactctttctattttacaaatgaggaaacagatgttctaaggttatgcagctactaagtgatgaagacaggaaagacaggtcttttgactacaagtctattgccctatctattatatcataactgcctgccagcagaatgtgttagtgcttaaaaggatagatgccagatctgtggaagtagggtgaccagtcatcttggtttgcctgggaatgagggtgggttctcagaacccaggactttcaacctggaaagatcctcggtgccacaactgagaaagttccaggcaaaccaggacaggttggtaccctgtccagaaaagtcacttatatgaaataaaccattatctagaatgacttaaataaggtatttactgtatttctttcccataatattgtgtcatcaatgctaaatgacaaatgattcctaagtgaagaggagttaaggccccgccttccttccatctgtttgttttcactggctctgagcatcctgccttgctgcagttacactcaactgtgtgtgaatcagatactagatgcctttgcttctaagtcagttttattttattttttatttttatttatttatttgtttatttttagacaggatctcactctgtctcccaggctggagtgcagtggcatgatcttggctgactgcaacctccacctctcgggctcaggtgatcctcccaccccagcctcctgagtagctgggactacaggcacacgtcaccgcacccagctaatttttgtattttttgtaggaacagggtttcaccatgttgcccaatctggtcccaaactcctgggctgaagcgatccacctgcctcagcctcccaaagtgctagtagaattacaggcacgagctaccgtgcctcgtctctaagtcagtttttaaggaaacttatgctttgcccattccaaatttgatgaaatggcaaaagagctattcagggaaaaatcaaggagggctgtcagtatctgtgatttcaaagtatttatcaaaacaattaactcatttttcttggtcctttttcaaataagtatcacatattggtagttatttctttacgataaatttgttttatactatttttatgagactttgttgacaaaaggattctgtagctggatggggaaacccatattattaaaagaaaaaaaaacctcagataatcatttcactatgccgtacagaatttttacctcattcattttttacatattgaaacagaccacaaattgctttctgggaaaagttttggccctgctgtcagtatttcctgggctggccccatcctggaagaagatttgggggagaaatgggtggtaaggaaatctatcctgtcaacgtgtccttgttgagctcctcagctatcagttaataaatatagaaagtaaattatagataacacaattatgaaagtataaagcacaggtatgtgaagaacattttttttctttgacatattagttgaattcccattttatttcagtaacttctcgtttgctttttaaattttattgaagaacgtgtatgcacaataaaatgtacccatctaattgtacacttcagtgagttttgacaaatgtatgcattctgtcatcccacaaagttccttcgggctctaacatgtatgatttttaagactttaatattgaaaagtaattgagttataaactgatatttctctaattttcttgtataaagtaaggaataccatgttgaaataggtgtctggtttttctaatagtcaaatgccctgatcttcccccctttggtttacatttcccaaaatgaaaagcaacagagcaattgcaccttttagacaaacttagagcattgtatttctatttttgtcatatacaaatttgttacacttatcagaactgaaaactctttgggaaatatattaacaaaaccccattaatttgtaaatgcttaatgcagctaagattgatttctaattaatacacatttgcctatttaagaaaattttcacatcagtcaaacactgaattaatggtatgctgcttcctttctttattcacctgatgatgatatttggggccataggaattttttttcaatgggcaagaattcaaagaaattagaaggtgcttggatttctgtttgtgtgtgtgaaaaaagacaacaaaatgtatagagctagtagtgaaacatgtaaaaaagaatcaaagaaattatgagtttgcagttgacccagatttctatggtggcctgtctaggcctctactcttcactagctgaggtcaactttcctgaaggtcaatgaggaagatagcctcattaaagccaacctgacctgtgttgttgccaaaggcagctgggatctttattcttcaacttgattatgagataaaggtagaacccagcagcagaaattgactttgctactataatccttccaaggttctgcttggattcctttcttaaagtatcatttggtcattcatttcagtacactaaggaaaaatatgttgagtcaataatgactttcatttacttattttgttattaatatttattgaaatgaacacattagtacttgtcctagttctttctatgactagattagaatattctttattttgattttgagtccaggtcagctcttagcgaattttgtttaactgttgaatttctaacacaacctagacattgtttggaaatgaatgagaatacttgtatatttgttaggaaaagcgcagtatctagtttctgactatcactagttacaatgcagctgaaataagccggttctgtaacagtcttgatagcctgtcattcaagtcagtattaccatattagcactattgtgtgattggatcttaggatatataaaaactatgcagacccaggaggcactgtggtgtgatgtaaagagcaaagggctttggttattagtcctgcttcctccacttactagctgtgtgatttatatcattgagccctggacctcagtttctacctctgtaaaatggggagatatatgtgcatatatatgtatgtgtatatgtacatgtatgtcatgcagggttattacagtaacaaatgaggacttatagaggggcactttaaagtctcagagtttgcattagattaacaatagtgaagaaattccagatttagttattaaatgatggatttgggttattaaaagaagctataggatttccttctgtgaaagtattttttaaaaacacatctgtttgaatttagattctttttggaatgactgacattataaatatctgtaagaattacagaactcacaatcaggagaggataagaattaaagcaagtcaacttatctagagtggcaccattccaatttggtagacactagccacatgcagttattgagcacttaaaatgtggccagaccaaattgagatttgctataagtgtaaaaatacatgctagatctcagagataatagtacaaaaaaagtaacttattttattaattttagtatgattatatgttgaaataatactttgtatacattgaattggataaaatatgttatcaaaatgaattttacctgtttctttttacttttttaatgtggctactggaaaatttaaaattatatgcatggcttacattatacttaaattggatggtgttgatcaaaatctttattgagctaggtgcagtggctcacacctgtaatcctaacactttggaagtccaaggcaggaagattgattgaggccaggaattcgagatcaacccgggcaacatagcgagactctgtctctataaactatttaaaaattagctgggcatggtggcacgtgcctgtagcccagctgctcaggaggctgaggtgggagcatcccttgagcccaggagttcaaggttacagtgagctatgatcacaccactgcactccagcctgagcaacagaatgagaccctagctcaaaaaaaaaaaaaaaaaaatccttattgaatgctctcgagcaaacgaaatcttaaatttagatcttttaagttcagatacagatagaatgaaaagttctcctagttcttcaagaaaaatagtagtaaaataatactttacaggaaaatcatttttaaaacagaccacttgaaccagcttccctaactttcccttacttgaccagtctgataggcagaccctggtgggatacttgctttactattgttggagagcccaaactttttaggaaaataatagtcattctaatgccatatggcaggttgatttcatttaagtttctaatttgggttagaaaattaaatattgctacctgtattactagttccccttttaaagggaaataaattgataaaataaatataggcatatagttaaatgtaaggacactaaacacagaaatagattagtttaaaatatttttaaaatttcctgagaaattacaaaaaagaaagtacaacttagccataaaaaggaacaaaataatgccattcacagcaagctggatggagttggagaccattattctttttttttttttttaatctgagatggagtctccctttgttgccctggctggaatgcagtggcgtgatctcggctcactgcaacctccgcctcccaggttcaagcaattctcctgtctcagcctcccgagtagctgggactacaggtgcacgtcactacacccggctaatttttgtatttttagtagagacggggtttcaccatattggtcaggctggtcttgaactcctaacctcaggtgatccacctgcctcagcctcccaaagtgctgggattacaggtgtgagccactgcacccagctggagaccattattctaagtgaagtaactcaggaatggaaaaccaaacattgtatattctcactagtatgtcagagctgagctatggggacgcaaaggcataagaatgacacgatggactttgggggaagggtgggaggggaggtgagggataaagactacacattgggtacagtgtacactgcttgggtgacgggtgcaccagaatctcagaaatcaccactaaagaacttttccatgtaactaaacaccacccgttccacaaaagctattgaaattaaaataaaaaatgtactcattaaaaaaaaagaaagtacaaaggagagtgaagagaggtaccagttactagtctgtaaacaaaacaatacttcaaaatagagatggtaaccctgggtcatgtcattcccaggtacattttgtgctaacatctgtaagcagtcagataatcaccactttaaatcatattttcatcacctgctttcaaattccttcctactttgcctctagagttgatttgtaggcaaatagtgtttttagtttgctatatcagcgtggacttaatagcacttaatacatatatctttaattcacattcatatttagaaacaaacattttgagtttaatattcgtggaatctatagttggaatggatatatttgtgtttttaattgtgctatttgagctatttaatttatacttgaattcaggaaaacatgaccacaatttttctagatcattgcccttatcatttgaaatatatttttatgttgctagtttcatactagcaaatcaagtcaaatcagtgttctgactttagttctgaaatgtcagatccggtgacatttaaattgctttgaaggctggccccccagcaattctgcctttattttgagagtgggtaggtgataagagactagaccaaggacttgttcagccatttaccaaatcaaaatgtgaggctcaaatggagccaaatgtgtggcagaaatggagcatccatttctgcttacaaactttcagtataaccaatgtatcacatagcaaatggtgaatgtggagataaaaatacaatttagactgggcacagtggctcatgcctataatcccagcactttgagaggccgaggagggtggatcacttgaggtcaggagttcaagaccagcctggccaacacggtaaaaccccatctccaggtgctaaagttgaacgagctgatggatatgaaccaccagtccaagaatctgtttaaagttcagacttaaaatagtggcaaataaaaagtcctcatttgtgatggtttgcttctgaaagaaaaaaaaaagtctctactaaaaatgcaaaaaattagccaggcatagtggtgcacacctgtaatcccagctattcaggaggctgacgcaggagaatctcttgaacctgggaggtggaggctacagtgagccatgatcacgccactgcactccaacctgggcaacagagcaagactctgtctcaaaaaaggaaaaatacaatttagttacatgaaagaggcaaaatagaaaataagctgaaaataaagagaaaatatcagttttaattgtggcaaacaccaaatctgtttacttcatgactcctgtgtcacaggatagagttaaaatcaggcttttgattagaatagagaggaatggaaagagaaaaacttaagtcgaaaacagaagatatgaaagggtgagttctaataaaaatgggaagctagagataaacataaaaatgagtaataaaaattttaagcttttcctagaattagaaggcagaacactcctggagaggaaaaatctgtgcaggcatgtgattgatgttgtctggctcagcctggccctccagcacacttgttaaaagctttcctcatggttatgacttcccagcacaaaccccacagctgcttcacatcctcccctcctgcggggccttcctaactacttttggagatggaggcatctttcctgtgcctctgatctcttcctttgcagtaaacactgagcccccagccctgccatgctgggctccaaacatccagcttctcattagaatcttaacactgccctctccaactgatttggtagactctgcaggtaccacatcacttgtcactgccccatttcattgactctaagaaagtcatttgtagaagttagcagtcagcttgcagatggtaggacaaaggcaggaccagcaccatattttctgactccagatcctgtaggcttttcctcactgccacttacaaacacacagagtgcttcctttaaaaaaacaaacaagtaaaaccttctcttgaccccgctatttctttcctactgccagattcttctaatatgatcgtgttcaaacccagcatggcattattggaaggactgctgactttggaattgggcaggccagggttcaaaacctaccctcatgatagctgtgtgatcttgaacacgtttctaagcctcagtttctccatctgtaaaatacctacctcacagtgtggttgggacatcaagtgacagtgactatattaagtacttagcccaatgagaggtgtgataattttaactgattattacataattgtctctggcatactgacctcaaccctgactcctccccaaaagttgatcttgctcaggattctcattaccttttctggctgaatcttgtggtcttttctcagctttcagccttctccagctatttacaacttaatttcctctactctcttgattttcttaatattattgattcttcctttccttgtggcttctcttttgtcaaattttctgacttctttttctcattctacccttatgtaagtcaatcttctaaggttccatctacgatcattgctctgttgacaagactaagttgaattaataaatcagaaaggagataatattatctattttactttctgcagtacatccttagccttggttcttccttacctgtctcccttcgactttctaatataaaaatgtcacattggattttaagtcatcagcaaacgggtaaagccccagtgctattagcactggatggctttcattattctattccatgtagacatggcaagcgatttccatgcccaaactgttttgtatgatgatgatgatgatattaacaactttgttttccaaatagtattatagagtttacacagtagtcctacatacattatttggatttgttcttcaaagtaacattgtgaggtaggtagagtttggaattatccaacactttttttttttttttttttttgagacagagtttcactctttgttgcccaggctggagtgcaatgacgcgatcccggctcactgcaacttctgcctcccgagttcaagtgattctcctgcctcagcctcccgagtagcagggattacaggtgcccgccaccatgcccggctaattttttacatttttagtagagatgtgatttcgccatgttggccaggcttgtctcaaactcctgacctgaagtgatccacctgtctcggcctcccaaagtgctgagattacaggtgcgagccaccacgcctggccccagcacattttataaatgatattttaaaaattctgactttgactctaggaatagtgccttttctgtttaaaccatactattttttgttccctattccgtataacttccctgataggtctataaatgctagattttaggctaaagaatagacaacatatttttattttatttagggaaaactaagaaaaagaggtaaaaatcaaaacagtaaattgagttattagtttattagcagatcaaggaagagttacaaatttggaggctaagattttattagaagagttggggaaagtatttgtggtttgtttttttttttttttttgcttttggggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctcagtgctttgagagtctgaagcagggaggattgattgaggccaggagttcgagaccagcctgggaaacataccaaaacctatctctatttttttctaaaaaaaaaaaaaaaaggttgtaatcagtgactttgattaggaaaaaaaacagaagatatacttgctaaatattcaaaagataccaaggtcagaggttatattcattacctattgcttcataacaaaatgccccaaaatgtaatggcttaaaacaacatacatttattatcttagtctctgtgcatcaggaatgtgtgttccaacttagcagggtcctctggctctgggtctctcacaaggtgataataaagctgttggccagagctgaagtcattttgaggctccactacaatgtggatctgcttccaagctcactcacatgattgttggcagtcttaccttcctcacaggctactggactgagagccacaattccttaagagctgttggcccaagcctcccttggttccttgtccgttgggcctctccatagagcagcttccagcatggcagctggcttcatcagagcaagcaagaggacaagtgagagtatgagcaagacagaagtcacagtctcgtaacctaatctccaaaattacacaccatcacttctgcagttagaaatgagtcactagatccagcctatacacaagggggatgggattataccagggcctgaatatcaggaggtgaggatcactgggaggcatttcacaagttgccccctacaaagggctagctaacatattggctgtctacatcaaaattcaaaaatatttttacaagtttgtagcaaaggagctgaaacaaagaaggtgaaatttaagaccagttaatgttaactccttcattcaaatatgagtaagtgcaagatcagtgtgaatttagttgtgattatgtgaaaaaagatgtaaacattttagttgttgtttgcaacagcttaaaaagcgctgaatggaaggttatgctacattaattaggagtatatagtattcagaacaaagtcatactcctcccgttcaccctggaccattcatagtaagcaggacactggaatgtctgcagaataggataaccagaatggaaaggagcctgaaaattgtgtcatagagacacagccttcaaaatcttttctggcaaacctgctaaaagaattttgaggccaggcgtggtggctcatgccaataatcccagcaccttgggaggccaaggcaggcggattgcttgagctcaggagttcaagaccagcgtgggcaacatggcgaaaccctgtctctacaaaaaatacaaaaactaggtgggcatggtggcacacgcctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactctgtcacccaggctggagtgcagtggcgcaatctcggctcactgcaacctccgccccctgggttcaagcaattctcctgcctcagcctcccgaatagctgggactacaggcacgtgccaccatgcccggctaatttttgtattatttagtagagataggtttcaccaagttggccaggctggtctcgaactcctgaccttgtgatctgcccgcctcggcctcccaaagtgctgggattacaggcatgagccaccacgcccagccttaaatatattttctacacaactgtagaattgcctgtttatctcattcactgtatggaaaatgtctgctatgtgacctacatggcaatgctagtccttattgtcaaatcactcagccaaatcagactcattttctgtcagggaaaaaaaaaatctgacttcatttttcaaacaaaattaaagtgttaaatggacatccctgtgacactcatcttagtattgattttgaattcttaaacagcttaccatgaatatattgcctggataaagtaaggtggaacctccctttttttctcaaactctctttgttttgctttcaaaggtctctccctccctcaggggctgtgcatttcccagccatctctttgaagttaggctttttgggttggaggagtagtttgccttttggatgggtaactggagatgtggagatgggtgattgtagttgtggagatgtaaaagaaaaaccgcagaccacagacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgttgaaaagactgggaggctttggttatccacgaatgtattcgtttcattattctgctggaagagtccccaaagcagaagcccatagatagaacataatcaatgtccacagttatttgaaagattgtcatatataagactatatgcttattcagtgtggcatcagaggctgtaactagaatcaacaagtggcagacgtcacctctaactaaagaagacctttttgatgattaaacttactccatgaatgaagcagcctgtctcacagactatgtagtttctcactagaagcactcaagttgaagctggatccttccaaggggcctgaagataaggttttaattttggactagagatggcctctaacatcccttctaattttaagatattgtaattcttttgttttttttttttttttgagacagagtcttgctctgttgtccaggctggcgtgcagcggcgcgatcttggctcactgcaacctccgtctcccaggttcaagcgattctcctccctcagcctcccaggcacaggtcaccacgcctggctaatttttgtatttttagtagagacagggtttcaccatgttggccaggctggtctcgaactcctgacctcaggtgatctgcttgcctcggcctcccaaagtgctgggattacaggcatgagccactgtgcccggccaagatattataattcttttaaaattacttatctggtttaattttattctttattcaagaaatatatttctgtctgtatgtttattttctgagaaaactaagaacaagttgggtttgttttttgttgttgttgtttttgtttttaacagtctcactctgtcgcccaggctggagtgcagtggcgccatcttggctcacttcagcctccacctcctgggttcaagcgattctttgcctcagcttcccatgtagctgggactacaggcgcatgccaccacgcctggctaatttttgtattttttgaagagacggtgtttcatcatgttggccaggctggtctcacacccctggcctcaagtgatcaaccctcctcagcctcccaaagttctggaattacaggtgtgagccaccacgcccagcctcctaaaaagcaagttttacatactatataaagtaatgatcacagaaagcaaattttaaaaattcacctaaatttcaccatgtatgctaattgtatcaaaggggacttagtgacagtgtagtagagaaaaaaggatctttggtttcataaaacctgggttaacatcccagctctgtcacttttactaattatgtgaggttggccaagttttataagttccctgagcctcagtttgcttaccttcagaatcttcctaagattatgagaactagatgagaaactgtatgtgacttccctttgtaagtggtgaagtgctttttaactataaagtattatttccagtggctttaacaggatagttttagtccctcattgttgaagtagtctgtgtgggattttatgtaactaattttgtatgttgtgatggaaataattcatggttggctgtatatcgagatgagacctggttaaattggatattttccagtgacctgatcccagtgttaacccaaatcactagaacatggccttatgttttcttttgttttgttttcttttttaacagtgtaattgtggaaaatttcaaatgaaaagagagaatagtataataaaccccagcatactggtcaccaagcttcaatagttatcaaaacattttgccattcctattctgttcctcctgatgtctttttctcccctggagatttctaaagcactataatttcacctataaatactcttgtttgtatttctaacagataaggattttttaaatgatcatattattattatacctaacaaaatcaacaataattccttaatatcatgtcatgatcagttgatactcagttttccctgattgaacatgaattttaactgacagatttctgaatttagaattgttttattagctctagggacctgaaagtagattataaattcagttaaaataacttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagtttgagaccagcctggccaacatggcaaaaccccgtctctactaaaaatacaaaaattagccgggtgtggtggcacacacctgtaatcccagctactcgggaggctgaggcaggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatatggaaaagattagattagtaaatttcaaattttaggttagaaaatccggtataaaacttgttaaacaagcaggtacccaggtcccacctctagacattcacttttgcagatgtgagttctgaccgggcaggtcaagagatgattgacctttaaaatgggggtaatacaacataaaggctatatcatcattgtcccaacacacacagtagttttgtagacatctgcatatatttgcacatccattactttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccagactcccagaaagaaagcaggtgttcagcctaaatcacattgttagcacaaacagtttagacacagtgagtcagtcttttcagtcaggaatgtagaggaccgtcctgaaatccaagttcccagataaacctctcaagggccaaccttagtaggcctttcaagccttttatgagatagtagtttaggcctgctatattaactcttctgcacaaactaaaatagagataaatagaagaagggttttaaaagagttgatataaactcctggatctgcaaacaaaatataattgactgtaaagataatgacagggtttggagtttggggtttttttttttttctttttaactgtaaatacagtatcatttttatatctgttaaaaaacatttaggtggtcagatttttgtataaaacaaatcctggattgggatgttacagtatagaacagattttaaactttgaatgctatatgagaaaataaactattcagatgctactgtcttagaaatacatttgaaattgtcactccgataacttttcgtctatgacaactaatcttcaagccactaaaataattttgaataaatttgtgtacatataaaatctgaagaaaattcagttaattttctgttatttaaaagaagtatagtttgttcatttaaaaataaaagttattggccaggcacggtggctcacacctgtaatcccagcactttgggaggccaaggcgggcggatcacttgaggtcagaagtttgagactaacctggccaacatggtgaaaccctatcactactaaaaatacaaaaattagccaggcgtggtggcgggcgcctgtaatcctagctactcgggaggctgaggcaggagaatcacttgaacctgggaggcagaggttgcagtgagccgagatcacaccactgcactccagcctgggcaacaagagcgagactcagtcttgaaaaaaaaaaaaattcttagtgtacaacctttgccatatacataacttgtaaaaatttagaaattacagaaaattttgacaaaaaataatgtcttaattttgttataaaaattgtaacagaaataaatgtcattcacaaacattttggaccatttccttctattggaagcattttgctataccattaaatattttttggatacaatattttaatgacttcattaagacatctaaatgtgtgcatgtgccatgtttaataaattccctatagttcaacattaacattgtttttccctattagaaataatttataattaatatcttgtacataattacttgttcacgccccttgattgctttgtttcctcagaatacatttctgaaagtagaataactgggtaaaagagtatatgaatacatacaaatacatacatcatacttagatttaacctttttctcagtacaatgcctcacattttgaaaaatacattcacataaatatacaacttaaagaattattgtagaagtgaacaaccatgtaactataacccaagtcaagaaattttaaaactgccagtacctcaacagcccctgaattcccctttctcatgataatccccttcttctctcagaaataactaatctggacttcacttctgtgctttttatatccctagcatcaaaataggaattctcagaattctcaaataataaagttcactgtcgtctgctaaaatctattttttttttttttttttgagacgatgtctcgctctgtcgcccaggctggagtgcaatgctgtatcagctcactgcaacctccgccccctggattcaagcaattctcgtgcctcagcctcccgagtagctgggactacaggcatgcaccaccacgcccggctgatttttgtatttttagtagagacagggtttcaccatgttggctaggctggtctcaaactcctgacctcaagtgatccgcctgcctctgcctcctaaagtgctgggattacgggcatgagccaccacgcctggcctaaaatctttatttgaatggaatcctacagtatatactctatttttggtctctgagattcatctggttgctttgtgcagctgttcctttattttattgctatgtagtattgcagtgaacaaactcgcactatttattcattttaatgctaatgagtatttgggtgattcccagatttcactattttgtagagcagatccttccacgttgttcttcagccatgttttaagggatgtacttgtctgcatttctcatatacattttagaatgaggttgtcaatttccaccaaaacaaaaaaactattgagatttttgtcttgaattactatatcaaatcttgatagcaatttgagaataattgacatgtttacagtgttgaatcatccaattcgtgaacatagtgtctatcttcccatttatttagctctttgatttcttgcaataaagttttatatgttcctctgtagaggttgtgtacatctgtattagatttatgtattgtcagatttattcttaggtattttgtttttagggtaagtcagtttctctcattctcccttctctttccctttccttgtactaactttgtgttcctattcatcaggcttcattaattccaacaattaatctgtagaatcatttggattttctccatacataatcatatcatctgtgtataaggaggatttgatttgccctttccaacttttttacatcttttcttgcctttattacaatggataaaacattcagggcagtggtgatggcagttatctctgcttatttctgatcttagagtttgctaagcatgaatggatcatgaattttatcaaatgtcttttttctgcatatgcagtcatgcatcctataatgatatttcagtcaacaacagactgcatatacatgggtgctctcataagagtataatggagctgaaaaattcctatcgactagtggtatcatagctgtcataacataatagctcaacacatcactcacgtttgtggtgatgctgctataaacaagcctgtgctagcagtcatataaaagtataacacatacaattatatacagcacacaatacttgataatgataataaataactctgttactggtttatgtatatactatacttttttgttgttttgtttttattttaattttatttattattattataccttaagttttagggtacatgtgcacaatgtgcaggttagttacatatgtatacgtgtgccatgctggtgcgctgcacccactaacttgtcatctagcattaggtgtatctcccagtgctatccctcccccctccccccaccccacaacagtccccagagtgtgatgttccccttcctgtgtccatgtgttctcattgctcaattcccacctgtgagtgagaacatgcggtgtttggttttttatccttgcgatagtttactgagaatgatgatttccagtttcatccatatccctacaaaggacatgaactcatcattttttatggctgcatagtattccatggtgtatatgtgccacattttcttaatccagtctatcattgttggacatttgggttggttccgagtctttgctattgggaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcctaccaacagtgtaaaagtgttcctatttctccacatcctctccagcacctgttgtttcctgactttttaatgattgccattctaactggtgtgggatggtatctcattgtggttttgatttgcatttctcggatggccagtgatggtgagcagtttttaatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttagacatgaagtccttgcccatgccttgtcctgaatggtaatgcctaggttttcttctagggtttttatggttttaagtctaatgtttaagtctttaacccatcttgaattaatttttgtgtaaggtgtaaggaagggatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagttgggtagcgtgatgcctccagctttgttcttttggcttaggattgacttggcaatgcgggctcttttttggttccatatgaactttaaagtagttttttctaattctgtgaagaaagtcattggtagcttgatggggatggcattgaatctataaattaccttgggcagtatggccattttcacgatattggattcttcctacccatgagcatggaatgttcttccatttgtccttcacgtcccttgtaagttggattcctaagtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttctcctgcctaattgccctggcctacagtatgttttaagctaagtgttattacaggagtcaaaaaggttttaaaattttttaagtttattatataaaaaattatagtaagctaagatttattattgaagaaagaaaaatacttttatataaatttagtgtagcctaagtgtacagtgtctagaaagtctacaatagtagaaagtaatgtcctaggtcttctcattcactcatcacttactgactcacccagagcaagttccatgaatgcaagttcccttcatggtaagtgccctataccagtgtaccattttttatcttttatgctatattttgattgtaccctttctatgtttagatacccaaatatgtattacagttgcctgcagcattcagtagtcacatgctatgtaggtttgtagcctaggtgtgtagtaggatatcccatctaggtttgtgtaagtacactctatgatggttgtacaggaacgaaatcccctaactatgcatttatcagactatatccccatcgttagcaacacatgactatattgaaataattatataataccatccttcaatctattgctgtagtgaattgcattgattcttgggttaaccaaacctggtcatgatttatgatcttcataatcctttttacatattgttgggtttggtttaggctttctgtgtctctcttttttaatttatttttacttttttttttttttttttgagacagggtctcattctgtcatccaggccatagggcagtggcaccatcacagctcactgcagcctcgacctcctgggttcagttattcctcctacctcagcccctttctgagtagctggaaccacaggcgtgccaccatgcctggctaattttgtagagatgaggttttgccatgttgcccaggctggtctcagactcctgggctcaggtgatctgtccgcccagcctcccagagtgttgggattataggtatgaaccactgtggcttcctggttttcatacctagattacacttgcctcataaaatgaattggggaatgttctctcggtttttttgttgttactattgttctattgattgattgattgactgagatggagctttgctcctgtcgcccaggctggagcgcagtggcgcaatatcagctcactgcaacttccgcctcctgggttcaagcaattctcctgcctcagcctcccacatagctggaactacaggtgtgcaccaccacgcctggctaattttttgtatttttagtagagacagggtttcaccatgttaaccaggctggtctcaaactcgttacctcaggtgatccgcccgcctcggcctcctaaagtgctgggactacaggtgtgagccaccacacctggcctctattgttctctttatgtgatttgtagaactcacctctaaatccatccaggccagagttttcaatcttagttcaattccttaaatatttataggaatattcagggtttttattcattactgtgtcacttttagtaaactgtattttgctaagaatgagtgcattttatctaaattttaaacagttttggcataaagttcataataccactgcaggttctgtagtcatgtcttctttttcattcttgatactggtaatttgtgccttctctttttctttctcagccttgccagacatttaccagttttattattcttttcagtgacaacttgtagctttgtaattcttttttttttttttttttttttttttgagacagagtctcactctgttgcccaggctggagtggcgtgatctcggctcactgcaacctccacctcccaggttcaagtgattctcccaccttagcctcccaggtagctgggattacaggtgcctgccaccatgccaggctaatttttgcatttttagtagagacggggtttcaccatgttggccagactggtctcaaactcctgacttcaagtgatccgcctgcctcggcctctcaaagtgctgggattacaggcatgagctaccgcgcctggcctgtaatttctttttattgtgtgttgttttctattttagtaatttctacttgctgttatttccatccttttattttgggtttaattttctgggagctttttcccttttagtttcaacctttttgtatccttgggttttatttgtacctcttgttaaaggcatatagttgtgttttattccagtctctcaatctttgtcttttacttggatcatttagtccatttacatttaattatattttagtatattttgagttttatctatggtcttatgtgttctctatttgcaccacctattccatgtttttttctctcttgatttatttgaatcaaatgaatatttttatcattctattttccctctgttaattttgaagtttaagcactcttttctgttatcttagtgtatatcccagaaattacagtatgcttcgtaacacatcaaattctgatattgataccattattgtcctcctgaacagtgcaagtactgtagaacatgttaattttatataattccttccttgacttttaggctatgtttttcatgtatttaaattatattcgtgtgtataaaaacataaatcccatgtatttatatcatctcctatttcttatattatttgtatcgatttggatttacccacacacttatcctttgtttgttctttattctttcagcatctctaaggttttatctgggttcattttccttgtgtcagtctgctggatgcaaactttccatttttcttagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagatagatagatagatagatagatgatagatagatagattgtattatttttggcttttattctcttgcaaaaaaaaaaaacaagctcagcttttatgttctagggcatagtaagcttcattgtttgataatctgtgctggataatctcagtatatgaagtccctgtgggtttgcttttattgtctgttatttttgctggttattggtcgagatctcttatcccttcatgtaccttattcatttttgtcttgtgctagaaattatgttgaaaattattggcctaagatgatgctttctttctccaaagaggaattttgttgttgttgttgttgttgttgagacagggtcttactctgttgcccagactgaaatgctgtggctcaatcacagctcactgcagcttctacctcctgggctcaagtgatcttcctgcctcagcctcctgagtagctgggatgacaggcacacaccaccacagccacttaattttttttatttttagtacagacatagtctcactgtgtttcccaggctggtcttgaactcctgggctcaaggaatcatcctgcctcctcagagtgctgagattacaggcatgagccactgtgcctggcccaaagaggatttttatttgctgcttctactgcgaaccttcaggcacctagctgtttaagactttcttactcaagatttaaggcttagattttcagtgccacctagatgtaaagccgggttgcaagtctgtgaaggggctgattgcttccagttcacccctagctctttagggcatcagctcagtgctggagagtagagtttatcagattctcttgaattctcactcattttcccttttgagcccaggaattagagaccagcctgggaaatatagtgagacctcatctctaaaaaagtttaaaaattagccaagcatgggggtatgcacctatagtcccagctactcaggagactgaggcgggaggatcacttgggcacaggagatggaggctacaatgagccaagatcatactactgtactccagcctaggcgacagagtgagactctgtctcaaaaaaaaaaaaaaagaaaaagaaaaagaaaagaaaaaagtactttttttttttacttatttagttgtcttcaatgggagacatcatctagtctaccattacaagaagcagaactctagcaatgtatttaaaactcttttaacgtagttttcatattactctccataaagatttaccaatttatattcacacatggtaaataaatgtatctatgtttacattttgataggtcaaaaggatgttttggtttaatttgcatttattttgtcattagtgtggtcaaatattttaaaagtaaatttacccatttcttttgcatctagtcactttcattagttgtttagttttccttagttgttttagttgtaagaattcttttttgtttgtttgtttttgttttttgtttttaatagagatgggctctcccttgcttgcctaggctggttctgaactcctgggctcaagcagtcctcccaccttggcctcccaaagtgcagggattacaggcatgagccaccacacctggcgaagaattctttatttgctaaagatatttacctttttcatgtatttgtaaatattttccccaaatctgcctgttttattttgcttgttgatttttttttaacatgcagaacattaaaattctgtcagaaaattacagataagcaatagggaaggctagaatgaactcttagctactagattagagttgaagacagcagtataatctcatattgaatttattatatgtacacacacgcacacatacacatatacatgtacagatatatacagaaatcataaattatatgtgcatacatgagttagtacacatacattcctagctctgtccacttagagagcctaaagcatacccacacctagatttttgtttctgaatgtcctcctctaatttaagcagccagggatcctcggaaaaatgattataaattctagggctggaaaagagaaaatataagataaacatgaagcatcttagagtgcctgaaggtaaggaagtattcaaaaagatgggggcatatcagagagacataggaaccaacctgaaagcatgtccagtggccaaaactggaacaatttgagcaaaaaataacacagtatagattacaatccaaagtataaaataaatacttatgagtgcatagtgatataaagaaataattagataaacaattgagagagaaaaaaagaagaattccaagtgttaggtatagataatttccctccacccttgagtgtaggttggacttagtaactcactttcaaagaacaaagtatggagagggaaatagtaattttacagtagagagaactaacagattatcttcaccaagtgatcacattagcattaccagtgatcattcctgcgtatatcatccgctccttgatatgatgtgatgagaagggcatttcacctctgatattcttcccaagaaacccataaccctgacctaggcaagagggagacatcagacaaacccaaattgaggaacattctataaaatacttggccagcatgctttaaaactatcaaggtcatgaaaaacaagtaaagactaagaaactgtcaccaaccagaggagactaaggaatcttgacgactaaatgcaacgtggaatcctaaatggcaagggaaaaagtatatagttgacaaactgatgaagtccaggtaaagtctggagtttagttaatagtaatgtaccagagttactcttagcttttacaagtgtactatagttacctaagatgataacactagaagaagttcatttagtggtatacaggaactctctgtacaatcattcctcagtatatatgcaggggattggttcctggaacctcacgtgtactaaaatccacgcatctcaagctctgcagtcagccctgtggaacccatatataggaagttagccttccatataggcaggtttcgcatttagcaaatactgtattttttatctgcatttggttgaaaacattctgcatataagtggacccatacagttcagaactgtgttgttaaaggatcaactgtactatctttgcaacttttacgtcaatctaaaattattctaaaataaaaagttttctttactctaaacaaacaaaaaagaaaccatgagtttacaccatttccagtttaaagtagcaattacagatttttatttacaagacagttattaaattataaggaattattataagtaattttggtattatagttatataacaaaaaagagttcttaccttttggagataagtactgaaatatttatgcataatgctcttgtttttgtttttttgaaacagggtctcactctgttgccccagctggaatgcagtagcccaatctcggctcactgcaacctccacctcccaggttcaagccatcctcctgcctcagccccccaggtagctgggactacaggtgcgcgtcaccatgcccggctaatttctgtattttttatagagacagcgtttcaccattttggccaggctggtctcaaactcctgagctcaagtgatccacctgcctctgcctcccaaagtgctaggattacaggcgtgagccagtgcgcctagccatttatgcataatgttttattgatgtccgggatttgcctcaaaatcaagcagtgggtaggcagtgggtactatgttggaatacaggtgaaacaagattggccaatgtgttgttaattgttagagcagtgtaatgaatgtatgaaactctgtattttctacttttgaaattttccataatataaagtttttttaagtgagaaagaaattacatagtttttaactttttaagttttatatttgtatatcttatctctgaaaatctgggttccttgccacattaatatacttatttgcttcatcctactagtttaaatatgcaataaaaataagactattgaatgcagattaggatttctttgcacttcttttcatccgaagggtatatcccacaggaatgcacaatcaaaaccctgggttttaaagaaattttaaataactcttctcattgtggttttgccacaagcttgatatagatagatttaagtttgtttgtttgtttcagtttgtttttttatttacatagtttttattacaattttagattcacatacagctataagaaatatagatccttgtagactttgcccaattcttcccaaaattaacattctgcaaaactactgtgtcacagccaggatattgacattgatacaatccactgatcttattcagatatctgcatcagtttgtttttaatttttaaaattgtcttttttttctccttgctttaattttggttttagattatgaaaaacatgtatatgattacacaaagtcaaacctgtgaatagggttcattcagaaaggtctagtttgcatccctgtccccattcactttcttgccctaaagaaaacaatttttaaaaattagttattttatttttccattatttttatttgaaaatatgagaagatatgtatatgattttgtgccaccccccttcttacacacttccatatattctcatctaaaccttgatttttaaaaaattttaatatgaaaacactggggatcactccatggcagtaagtagacatcttcttcattcctgtttatgcctgctgaatactccattatggcaaagaattgtttattaaaccattcccctaatgatggactttgggattattttcagccttcttttactacatgaataaccttgtgcatacgttatttcatactgttgctaatgtcaaattccttcctcaaatgttgtgtcattttgcatcgccaccagcactgtctgagggttgtaggcttcaattttaaattgtgatttaaaggactaatctctgtcatataaattagtatatgtcttacttcattaaaaaactgtactcatatgtataaggctagacaaagagagtcatagataaattctgatttattttatggccctcatttatatctgtggacttgaccagaatgcttttaactagagtgggtttcttatcattgtaaggtcactaggtctaagaaaatttgtaatactcagaaatagagagaaggtcatttgtccctctgccatttgtttactttagatagtaggcagagtcattgaatcttattaggaaatataaaaaacatacttgctctttttgccagactcgaaaaagtactaaagctattcatatttcttatacacaccattgagagctcaagaggttcacaggaaataaaggcaagattttgatgggacttttaagacaaggcaaggatttggggtttatcttgaagatgtggatgccatcctaaggcatgtgatcagatcaccatttttaaaggttgtttttttttggctacagtatggctatagtataggaaggaacacatttggatatggggagaattgggaggccattgccattgttcagtatggatattgatggctaggatagatcagtgtcagcagagagcaacagaagtgaattaggaattagaaaggatagggtttgatgattagataaaggaagtaaaggaggaagaggagtcaaagctgacttgccgtctctggcttgggcacctgatatatgatggtgccactgactaacttgggcaaccctggaagcagatgatgcagtatactttggacatgctgagtttgaagtctctgtaagatatctgaatgaaaggactaaataggaagttagatatgtggattaggagcacagagagagatcttgggtagatacagagatttgggaatggttgctacttagatgatttagaagagtatatagagggagaagaaaaaaggacttgaggactgaggttcttccaaattttggaggttgtagaaaaggaggaatagctagcaaatgagatagagaaggaatagctgaagagatagaaaatcacgacagcaaggagttgcagaagccagaaaaaaaaaagtgtatcaggaacaatattataggaaaatgaagggtttgggtaattcttagttccatcctttactagattcctgtattcttcaactattgtcgagtgttcatgctctgcacagctcccattcggcctcatttctgagatgtgctgccttttggtatctattggtatctctttgctgccatttggtattcctatctgatatctcatttccttagtgagggacatagtgagtgaaagaacattagaggacaaatggaaaggcctatactgttgtcctagctctgtcaccaactttatttagtaattttgtttctttatgcctattatctgtgagatatagctagaatttcaggacagagatggctacacatggaaacaattacaatgagaagtaaggagagagaggaagagaaagagccgtcatagaggaggtgatactgagaattgaaggatgaccaggagtttgccaagtggtaatggcaaggatgaaactagaaagaagtagtaaatatattataaagatacagaaatatcataaagctttctttttgagacagggtcccactctgtctcccaggctggagtgcagtagcacaatcatggctcactgcagcctcgaccacctgggcccaagctgtcctcacacctcagcctccaagtagctgggactacaggtgcacgctaccacacgcggataatttttgtatttttttgtagagacagggtttcaccatgttgcctgggttggtctcaatttcctgggctcaagcgatccacccacctccgcctcccaaagtgctgggattacagacatgagtcactgcacctggcaaaataataaaatttaaagaaagaaaatagaatgaagccaggcctcataggaactaggaaaaaagatctcaggaatccaagttactgttctcttcattccttagggttttgtgtctactttgctctggaagaaccagctttctccagttactcaagcgcttgcacatgaccccaaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctatagataaccttcttttgaatcagggatctgtttcatccagtggcaaacagaagcccactgctgtttccatgattgggctggggctttagatgggagagtttaatagaatatagatggcaaatcgactatatgagtgggaaaagagagaggcattacaggcaggcaaagagcatgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccagttgagaatatccaacacacataaacaggaattctagaagtagaacatagagggaatgatgaagaaaagagaccttattcaaaaagataatagcccagaactttcccaaattgaagaaacattgtaacctcagatagatgtaaggtttggagaagaaaattgctaattttcttggattatttgagtttatggtggttgtaggatacccacctgtaggtgtctactccaaactgcctgagtctggcccccaggagaagaacctaggctagcaataagagtttaggaggcattaccattagcacagggtccatttcacttcttggcacctcagtttctaccctagcaacttttgagaatgaaatgaagtgtaaaagtactctgataatcacaacactacatagttttaccattgtcttcattgtcattgtcataaattctattgagtatagagcctcagtattagaggagaagagctaaggaacctggagccagatttcctatattcaaatcctggctctgctactttgtaaccatgtgaccttggacaagttatataacatttgtcttaagcctcaatttcctcatctgtgaaatagtacctgtctcctagtgtttttatgaggattaaataagttactacttgtaaagcactttaaatggcacttggcatgtagataaatgcccagtaaatctttgctattagctattaaagtacctgcatttcacaggaaccttcagtatcttatttcagaggagtgactaatgtaaaaatcatagtctatgaggataataaatttaggtatctgtgtcttcctgtaatactcaaaggatcagtttagttaactgctggcttttgtctatgtaaagagttttgtggttgtttgcaaattgctcatgatgttatttgaacattcaaggacttctatttttttcttggtaatgtctgaaacttggaaataattcatgggcatatgggatattctcctgaggacacaataatggttccatttttcttgctaagttggaacaatttaatcttgagcaaatacctatgcttgtgcttctgtttttgtttatatctgtatacatctatagttttacaaataccaatattgacattttcattttagccagaaacttgcctaaaagtaagattacacgagctagtttgatttcagagtgcaaatggcagtaaaatgaaagcagaaaataaaaaattaaccatatgattattttgtaatccccagtgtgtttgttcaaggtgagatcattttccagattcatccttcacctgtaccaccttcctgatctgcaaggccatatcagggctggcatggttatttacagttatttagatgttctgtgaggcagataaacagaagacaggacacaagtagaactgtcaaaaaaaaaccccaaaatccatgaattccacaagcgactagaaggaacttgttgtggttttcatatctacatcgtttgaaagggcactccctctcctagagatcaggagctgtactgttagtgatggcaggggctgcactgatacacctgcctctgaatgaagagaaggttttgaggagcaagaaggagaacttatttctagagagaagaatggaaataagggctagagagacttagaaacaatcgcagatacacatccataccagagttacaagaacttacacaggatagcaagcaaactgatgcaatggttatgactgatttggtttggggtggcagaggatccatcccagcttctacctgcaaaagtaagtaggactaggtcaaaggtctaagaaacttaaaaaaaagtgtgtttaaactagctgaactaatacatccagtagataaagaattgcacataaggtatttgtataataattttttttgaattaatgaagttaaaaaatttggggagagagggctgggtagaagagagagaaactcgagaacttgggcctttaaaccctgcaagcataactggggccatttaactaaccaacgtcctagttgaacagagctcattttgagtacagaaacaatagtagcttggaaacttagttctacctaaccccatgaaaccctgtctgtctcctggtcagttgggaaagaacttgtgaggatttcagtaattaaaaaaataatccccttgaagaattagaatgtcactgttctctcgataacccccgtaagtccaagttaaggcaatagcagcctcctccttcaaaaaggtgaacaggaagcatggagttatacagcgggctgagaatcaagagactgaggttctagtcctatctgctattaattagttactaacctaaagcaagtctcttaaacttccagttctaagattctgtgatgtaactcatcgtgatttatatctggaggtccctccccctcactttagtgttagagattagggaggtgggtgtttagctgtgaggattagtgagtacactgaggactaacagtgaagttcctacatggtagaagctagaacagaataggggctattgctcttatctgccttgctttttttctggaaattattagaaagccatacagatatgtatgttaacgtaaacaacaaatccagaggtcgtcttagaattatttgctatcccttgtagctggagcttccttatccactaggaggcaccattgtcaaacaacattgattaggggtcaagagctcttgatcatttaagcaattggagaggaaaaatgtctagaaagaagaaaaaagaggtaaatataggaccctggaaattgtgaaaaatcaatctttgttatctagatggacattagaacagttctcagtttctaaaattcgataaacagtatttcagactacatatcaattttagaagtggcaaaatctttcaaggcagtctttttttcgaagaaacaaataagatatgaaaaaagaccttagaaattactgagccaaatcccatctttattgaggagtcatgatcaacccagaaaggttaagtgtcatgaccaagatctgccaggcttgagcctaaaaccgatgtgtagggggggcatttctcattgattttggccatcccaacacctgaactctcttcaagtatttggagaatccctcattttaagagccttgataggggaaaaaatcccatattctactataaaagctaaaaatggcagatatttgcactactaaacatttagacccacagaactaccacaggacacacttggcatcagattcacttagaaggatacaggacagggggaaagaaaaaacagctttttagtcaggcagcaccaggcattcctctgcagtacgagtcctttcagtagtatatacaataaagttcagtaaatataacagggaaaagaaagatttttaaatagtgttgagaaaacaagttaacagttcagaaatcaatttagattcacccttccccacacacatgcacatacaacaaaaatactacaaacaaaatagagttgatagaagctaatcaaatcataggaaagctagcaaaagataaaattatttaacagatctttagagagcttttaaaacttcaaagaactgggatccacaaagaaaaaaggtatcaatagatttaacaaaaattgaaaaaactagaaaattaatttgcttcaatcttgacataaaaggtttacattctatcgaacataaagagttcaccccaacgaaagggaagatattaagcttcatacacaaacaggcaaggacaggaatagacagcttccaccaaaagaactacaattggtaaagaggcatttgaggatatgctcagtcattttaatgtctttgacagtatatcagaattgctttattaaacagtgaatattccctttctccattgaaaaggtgaaggtttctatctacttgcatatcttaattaacaatcctgaataagcaccattcatattgaaaaaatatgattatatcctatttacagtatcagtgcaagaggaggccttagctccatttatagcacctcagacattcccaaccccaaacccacctactatgttgacacatttcctggtgctccaggccttattgttctttgtcggaacaaatgccttgaaatgctgctgtcctcttaactaccatgtagtcaccaccactcccccatgctctcacccttgcttcttgaggacctgtctcagaggctgactactccatgaagactttctttttttttcctttttttttttttttttgagatgaagtctcgctcttgtcacccaggctggagtgcaatggcatgatcttggctcattgcaacctctgcctcccaggttcaagcaattctactgcctcagcctcccgaatagctgggattacagatgcctgccaccacacctggctaacttttgtatttttagtagagacggggtttcaccacgttggccaggctggtctcgaactcctgacctcaggctatccgcccgcctgggcctcccaaagtgctgggattacaggtgtgagccactgcgcccagcccatgaagactttcttaatctctccttctgtaatgtaggctcttagaagatgggatcttcatgtaactggtccttctatcctctacaaatagtagatgtttaatgattgaatactgaatgaaacataatccccccacaaatacggagtagtttagatggggaaagggtgaaaaagattatgcgtacatgactcctttctttcagaaatgaattcgccaccaacaaatatttgtatatattcatcaatatgtgggatagtatgctgaagacaaaatacctgtttatgctctctatttgtctatagacaattgtacagaccagaaggcacctacccatgaaataaataatagtaactgccaggtgcagtggctcacgcctgtaatcccaacacttcgggaggttgaggtgggaggatcacttgagaccagcctgggcaatataacaagattccatctctacaaaaaaatttaaaacttagccagacatggtagcactacttgtgaggctgaggcaggagaatcacttgagcctgggacttcaaggttacagtgagctatgattgtaccactgcacttcagcctgggtgacagagcaagactgccattcattgacttataaataaatacatacgtacacacaaacaaacaacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaattagaaaaaaaacagaattaaagatttttttaaaaaagactgatttgtgtatgcaaggattacagcatttatcaacaaacttactaaatatagacaattcatttaaattatatcaataatatagtattcatatgtatcatctggaaagatggggacataggctctgtattttaaaaatccccctatatggttctggaacatggggcccccataataggcatgaaaatggatttcacatatggagcctttctttacattatgattttacctacttagttgtaatctcttgtcttccattaagtaactgaaagcctggagcagaagtgaggaagtttccctctttgtaacctgagcattttgtggaggataatgcatggactgtaagtcagcttgcctgagttagaatccaggctctaccccttacaagctgtgtgatctcttggtcaagttacttaacttttgctgtttctcagttttctcgtaagtaaaataggggaggtagtcataatacctatgtcgtagacttctcgtgtaaacattgaatgagttaatgcatataagggacttagaaaatacctttcacgtagtaagcactcaataaatgctagctttaattatttattacagcaaaataaggttacttctgtctttgaactgtatataaaataaaccaagcagtttaggtttggctacatctgcttcactcagtattttgtcttcaggattcagccatattcctttgtgtagctgtaattaatttcctttcattgctatatagtattctatacccattttatctattctactattgatggacattgggttgttcacagtttgtgaccattgtgaacaatgctgctataaacattcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtggacatggaggtgggggctaaattttgaaatcaagtacagcaaaaactccaagaggtgttattcttccagaatatcttgagtcttcttggccttctgcaattccatatacattttagattctgctttagagtttccacaaaacctgttgggattttcattcaaattctgttgaatctatgcttcaacttggaagacatcggctgtttacaatattgagtcttcttgtcagtgaacaggataattttctctccatttatttcatttgtttaatttctcttaaaaaaatcatacttttctccacagagatcttatatacctttcttttagatttatttctacattcttaaagaaacactcttttaaaatttcatataacttacaatgattttgctgaactctgcttagttctaattttaacttagattattttggatattctatatataccatctgtaattagtgactgtttcttccttttctattctcatacattttatttctttatcttgccttactgccctggctaggacctccagaataatattgagtttaaattgttagagtggactttcttggcttgttcctgatctaagagttttttaagttttttaatcacaaatacatagttttaagtgttttgacatttattgacctgaccacataatctttcatctttaatctatcagtgtacacaattatattaattccaaatgttaaaagttttgcattcctcgggtaaactcaatttggacctggtgtaattcttatatattgcctgtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaaaaaaaaaaaaaaaaaacttgtcagaaatggcatctaggcctagagttttctgtctcagaagattaaattactgattcagtttcttgaatcagtaaaggattattcaagttttctaattctttttgttaattttggtgagttttatttttctgagaatttgtcggtttcatatacatttttaaatttgtgacataaagtttcagtatcatcttttatttctgcagcatatgaaatgatatctccttcattgttaatactgggtgctatatgtgtcttttctcttttctttttgttatcagtcttgccagagattcatcatttcacagggaacaacttttagctttgttaatttcttgaatatgtttgtcttccatttcattaatttctgcttctatttcctttcatctaatttctttgaatttaatttgatgatctttatgtaacttatacaggtagatgtttagttcttaaatgtttagcccttctctttttttgagtcagggtctcactgtgttgtccaggctggagtgtagtggtgcagtcatggctcactgcagccttgaccttccaggctcaagcaatttggccgtctcagcctcctgagtagctgagacaacaggcccctccatgcccagctaatatttttattattattatttgaagagatgggggtctcactatattgcccaggctggtctcgaactcctgggctcaagtgatcctcccacctcagcctcccagagtgctgggattacaggtgtgaggcactgcacttggccagcctttcttttctaatatgtacatttatagcagtaaatttccctctaagtactgctttacctacattttacaagttttgatgtgtttactgttattattattcagtttaaaatattttctaatgatttattctgagatacatgtaataaaagtatattgtctagtttccaaatgttaggaattttctagatttattaattgctttaaaatttatttatttacttttttagagatgaggtcttgctccatagcccaggttggagtgcagtggtgccattatagctcactgcagcctcaaactcctggattcaatcaagccttccacctctgcctctggagtatctgggactacaggcatgtgctgccatgcccagctaatttttaaatttttagtagagaaggagtctcactgtgttgcccaggctgatatcgaactcctggcctcaaatgatcctctcaccttggcctcccaaagtgctgggattataggcatgagccattgcacctggcctttattaatcatttcagagaatctatttgttgctttgctttttctctattttgtctctttacttcattaatttctgcttattatttccttctaccttcattgggtttaatttgctgttttttaaaacatgtctcatgatgagatgtcactgacttggtaacttttcatattttctaatattttaagtcagcattcacaatatttctattaaatttctaattaaagttttaaaacaagtttatggatacaaactactttgtaagtaccatttcatctgcattctgctttttttttttaacagaactgatttcctatgacaaaagtatagtgcctattcatttttttaaaagtaaaggtaaaaagaagaaaacaaaaaatttcaaatagaattctacccagtctttaacaccccattttaatagcaaaggcttcacactgcatctacttatacataaatatgcatatatatgtttatacatgttaatgtattatgaacatctatgtcaataaatatatgtctataacatcatttaatggcaatataatattctactctagttaccacaatttatgtaaccattctgttgggaatttaggttgcttctaatttctccctattataaatagctgtgataaacccttgtcattaaaacttgaccagtattcctaattatttcccttggaaggaaataattgagccgaaggacatatacatgtttaaggtttttgtcacacattataaaattgcccttcagaaagttgtattggtgtattgttctatcaatagtagattacctactttaagcaaggtttctccagtgccaagttgtgtatgtaacatggatcaccagcttcttaacctgtaagattggacctatgcccctcctcctttcagccatttttctatatttgtgggtctattaatggcaaaaccctgatcttgaaatgtaacgtaccaatcctgtacaagttttgatagtactcttttcattatcattgttaggaatatgttctgctgggcatggtggctcatgcctgtaatcccagcattttgggaggccgaggcagaggggatcacttgaggccaggaactcaagaccagtctggccaacacagaaaaaccctatctctactaaaaatacagaaattagctggacgtgaggtgtgcgcctgtaatcccagctactcgggaggctgacgcagaagaataacttgaccctgggaggtggatgctgcagtgagccaagatcatgccattgcactccagcctgggcaacagagcaagaccctgtcttggaaaaaaaaaaaaagttctaattttcattatgatgatttcttatttgattaattggctatttagcatgatttctcaatttccaagcatttagggttttctagttattttgttaatttatttctaacataactactttgtggttaggaaacatactctgagtactcgtttcttgcagaagtttttagactgagcttttatctccatagtaagcattgaggtttttggggtgttttttttttgtgtttttttttttggtgggtggggatggggtcttgctctgttgcccaggctggagtgcactgacagagtcatggctcactgcaacctcaatctcctgggctcaagcgatcctcccacctcagcctcttgagtagctgggaccacaggtgtgtaccaccacacccagctaatttttttttattttttgtagagacagcatctcactcttttgcccaggctggtcttgaacttttgtgctcaagcaatctgcctgcctcagcctcccaaagtgctgggattacaggcctgagccaccaccatgcccaaccagcattgaggtttttctgtgctaccaacatgacataccagaatttattctgtaccccatttttcatagtgcagctctatggtcccagccaggagcaaagggtgtttcatcagagccttaacctcttagatcaccctggtgcaaaagcaactggaccctgtcattctccatctgaccaccccaccccctcctacctctctagagttcctaaaagtacccctcctttccaaaacccacattcttcccctagggcagaagcagctcttgttcacctctttgagttgtaatcctttctctgttctcaggactagtttttcactcactatactgttaattctcacaagctttaacaaaaactttttgtttgactgggcacaatggctcatacctgtaatcccagcactttaagatgagaggcccaagcaaaaggatcgtttgagcccgggaattccagaccagcctgggcaacatagccagatcctgtccctacaaaaattaaaaataaaaaaattagccaggtgtggtggtgcatgcctgtagtcacagctacttcagaggctgaggcgggaggatcacctgagcccaggcattccaggctgcagtgagccatgattgtgcccctgcagtccagctctaggtgacaaaacgagaccctgtctccatttaaaaaataaataaataattttaaacatttcatacagtttttgtagttggcgtttttgtcatcctcagaaaaaatgctggttggaaaaatccagatttgctctgtacaacagtgttcttcaaggatatttgcagataagtaccaatctgtcaccagtctgccatgagatacatacagaaattgacagtaaacatttagaaactgttacagcaatttgacattgctgtgaaatcatagcacgtgattttgtgccttcaactccagataatcctgttgccaaagcagcatattttggagtggcatattctgatctccctcaatgtgcagccagtaataccttgtgcctcaagacctgtgatctgttttgtttatttgatgagtttggttttggataatttcttaattatataaataatgcatgtttattataaattttaaaaattcagatggatgaaaaggagagacagctaagctcattcataatcccattacttttcacaattcagactaaactgcccttaatttctctctgcatacagtatagaagtccacctcccccatactcttccataggagggtttcttctccctctcctttcattccctcagaatggagccaactaggaaaattcacaatgtgttctttgggggttcttgacagccccagaagcaccccaagatgggaagccaaagagaagagcaataaaagatgccttgtcagtttgtagaatcattatattatcaaataaagtttatcaaagaattgagtcatcaactttgttcaaaaggttcaaggttaggatatcaggatggtatgtattatgaatatgtgtattttaaatttcgttgaataaaatttgcataaataacagtatttttagtttttatttctatatctcatgaaatttaaaattagtagattgcttcttttactttaatatcaattaatattataaataatcaaatagctttaataatagaaaaatattttcacagtgatgcctctctttcagagtaacccttcaaagaatgtgcctgtatatttactaagttgcacaggtggttttgtttgatatctgtggttatgaagcattgaattaaaaaaaaacatataatggctgaaagatcccatttacaatagcaactaaaatataacatgtacagggaaaaagcctaataataaatactttaaaccaatataaagaaaatcgtaaaactataacttagagacatgaaaggaagtggagagacatatcatgttcattgatgagaatattagaaaatgttaatttctagaagttaacctatacatttaccatctgaatcaaaatacaaagattttttatagtttgacaaaatgattttaaaagtcaactgggaagaaaaaaatcataagaaaatgttggtgaaggccagttgtggtggcttgtgcctgtaatcccagcactttgggaggccgaggtgagcagatcacttgaggtcaggagttcgagaccagcctggccaagacggtgaaatcctgtctctacaaaaaaatacaaaaattagctgggcatggtggcaagcacgtgtagtcccagctacttgagaggctgaggcaggagactcacttgaacctgggaagcagaggttgcagtgagctgagatggcgccactgcactccagcctgggtgacagagcaagactctgtctaaaaaaaaaaaaaaaaaaaaaaaaaaaattggtgaagaataatgagatttttttttgccaaatattaaaagctgctactacagtattttattttgtctgtccatgtttttgtttttgttttgagatggagtctcgctctgtcaactggagtgcagtggtgcaatctcagctcactgcaacctctgcttcccgggttcaggtgattctcctgcctcagccttcagagtagctaggactacaggcgcaggccaccatgcctggctaatttttttgtatttttttagtagagacagggtttcaccatgttggccaggctggtcgcgaactcctggcctcaagctatccgcccgcctcggcctcccaaagcgctgagattacaggtgtgagccactgtgtccggccctacagtattttaaatggtaacttgatgcaagaataggcaagtcagtggaagaaagtagaaacctaaaaatacccccatgtgtgtatgcacatgtgtagagattgtcatttcaagtaccagtatttcagatatgaccagacaaaatggattgatccttgctgataattatagcacagggcagtaaataatttccaagtatttctcacggactggttccctccttagtctttatacttctcaccactttgctgcctcctccccaggctccgtcttttccctcatcccttctgggtccctccagaaagtcctctagctctcagaacatctcccaaattctttttggaaacaccagagtccattgaggcattttatttgtaagtatatattacatccctagaaaaagaattccaggattttccctcctatatgttttcatcttgcttcttcatggtccataatgccagctgaggtcgttagtacagtgaatccaaactggtgggataggaacaggttattctgccattttactagatctttgggttgcacatcaaatctgggatctggggctgatcactccacacttgtttaacctacctcaggttcacaacaattttcccagctctatgatcatcagtgatttcaaattcaccaatgtaaccatgcttcatcatcacagttagaaactggacagtaactttggagcacaacctaataagaacctggtgtttgcctctttttggtattgttgatgctctggatagcatcagccaggacattcatgcacaccattatggcagcatggagagatggcagaaagagcctaaattcttattgcttcattatgcaatcagtttagctctctccttttcctaacccctctctcatctaagttgaatcgtgcttaccctcatatatcacaattacaaaggaaaacgcctaagcaaaactgattccttcgctatgagatgttttttagtcctcatagatcaactaaccagcttaaactacagccagtttttaaaatagcgtttcttttctccccacaggacaaagaaatgaaaaatatttactctctgtagtaatcaaggaaatgcaaattaaagcaatcatgaatgacttttttcctcttatctaattggcaaagatggaaaaaaaataatcattatcctagtagagcaagggacacattcacacatggtagtgggagtataaattgttaaactgtttctggtcttgtgtatgtatcaaaagtgttattgtaggccgggcgcagtggctcatgcctgtaatcccagcactttgggaggccaaggcgggcggatcacgaggtcaggagatcgagactatcctggctaacacggtgaaaccccgtctctactaaaacaaatacaaaaaattagccgggcgtggtggcgggcgcctgtagtgccagctacttgggaggctggggcaggagaatggcatgaacccaggaggcggagctcgcagtgagccgagatgcaccactgcactccagcctgggcgacagagcaagactccgtctcaaaaaaaaaatgctattgtatataccccttgtcctagcaactcagcttgtaggaattttaccatacagataatcagagttgctcaccaagatgcatgatcacgttcatccaggctttatttctgatggtggaaaatgagtgctgccatactagggagtagactagaccattataataatgtttatagtagactaggcaactataaacattattttggagaagaatcctatttgacattggaaaatgttccttaggtgtgaaatggaaacttggtaaagtttttagagcctgtataaatgtgaaagtattttcattcatttatataaaaccacaccgagaatcaaataatagaatcaactgttcattaggtgtctacagtgtgtcttctgctgagtattaggtaggggtacattgaaagtataaatatattttttcttgttctttaggactttacactatcatggaactgttgtagggcttaaagatgtgcatttgttccttgcacacccagtaggtatagctataatcaatgggaagagcacaggacatagctagacagagatttcgatcttgtccctatcacatacttgtccactcacttagacaaattatttgaaaatgatgctgacctcatggggtggttataagtatgaagggaggcataacaaggactgcttcctatgatgcctcatgaataggaagtatgttagttcctttactttcccttccagaagtttctatttcctcagtataatatctgcagcaggtatattgggaaactgaactactgaatgaatgaatgaatgaatgagatactggatttaaaaatatgttataagccttaaagcattatgaaaatgttagctgttaatatttgcatagtttcattaatatgtataatatggcaaaattcatgtatacatatataggtgtatgtggggggagggggaggtgtttgtatgtgctaaatgttatggaccatatagagttgttatagaatgaaaagcaaaggaaggcattaatatggctggtaatcattgagggggcttccagggaaggtaggattggaatgaaaccttgaattaaggtaggttttgaaaatgaaaagcaatatatacaaaagtaaaaaagaaaatggtgtactcagggagtgataataagaccattctgcctagagaggaagattttcttgaaacatcagtggacaaggtaggtagaagaggcaaggtgtggccaagacaacaagaggccttacttatctagtaagaaatagaaaactactgtaagttctaagacaatatcgtgacattgcgttaccaacacatctatgtgttacaatatgtttgtagcgatgaactttgggaatggcagtgtaaacaaaaataaattttattttatatatgtcattgttttttccttccacagtatatagcctgaattttccatttagtggtaataacaatagcaagattgttttttaaatccttgtattctacataactgaatatttttggaatttgacttaaaaatatgcacacaaccctagcattgctgttttctgatgcttctttttgtgaaaacctaaagaaaaattatagtcaattttatatactcaatgttatttgatattactgttagcctactcttcctgtttctttccctgcagattttcaatgtgaagatgactgtcatgccctttataatttatgtctatatttcattgaaagaaaggagatttaaataacataacccttagcagtaaatcaactaataacttagttacaatgtattcactttcagtgttgtcttcctggaatttcctcttttcttatgttctttttcacatttttttacagtatggatggagcagatctgtgttttgaaatcgtaaagcgagctgacgctggttttgtgtacagtgaagctgtagccaggtatgtattgtatatctaatcaccagaggtcaagttgaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggtcaggagatcgagatcatcctggccaacatggtgaaactccttctctactaaaaatacaaaaattagctgggcgtggtggcatgcacctgtagtcccagctactcggaaggctgacgcaggagaatcgtttgaacccaggaggtggaggttgcagtgagccgagattgcgctattgcactccagcttgggcaacaagagcgaaactcagtctcaaaataaataaataaataaaatgaaaacgtgggtttataatacaggcttacattttcagtactgctgtctttcccatttctgatgatttttgtacaggaagcggggatctaatagctcaggaaccatgtagaattctacttgggtttttttatttttgttttggcaaatctgcctcattagttcttcattttgccttttagtgatatcaaattatctcacaataattaaggaaaagtaaagaacagtaaaaggaagagaaataaaagcaccatttttaaaaatatatttgcttcaggccagtgtgagacctaccaatcaaatggcagctgttgttctaagtggagaagttgtttgtaaagacctaatgactcaaaataagaaggaaatatgggccgggcgcggtggctcatgcctgtaatcccagcactttgggaggccgaggcgggtagatcacgaggtcaggagatggagaccatcctggctaacacagtgaaaccccgtctctactaaaaatacaaaaattagccgggcgtggtggcgggagcctgtagtcccagctactcgggaggctgaggcaggagaatggcatgaacccgggaggcggagcttgcattgagcagagatcgtgccattgcactccagcctgggcgacagagcgagactccgtctcaaaaaaaaaaaaaaaagaagtaaatatgaaaaatcacaggagccatgcacgtgctgggccacttgcttatacatttagagcaacacagctttctgttttggttacattcaatcataattacccactcctgtaggttgcctttttaatacatggaatacagcatccctccttagtcaccagccatagtatgttgaagggttcaaactcacaaacatattaagtttttttttttttgcggggggtgcgggcggcgggggacggagtctcactgtgtcatccaggctggagtgcagtggcactatctcagctttctgcaacctctgcctcccaggttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattgatttttaaagccacctgtataagctgttaaaatggtgaaaggaactttccagagtggaccagaaaagagtagcattgggaccagtagatgacattgcaaagagagaggtttggaggcagtttattaaaggttcttcctctgaacaataaaaaaaagtaggcggggactcagaaagtattattatgtgtgtttgctattgcagaggatcaatgaccatgcaacaagggcgcgtagattcttccattggtttaatgacagatgacttctaatctttcttcgtcctctctgattctgtgatttattgttaggaaattcagcttgtatcagtattctagtgagaccgactgcaagaagactctgagacaccaagtaatcaaattgataatgttgtttttctccaactggctgagcttcaagaggagcagcaaagcatggcataaaataaaactgtgttcagtccttagtgcaacccaattagttattacctccatcctttcaggggtgatgagttgtggagtgagctaacacacaagatcagattatcaaatcaaactctcagagatcttcttaactagtaccaagctttactaaataatctcaaggatacaggcagtcagaaggctcaagtgaagcagagaagggaagggcagccccccacgtcacttcttactgcctcagaaatgcacctctggcccagaatagatgaggtttatactggggtttgtgggtttccacacacaaaggggagcattgcaaatatcttcattttacaccccagagatttggatagctccattgacattctccaggaagccatctgtgcctcagagatcccgtgttctacttaccatagtaatccttagccagagatatcctattaagggcatttcagagataaggtctcttctgcctagcaaatagcattaggcttttcacctgcattgacaagaatagcagactgaatcacctctcttctaccatgctgcacccctgaaatgcctccttccaaaggcagtaaatgcattgctggccagctttttccttccatggagttattatcttgctgatccttaggaaagataaagataaacaaatatattgctgagtttctctgaaagcacaggtctctatgatgcttcatgaagtgaagttttttgattaaaagtttagtcagcaacttcctagaacatgtgggcagattttagttcttgttttattctgcttgcacactttgacatgcattgcctcgcaggatcatgactgggagggtggagaaagatagttcagttctgttataacttgggaagaaaaacagttccactgtctccacacacgccgcaaagattctgctgtgtacatacgtttgggtcaagtaattgagtgttctcatatgcaaatgaaaaaagcctcattcattgagtttggttttgtgttatgagactttgagataggaattttctttaggttaaagataatttaggtggctgtctcagtgctttgtatccaaaatagttcattctgtgggtacaagctatgtccactttaactaatttaaatttacccagtatttccatgttgacatctagatggacaaataagctgttcctaaatctttgattgaacttaacaataataatattgtactaataatgtcttaacctttgtagcatggtttagagtttacaaagcactttgacaggtgtagtctcttagccatttcaaggggttacagatcttccaaagcctgatttgaaccagtaatgggccacaacaccaagttaacccctcatttgaacaaaacttatggccaggcgtggtggctcatgcctgtaatcccagcactttgggaggctgaggcaggctgatcacttgaggtcaggagtttgagaccatcctggccaacatggtgaaaccctgtctctactcaaaatacaaaaactagccaggcgtggtggcgcatatctgtaatcccagctacttgggaggctgaggcgggaaaatcgcttgaacccaggaggcagaggttgcagtgagccgagatcccaccattgcactccagcctgggagacaagagggaaactccatctcaaaaaataaaaataaaaaataaacaaaacttaattacaggctacaatggcccaagcaaagagtatatgagcacaaccccttatatgtgcatttgcaaagtaagataaattaaaacatcagagctaatgattacatgagcctagctctctggcttaaagccccgttgtaaggagcctgtgattagtacaggaacaaggcttgtgattagtacaggaacaaggcttgggtttgtttttgtttttgttttttctcctacctttcatttttaaaatggaacctttccaattaattgtaatacatgaaataatgcatatgctaactagagaaatattcctgtgagcttgattaaatggtatcatgccaaagagggaacttgatggaaatgtcttttaattgtaaagccaggatagggattttttttttttttttagtcctgagtcacatacacatgttcaaggtcacttgtatcagaaatataagatctggaaacaaaacaaaattctataaatattatacagtgaacagtgttaagtctattgcatttctgtcatgctggttgggaaggaaaagggaaaaaatgagaaaagaaggggaataggaagaaaagagacaaatatggagggaataaaatacagaaaatgaaacagatactcagagaaagagtaatagggcaattatagaagaactttagaaataggagaaggaggttctaaagtggtactgaatcaactgctcttgtcacacatggttgctagttaaccccattaccattttttaattcctgttctttaaaatgctgatttcttctttgttcttcacctgtgctccatgagggctcctcagctggccatgtaaggagtcaggctttctaggacatgtgcctagaattaactccactttgttcaagggagccccaactaaaacttgattatgttacaaaaagaaattgtccgataagggtggctcttccctcatttgtcctcacagctaaatagaagtaagatgaagagcatcttattatttgctggcagatcaaaggctcccactgcttgagtctgaatccttggggcagccctgagcactgtttacataacgcagtccagtttaagtagaattacctgagtattggggaaaaaaattgtcatgttttaagcttgaatttttagtttgcaaagcaaatttacttatgaactatgtgtaattcttttgacttagatagcttagaaaatatagagcatactatttcttcatgaagcccataaacttttgagtctgccaacattttcattattaagcctcactttacaccaatcctgtctgctcaaatcaaatgtgtccatggacagctaatatgagagtgggagttataaactaggagcactgtatattaagttttaaaataaaaattgtttacagtttttagatttcttttgttttttacagccattatatgagacagatactggaagctctacgctactgccatgataataacataattcacagggatgtgaaggtaagtcatttgttatcactaactttaatgtttgtgaagaaatactgatataacaatgataatcaagaattcttctttaatattgtcataaagaacatcttaattttacttctaagtaaaaatgtatttaactgctttgtatttgggaagtcattgtactaattcttactaggaacactataatttcaatttatttatttttactgaagtgttcatgcaatctaaaattgtattatttctcttttgccattgtgtgtgagagagaaatgaaaaatccaataaataggaaaaaccaaacaatatcctatactgagttaattgggggggaaattagaatttggtttatatagtaaaagttaatcataacatattttcataatattgcaatgcagaatagtcagcattgtatttttttgcagatagtttttaaatatagtatgaaatcataattatacatgtaatacgattttatgcttggaataccggtattatcattattcagtctttctgcctatttcatcccagtatcgggttaatgagaactctcagttcctggttctttaacggtgtcaagccaaacatagagggaggcaagaaatgagaccagtaggccttcctcctgatccctagcttctcccaaggcccagaatcactagggagcccctgaggtccctttgaccctgggctacacttttaagctctgatattttgtcactggcctttctctaacctccagcatgcacatacatagtgttccttccctcaagatatattattaaaggcctggcttcttcgatgtatttaatactttaaatgattaagaaaattaagtagagtttaattaaagtgtctataatgtttgggaaattttcacagaaatccttgtagttaaaagctgagggaaaacatgagcaattccaaaaccatctagtaaaatattttaatagcaaatgaaaatcactggagaaatatacaaaatacacattagtgtaaattagttgtaaaatatctcactcatccttttcagatgtgttaagaaaatgatattgttattatcagaactcaacaccgagcatctcaatgggtccccctttatgaaaaagtattctggccaagcccggtggctcatgcctataatcccagcactttgggaggccaaggcgggtggatcacctgaggtcaggagttcaagaccagcctggccaacatggtgaaaccccatctctactaaaaatacaaaaattagctgggcatggtggcacatgcctgtagtcccagctacttgggaggctgaggcaggagaatcgcttgaacccaggaggcacaggttgcagtgagccgagattgtgccactgcactccagcctgggcgacagagcgagactccgtctcaaaaaagtattcttcagttatccaaaaagaaataaaagtgtggaaaggtaaaaggcgggaaattgtcaactgtagtagtttgctgtgcagttattttgcattaattaatgtaagaaagttcatatgtagagagtaaaatatatctctttgtatatattctaaactatatacaagaaaaaaatgataatttaaaaacctaaaatgtgttcatgtaatagcattatgttaagaactgttttgctcaagaggcaattttattttgaatgaattattctcgaaagataattatatcaacatcatataataaacaatgattgacaatatattctactgtaatactttcaataatgtagtcagcttttgattaactggtatttgatatgacaacctaaacctaattaatatccaaaagtagataatttgacctcaccttttaatttaccttctgatttatttatttaacaaatatttgagtgcctactttatacagattactgtgcttggagccctaaaagtattatggtctcagtagggagataaggctcggtatctcttatctactgtagcagatcaacacatgccaaaacatagtgacttcaatcaataactgctgcttacttgctcacaattctgcagtttgggcagagcttgataggactgctcaattctgtttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttagggctccaaaagagcaaaaatggaaggtgctaggcctcctgaagcaaactgacactgtgtcacatcttatgcatttcattagttgaaacatacttcacaaaaaggtcacaaggctagtctgagttcaaggggaagaaacatagattcatattttgattgatggagtgccagatatatacaaggatgggagaacttgttcgtggccacctttagaaagacaaataattattgtgcaaggtagaaggtgataagtatcattaaaagatgaggtcagagaagtttcctgggggaggtcacattggagcttgttcttgaatcatggggtagttatatggagacaaaaagacatttcaggcagaaggaacagtttgtgcaaaggcccaaaagtagtcttacgttggagtatgttagattagtttattatttctaaagtacatgctaaatagtttagaggaagcacgtagaaacatgccaaggaatgaaaaagaagtaattctcaaactgcaaataagtaagaagaaaccaccccaaaaattgccattgttcagttgggagacacactcaacacagagcacacgttaatgttgatattctttttttgtttgttttttgtttgtttgtttgttttgttttgtttgttttttgatacagggtctcgccctgtcacccaggctggagtgcagtggcgcaatctcggctcactgcaacctctgcctcctgggctcaagcaatcctcatgcctcagcctccagagtagctgggactataggcgtgcgccaccacacctggctaaattttttttgtagttttttgtagagacgaggtttcaccctgttgcccaggctgctcttgaactcctgggcttaagcaatcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattctcattctctctctctctctcataattcttggcatatgatccaaaagcattacatttcccaaggatcctgttattatatttattaatacttttttctttacttttttacaaaaggtatttccttttgtaatcattgtaactgagtcttaaaaggattatttggttagatttgaatatatggtaccatgtaatctatttttgggaactgcttgctctgaagaagcagtttcacataaaactgcataaaaagcaatcatataatcctttgaaattcgagagatgtgtgaacatagtgctgggcctccccacagccacacttagtgacatatcaggctatattctttgctgtgggaggctgtcctgggaattgtaggatgctgctaagcatccttcacccactagatgccagtagcatctccccctagttgtgacaaccaaaaatgtctccaaacattgctaaatgtcccctggggcacaaaaattgtccctggttaaggcccactgtcataatagactgttataattctcaagatttgcctccctacaggtattaattaaggcatgcatataaatttctatttttttctgtcatcttcttccctttaattctactttttcttgtgaaagaatgtgaaaactttcattatgtttctggtatttttttttcttcctctcacccctaaattaaaagtactttagaaagaaatagcacagttgtcaaggtaaatgcaactcctggctctttgccttctttcatgggctctactaagcactgagagtttgtggaattttctcctctctcctaactcttgcaggcagccttagatcatgaggttgtggggagacttagttttagacctttctgtcactctgacctactcatgtataattctaataactgaagttgaagtgaaacagtttctctgagaatgcaaattgctacccacaatcactttctattctgaatggtgcctgtgcccagaaggtctgggtgctgtttttagttcttagaactgtgcaaaccccagtcacacacacactcagccagaggccagagtgtttctgagtgtgcttcctttaaatggttttccttgctaacctgtgtgaacacgcctggctgctttttggttcccttctggtctcagttctccttttacctatttaaggccagactttatgataaatttgtgtttatcatataacactggttggcatgacattgtggatttcttaaagcattccgtagtctcttgttctccgttactgatgtttcttttacacctgataccacaactccccaaagtttatcatgttgtatagagaaatttaaattctcataaaacaaaaacgtatttattctttatttattttatttatttatttattttttttgagacagagtctcactctgtcgcccaggctggagtgcagtggcgccatctcagctcactgcaagctcaacctcccaggtccacgccattctcctgcctcagcctcccgagtagctgggactacaggtgcccgccaccatgcccggctaatttttttgtatttttagtagagacggggtttcactgtgttagccaggatggtttcgatctcctgacctcatgatctgcccgcctcagcctcccaaagtgctgggattacaggcgtgagccaccgtgcccagccactattctttattattatattaacattggttaatcttctgcatttcttttataagattttttaacataatgtgcacgttcagttttaatgtggcattttaataattgtacttaggaagatctcatggattacatgattattataaatttatcttgtgtttctaactgctatacttctctttgcccagcctactcctacaaaaaaagaaatcaactccttggttttaagtttctcagcctgagcaacatagtaagaccctatctctctctctccttttttttttttttttttgagatggaatctcgctctgttgcccaggttggagtgcagtggcacggtctcagctcactgcaacctccacctcccacgttcaagcaattctcctgcctcagcctcctgagtagctgagattacaggcgcctgccactacgctcagctaattttttttatatatatattttttagtagagacagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtgatccccccacttcagccccctgaagtgctgggattacaggcatgagccactgtacctgactggaagttgtatttttttaaaactcctaagtccagtgagattattacatgcagtatagcttatgttaaacaaacattactgtcttagtcggatgagttttggtctcaaaactcatgtaagaataaaactacttagtctgggcacaatggcttgcccctgtaatcccaacactttgggaggccaagatgggcagattatttgagctcaggaattcgagaccaacctgggtaacatggcgaaaccccgtctctacaaaaaaataacaaaaattagccgggcatgatggtgggcacctgtggtcccagctattcagaaggctgaggtaggagaatcacttgaccccgggggggtggaggttgcagtgagccagatcacgccactgcactccagcttgggtgacagagtgagaccccatctcataaaaagaataaaactacttttgtaactgtggagaaatctgtgcatctcaggaactctccctgatggactttgagttactctatgatttacatgtctagaaatcactagattggacacttccatttacagctagcattcagggcggtcacctcaagttcccaaatctcctttgtctctgcacattaatgagccaaaaatccaattactactataaacgaattgatactcactgtaaatatttgaagccagaatgtgttcagacttttctcagaacattttcatgtctcagttaagcatcaaagtagaaaaggaaaaaaaaatttactgggtttttgtgtgtgtgtgtgtgtggttttttgtttgtttgttttgcccccggaataacctctggtgatttttgaacacatggctcttgggcaatgtactgtgaattgcttttacagctctaactcaggaacaaaacatgctatgagattaaagccttggaaggattacgtgaacttactttaaacttcattttggacactgaagtaattactatgtgaagaaaaaaaggagtctttaagcagtctctaacaaagtggcaagttactattaatggttgattttattcagctgtttttgtttggttatctgagaagagaatatcagtaccatggaagtagaaatagacaagaagtttatagctccaaagtgcttatgatctctttgggcagatagtacacgcttttttttttaatcataatatatgtacttattacagaatatagtcaccatcatttgtctactgacaagattacatgaaagaaaagaaattaacattaagaaatgcttatctttaaatgttcacttaaatattagaaaaaattggggtgatttacttaactatgcacatatacatacatacatacatatatatatatatatatatatatatttttttttttttttttttttttttttttttttgagacagagtctcactctgtcgcccaggctggagtgcaatggcatgatcttggctcactgcaacctccgcctcctgagttcaagtgattctcctgcctcagcctcccgagttcaagtgattcttctgcctcagcctcccaagtagctgggactacaggcacacaccaccacgcccagctaatttttgtatttttagtagaggtgggtttcgccatgttggccaggctagtctcgaactcctgacctcaggtgatctgcccacctcggcctcccagagtgctgggattacaggcatgagccaccgcacccagcccacttcaatattttcatcagtaaattagtatactttagagttgtggtgattaaaataatatatgtaaagcatataagtagaatgcttggcaaacagcaagtgcttactaagcgttagctactcataatagtaacagctgatttaataataggatctgtaaataagatagtattttctgctctacaaatgaagaaattaacacgtacagaggataagttaatttgcctaagattgtccagctaaataaaaagtagagccagattgaacccaagaagtataacttcagagatcaatctcttaactgcaatactattacactcccttattattcattcatttatttcacaaaaaattaactgccaggtactgtttgtcactaataacattatttatattgaatacagaagaaaatatgcacaatgtgatgaagatgggcatataatgacatagctttttactttgacaaagcctaatccaaatatttaagcatttttataagtatcatctgctttaaaaatatagtcaatgaatattgcttctccccaataacatgagccagataatttcaaataaataatatgtttataaaaccttggatttttttcactgtattattcatgcatttaggtaagatgtgaatgaggatatttcttatttatttttttacttatttttatttttttgttttgttttatgagacagagtctcgctctgcctcccaggctgtagtgcagtggcacgatctccgctcactgcaacctccgtcccgggctcaagcgattctcctgcctcagcctcccgagtagctgggattacaggcgcccaccaccatgtccagctgatttttgtatttttagtagagacagggtttcaccatgttgcccaggctggtcttgaactcctgacctcaaaatgatccacccacctcagcctcccaaagtgctgggattacaggcgtaagccactgtgcccagctacttatttttaaagattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccattggaaacctttcaggaaatagatactcatgaaaggcatggcactgcacacaagtaagtttgcagtcacaaggtgtgacaggtagatgtgcgttgatgtttttttacctatttttgttaaaaatatccattgagagagagtgtttccaaaaacaccaacaatacaaaggaggatgtaaatgattggtaaagccatggaagagatcatagatggttgaatacatgttgtattgttgttcatttatgtcaggttttcttgaattttgtcacaggagctagaatagaattgcagatatttaatattaaaattatttttggtacagtatttaagctgaatagtttttaaaaaagaaaaacattgaattaaataaaatagtaacaaaaatgtattggatggaacgggaaagtatagatggcttcttaccttttctaatcacgattgtccggttgaaataaagacaaaaagttacttattgtgatggataatgcctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaacataaatgctggtttttacttttttctgtcttatatttaaatctttctcgcttcaaagggtacacatgaagtgctgaagaatcatatacaaactgcttttattcttatttttctccttatttcctcacttctttcaggtgagaataacaaaagttactggattctggtcaaataagaaccatgatctctattcagaatgtgccatattctctgtgttcttcaccatagccttctgagcaccacattctccactctttcatgatctagagcaaggtttctcaatcttctttttaatcatgttctcttttgataaacataaaaactgtaccatacacaaccctttgaaattcttatatccccccagcccctcagggcaattttactctctacccccttcagaattatggtttgatttattttctgcatcttggattacagaaattggggttttttttcaaatatgatattataattttataataactttttaaaccaatccacacccaaagtcttgaaaacttgaggactgtgcagtgtctgtgggtttaaataacaagattcttaattaatgtttaccactgtctttataattttatttctttgctatttttatttagaaaacagtccatatgcttcattgtaagtttgtatctgaatctagtgcaacctgatgaattataatctggtttcagttagtgtagaccctggtataaatatataaaacctaatctgtaacttcaccagttcaaaaatcagtcagacagtgaaatgagccagtttatttaagaaaaaattatctgctcacagtaggttttgattttacataaggattggagcttccttttatgatgctgttaaagaaaagcagtagctcctaccttgtgcagataatgcatagtatactaaaaactgcaaaggtaatggtgcttctgtatgaatattaaatgcttccaaacaaaagggacatagacttctgcagaggctagctttatcagacagaagttgagtctctgtaggactctcagtgtagcagtcaacaactaggtcaccatctttaccttcccaaacttgtatctactatgtacatctccttcaaaaataaacttggatcataaaactactagataactattttccagaatttggaaagtactattaagaaatcaaataaaaattacatgttacagatgcaaaactggtctccagaaaatgtctctaagtctatattcccctcaggagaatgtctatctcaagtcactcatgcatacattttgtctctgctaatttgacaaatgaaaaaagttctacaactcttaacttcagttactaatgactgtctacatagttaatatgctgactgcctttcttaatgatcagctttcaaaatttaaaccattaggtcctgtttatttttatagagtttaatttttaagctaaaaatgaataataatcactcttacctgtatgagtagtttatgccaactaaggttatattgttcagggcagtgatgccaaatttcagacttaaaattctctgatcttcactcttccaatatctttagtcagtgtgaatagattcttgcatgacaccaactacagtgggaggaaaaggggaaattaaacagaatattgaagaaattcaatagttatggtcaatgtggcaactgcctcctcaaaaaaccctcatttctctatttctgtagtgggaggaagtggtgaacaatatacatattatacttccttatgattatttcatgaactagttacactccagtaacctttgtttgcacgattgactgaagttaagttcacaggtttaatcccccatggccagttttatatgacacagtgatagaaggagccactctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattgaaagatagttgtaatattatctgttcaggcataagcgtctttggtccgaaaaaagaacgctcttgttttcctccattgtctccaaactcagtaaatgataccatcactccttcagttattcaagccaaaaacttacgaatcatccttaattcctctttctttcacatctcacatctaatcaattgctggtactacagcttctactatcactaccatcattcattagccacatttcatgagagcttactatgtgccagatatctcgctatgtgccttacatccaagtcttatttggttttcacaacaccctgtgaaatgtctcattttaaaggtgaggaaaactgaaactcagaaagatctcataagttgcccaaggtcacacagccatctgtcctcacaggatggtgattggctcacctcaaagcaactaattcaagaacaagtccatagctgcaatgcctttttgtgatctagcctctgaagtcaacagtgtcacttctgcagtattctattggtcacacagagccagccctgcatcagtgtgggacgggtaaatatcaggaggtgatgatcactgggagccatcttggaaactggctatcacagatgtcaatcaaccgttgaaacaaaggaagagtcagaagtactgcttaaaaaccgttgtcagtccactggttgtttattggacaagcatacctggataggtgtaagttttgccagttcttacactattttggtttttaggtctatttttgttaaacagtgtaattcattcaacaaatacttattggagtttctactatgttcctagcagcatgtggaggtcacagaagtaggatgtttagtcacaagctaattgagggtctctggaaattgagcagattccacaagcaagccaagaatttagattaatatgtgatacagatttcaaatgctctgtgaattagagaagggcagaaacagtgactcaaagtggttctgaaaggctttgtgaaagcaaatggaaggaaagagaggagaacataacctagtaagtgacagttttgtgccaggtatgggacagagcattttatgactaagaaccctagagatgtgtggtgggagtcccattttacacgggaggaaattgaggctcaaagaggttaaatagcttgcctagaggaatacaattagtaaattagctttaaaatgacctcattctctgccttagaaagaaattattggttgttctagcaggtcaataagggtaccttatggtactcacaatagggtcatgttttaagtatttttaactttgttcagatagggtttcctgttctgatttatgtatttgtgtatcctgttctagacttgaggtagcagaaactgaccatggaagaaatcaagtccagtttttttctgtctttgaaaactctggactttgttaagcaaactattattccaacaatggcagtataaattctttaggattcagtgattttgagttccccaattgaaatatatgtaaattttattttcattcttctaagaaattaggaaatattgttacaattggtaaaaagagtaaatgtcagggaatactagattaataaagtatgttacaagtattctgtaaaagtggcccctttggacttttctcattcaaatcaccaatagttttctttggttctcattcatcttgcccatccgtctcttcaaggttccccttctattgtccaagtccaaatgctcttggcctaacagttctagttgattcctgtatcatctgccaaatattgatctcctaagtgttctgctgtcacccttaggatttacttccttgaggtgttagagttatgtcctacaattgaagttctgtcttgtattaattttcctgcttttgagatggatttgtgtatcaagtgtgttttttaatctggccccaaaattcatctggagtggttcagtgagagtgtttcaaagggcaggcatatacttacctggcagaggagataccatcatcaaagggcaggcatgtggacatttattttggcaatccatggtgggctatacatagcaaggggacatgagagctttcctgactcacatggattgttggggttagaattagggtcccttatcaatttccctcagagccagaacccagaggacacaggacagcttagtcattcctgaagccatgtgcttcatctagaaattattttaggctatccaaactagtgtttaaactggctgcaactggcctcttaagtactctcactaaccaatcaggagctcagggcattgggaggctggtatgcagaaagagaagacatgactaatttagtacacattagaatatcatattcaaaagataattatttctttaaatcaggggcagtggtaagtaagccttgtccagttcaacatacacccaagccagtggttatctttaggaggagtgagacacagtgcagttactcaaagctatggtttgttcaaggctcactgagccccctgccctctccaggaagtggtgtctggccacagccttgtttccagtcacactgttctcaggccctcaccgcctgccacaagcagctctgatcgtgggtgtcccacccttaatcagagtgtgaagaaaaacctctccttgttctgaagagctggtttctcagcaagcaatgggagcgtttctctcaagaattacttttaaaaacagcagaaaatacagtctgaagtttgtaaatttataataacacagaaaagttatcagcttttgtaaaaagtaaagcagaggttcctcttcgaagactttcctccccatttaattaggaataaatagtaacttctcttagaagtgaaatttattcaaagacctgtgctaacattcttaaatatctgctagccgtgataaagaaatcaatgtactttatgttcttagctcccacaatttagcctaaatatttgccctggcatgcttatactggtgcaagcaagcattgggtcatagcctgttcctcttccttatttgcaggtttttacttttctcagcattccacaagttacttcctccttcttttgttctcctctgcctttgccttttttaagaagttctaagttgctagccaatcgggacagatacagaatgcgaggtcccgttccagccaatggaaaccggacacagcagtagggtggacacgtcagcttataaatgaccctgtctcctttgttcagtgtactcttgtggcaaaactgctggcgagtgtaccctttctgcaggaagtaaaaatggccttgctgagtaaattaaatttatgttcaagtggtatttctttatggtaccggggaacaagcatttcaaacgcttttaagaaaagactaatgacaaaacagaaatggacttggtgagttgaaaaacacatacacaaactcaaagggcattttcttattagtttgcatttccttgtgcatccagtgaaccaactccccaggagttggatccatctctaaattccgctagtaacttcaccttcagtaaccgattgcagcacagctgctgctccaaactgtgggtgaccacccaggaattaaaggttcctcatctcccaaccctttcatcctttgtcttaccaaaccacatgtttccatgaacctgaaccagggccattccagcaaaccccacttcattgacactgagaaagagtagagacaggcttggcttcagctcacctccactagagcactcccactgatcacaaaacccacaccactacctcaaatgctaatagttcttaaagaattccaggaattggccttatgagataactaagattgcctcaggaaggaatgctgaacaattgatttacagccttgttgccacaggccacgccaccaggtggcccattactcaagataaccatagcaaccagatctgctgacctgctttgctcagcccagcctgcatacccttcccctgttaccagttcctgcactttgcctaataagaaagccctatgactcttttcagaaggaagcccgggaattctctctctcttgtgctgcctcccttttgtttgggcataagctccagtgaagctttgtctatgaaagcgcttttggcctcatatcaatttctattgcattgagagtccaagaacccatgatcggtaacaatgccaattgagggtagaaaaaagaaaaaaaatcacacacaaacccaaagtgctttttctattctctcattcaacaagagtctaaacagatgacctctgtgaccaaatgtgtggggatttctcccaatgaacaagcaagcaagcaattcagtggacaccagctgtgtgtcctctaattcagttctattctgacactatctacctggagatagcgtcagatcccacaggttgaaggctgagtccccaagacttcttcctaccttcagatgccagtggcaagccccaggttgtttcacctgtgcttctgaccgacaggctataaatcaaagatcccacagcccctctttgggtccaattaatttgctagagcagctcacagaattcagggaaatacgtttaccgatttattataaagtatattacaaaggatacagttgaagagatgcatacagtgaggtgtgggagaagagagggacgtggagcttccatgccctcctgggcgtgtcaccctccaggaacctccacatgtacagctatccagaagctccttgaaccctgtcattttggggttttatggggacttccttacacagccatgattgattaaagcactggctactgttgattaccttaaccttcagcccctctcccctctctggagggttgggagtagggctaaatgttccaaccttgtcatcctgccttggtctttcctatgaccagccccatcctgaagctacctaggagctgccagaccgcagtcacctcattagcatacaaaaagacatcactttggagtttttgaggattttaggggttgtatgccagacaacagacgaaagaccaaatatatatttcatagtatccagtccaccctctgtcttggatccctcacatcaaaaggatgtacaactcaaaagataccgccaaattactagaatctcattcaatcagtaataatcagtccagcccatcatattgtatgaatgtctcccaaggcgaggccactcaggtttgcaggcttccattcagtcttgtcagagtgctctcggcaaacatatagcttcaccctttacagcagctggtataattaagctaggagacagatatcatttcttgctctaagcctctttcaaggtattaatataatactgggtttctttcatttcataacccatttattctttactctcactactatttttccttatctctataaactcccaaacttttccacctttggatgggacaatagaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagccccactcatgttgaatgtgagcacacacttgcgaaggcaaataaggcagctcttcgtgctttcatctccctctgttttagacaaccagtgttttcattgcctgttccactctctatcaaaccgttactctgaggaagatatctctctgcccattgctgaacattataggctatataatgtgttcctgggtctgaagaagtgacagccatccaaatctgtgcaatatcttctgctctagcttttatggcactctgagcaaactattattctgagaagaatatctctgcccactgctggaacattatgggctgtaccgtgtgttctttggcctgaagaaatggtgttcagctctccaaatatgtgcaatatcttctgttctggcttttttatggtattctcatcattcacatcttccaccgggcaagcaaagcccagtccagaatcagtgtctactcctgtcaaaacccatttgtggcctcccagggctaccagcatcagcctcacttgccagcttgttcagggctttcccaccagggaaatctgccccacagccatgggcaatgtctgtctcttttgctggcagacagaacagtttttattggcattttgtgcctaagatggtgcaaaagaaacatgtctaaatgcagcctatctctgcactgttgcagtacccgtttatccactcatttcacagacccaggtggccacttcaagggagcacccagggttgtctgcttgtgatatcaatcactttctgaaccaggatcttttttttttttttttcaagtcagagttttgctcttgtctcctgggctggagtgcaatggcgcaatctcggctcgctgcaacctccgcctcctgagttcaagtgattctcttgcctcagcctcccaagtagctgggattacaggtgcgcaccaccatgcccagctaattattttgtatttttagtagagacggggtttcgccatgtcggccagggtggtctcaaactcctgacctcaggtgatccacccaccttggcctcccaaagcgctgggattacaggcatgagccaccacgtccagccaagaaaggagctcttctgatgggcattgacatgttctactttaatgcactcctcaaatttccatagggccattctccatatgggcatccctttaataaataggccaggtttccactgcccttctgcctgaccatgtggccaggccactgagtcagtaaaaaaatcaaacacaggggtttttgctattgttcatttctgcagaatgcaattcagccaccaagctaatttggtcttaccttctttgatcaagagtggcatccttccaaacaagattgttcaccttggaactgtcatttacacaccaagcaactctttgttggtcagttgagagctgtttacggggccctgtccaagtctcagtagaatcccgcagttcctcacacagttccagagtcagtcctaggggaaaagaggctccctgcatgagagtatttcctctttgcacttcccagggaggatgctcctgtataaaccatttccattttattatggaagtgttctgggcactgccatccccatttgaatgtttctctgacatcatgtgagaaagcatgggtatttcaggtgtcaagatcattttatgtccttcagtcataggggttaacttcagttaatgtcccatagcaaggtagtaaatacccccaagtggaaattctctactgcaaagtcccagtagttgtcactgggagatgctcacagacttctgagtaagccccagtaaacgctgacaaaggggtagcaaatggagaatttgtccctatgatattccagcttctattctacagattgtgggcttgggtaatcttactggtttgccatttagcatgttcaattaatattgctacaagggtgttttacaatacaaggtaagagaaacattccccagtcagacacaatatccccataatacagtcaagtgaaagagatacaaccacttcatgtaaagtgtgttcaaatgtaccaacttaccttaattttctcaatgcttactttcctaactgtagcctctattacgactttaccaacaggttttgagtttacagtactaggtaggggaagtgttccccacccagacataatatccagttccatcaaacattcaggtaaaggagacataacttctttacataaagcctgtttataaacattctaaatctcgtattcctaccaacccttactttctgtcccagtcccagaatttctcttcttcactcccagaccattttaccattttctccttagaaaaaagctttgaatccccagcagagggttgagccaagggaccttagcccttttgtcaatctttgtcttgattaacctgcctcaacactgctccaagtaattgttggtcagctttctcattgtaatctcttcctctcattttttcaatttctcctaactgggataaatacaccaaacctgtttggatcctcttaccgttaggagaacagcagaatctccctaccaaccttctatagtgatgacctttgttttaaccccatcgatttccactttattcatcccattttttaatagccctctaaagactctaccctgcttagatgagtcccatgactctcctttctttttcctcttagtttcaccccatcaatgttttcttcattcaccttatttctcaataaccatttagactttccaccttcctgggatgagtcctgtgactctcccctctgcctttccccagtctcttgttaattacgctcatgttttcattggtgcccatacaaaagaggctcccttagccatagcatttactacagccagagtaatggatgtattcagtgagtgaatatctcagtcatcataaagccagtcccacatggtctacataggaagcaaatgagctgctgcttcagggtacaccacttggcatttataggtgaaattggacagtccccttctcagggtaaacaggtccagtccaccacgctggccattcccttggaaataacctcctgtgtgtctggaaatctacctttccatctgtgattgttcaataatgaactgcaggtcctacctcaaccaaacatgctcttccactcttgagcatttaaaaccaaagaaactgctctgacagttccttcacagtataccctccagtttcaatagtttatcagttttaccctttccccacattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagggctattatttaaactataaattaaattccttcccaaggctagtttggcctatgcccagtaatggacaaggacagtttagaggttagaagcaagatggagttggttaggtctgatatttttcactgtcataatttccttagttacagttttgcaaaggcagtttcaatcgtaaaggtacttcagtgtccttgcataatttttccttgggggtcagctttgaggctagtggcctgggctcagacagacaaagtctaacctagcattctcctttaatttcatttagctattagagataaacaccaaagaatttagtatttcactttttcatattagtctgcataccctcatgcaaccagtgaaccaactccccgggagttgcatccatctctgaattccaccagtaacttttacctttagtagctgattgcagcacagctgcagctcaaaacagtgggaaaccacatggccacccaggaatcaaagattcctcatctcccacctttttgacgcaggatttttcttggccactttgccaatcagggacctccatggccagcaacgcccccctacctggcctttgcttggccatgggcctgctgaggcgtcaggcccactcaccccacctgtgctatggcttgtacctgcgttcagcagttcccaagctcctgtccttatccacgaagaatgaggatacgctgacaatttgaagggtgaggatgggtagggaagaattttattgagcagcagaacagctttcagcagagaggggacacgggtggcccccccacccctgcagtcgggtggtttgtctctctcagtgtggctgggtccatggtattttatggattcagaatggggcatgtgtgctgattggtttgtgagtatgcagaaaaggttaaagcgaagacaccactcaaaggtgggcacaacagtgtagaaaaccaattagggaagggtaggtatatgtaaaataggtgaggggcggggatcaatcagaggaaagcacaccaaacaggaagacaggttctcaatccagtccatggatttacccgggacatgtaggtaggctttaaactgtcttcagcttgaaggtcaatttcactgaggactcgcccctatctgtctaggcattttgtctgcctcctgctgctgtcactttcattctttctcttcccaaaccacatgtttctgtgagccaagtccattctagcaaaccctacctcactgaaaccaattcatagtttggaaggaaaacaaaactcacaaagtacttttctactctttcaacaacaattaacacagatgatttctgtgaccaaatgtgtggggatttctccccaaccaacaagcaagcaagcaattctgcagttgacaccagctaggtgtcctctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctcacagaactcagggaaccagttacatatacccgtttattataaaggatacagatgaaaagatgcataatcctggggcacggagctttcctgtcctctctggacagaggcaccaccatctgggaaactccacaagttcagctatccagaaactctccgaacactgtccttttgcggttttatggaggcttcattatgtaggcatgattggttaaacgattggccattggagattaatttaaccttcagcccctctcccctccttggaggttggggatggggcttaatgtcccaaccctctaatcctgcctagtctttcaaggctaccagcctcatcctgaaactacctaagggttccagccatcagtcaaccattagcatacaaaaagacatcattctggagtttctaaggattttagcagttgtatgcctggaaagagggttgaagaccaaatatatattttatagtatcacagacctgatcatcaaagtttcactatccttcagctttggcttttggcttttcatataagcttgagtgtgctggctaaacattgtcttttaggaatgcacagcatagaaactctagcgacttcagtggcagtcataagaactggaatcatttcaggggtggtagttgaaaagcagacaggaaattagcaggtttagaataggggagaaactttagcattgaattacgtgaggcaaaaatatatttgagggacaaattttgaattttgacatcttcaaatcagtcaaacttggttcatattatgcttcagaactaaccattcttttctgtagattctttaaaaagccaaaagtagataaagatttctatgaataaagcagttgaggatagaattccaaaaataatgctgttccattgtatcaccccaggtacaaaacacacacacacacacacacacacacacacacacacacacacacacacacaaaatctataccctgggaaacagtgacttggattgcagtgagatttagcgaatttaaaaggcatcatatatcagtgcccagaattctccacttcactgtctctttctagggccaaggtttcctggccattttattaccaatcacttcttttgaatttctagatacaattgtcttaaggtgaagtcccctgctccatgtaacttcctgtccttaatcaaggggaaaaaaagagatagatgtcaagggaagagaaagaagaattgaatatctcatgtcttccctcctatacccattagtgtctgtattcattttctcttaagcgccccaagcatgaaagtcacaggtttctctgagaaccacatttagaaaattaataataataagtgacagccactgatctgcttttatatatatattcatataattttagaaatatctctgagatagattctattattactgtcactttctagatgatggatgtgggtccacagaggataacttgcctacagtgataaaactgctctattataaggtctagatttgaacccagatagtctgactttagagcccacattctttactgttttatatggactctcataatatatgataatactcaatagaatctagtttattgctttaaataaggagaccagctatccccaatgaccaaaaatatatctcatttatgtacttgtttccaattttcaatctcgagatttattaactcctgccaactctccactgtaaaggtaccctgttttcattgtaattgataagtaatctgaaggtgatattttaagactctatgagtatactgtgtttccctttcacccactggattttgacattcttcgatgattctcttcttgcctaaatcagctgtttccttggtggtggcatcttggtaatcttttggtgaatggatatattagatttgaagtagtccttttaagacatcttttggtgagtggatgtattacatttgaagtagtccttttaagacatcactctaaacaagtcttgttgttttatattatttctcaaacagcactgtatgtggcatagtttctaatattttcatgttgcctcttcttccctttcctctatcaaaagccagcctaaaaatgtatggttttaataaacctacaaataaagtattgaacttggaagtataagttctctagagttccagaaatatctggagaaaaaaaaaactggaaagaagaaacctgcgttaaattttataataacactgaaaaaagtctttaagagggtcacttttttaatagtgccttggccagcagagggtaatatattaccagccctagttaaaccacttttgctgacgcataaactgcccacattgcactattttccagctagaaacataaagcaatagaaaagtttggggattttttgaagctctaatacaacaataaatttcttttagtagctgaaaaccactttacacatgatagaaaaaaagtaattgtatagacaatggatttctgtccttaagatgaaagcccggtgccactcatctgcccttaatagggtatgtcctttagggatagtttttgttttgttttgtactagtgattatcacaagagttacttttgtaaagtattcacaactacagttatcctagtggtagaaagaaagtcttacatttcagtatgtgaaagtttttattactgtatcttttagtttttctttaactttttttaatcatagaaattgatggacatagttttaaaagtcaaataacactgaaaagcttgtaataaaaacatgttatgtctattaataaatgtaatttaaagtattttcacctaatgaagacagtataggagaaatcacctctatcctcgactatagtcacttcctcctgtcagtgtaacaacttacgctacatatcccttccacttaagtggtaattttttttttttttttttttttgagatggagtctcgctctgtcgccaggctggactgcagtggcgcgatctcggctcactgcaacctccaactccctggttcaagagattatcctgccttagcctcccgagtagctgggattacaggcacgcgccaccacgcccagctaatttttgtatttttagtagagacaggatttcaccatattggccaggatggtctcgatctcctgacttcgtgatccaccaacctcagcctcccaaagtgaagagatagcttataataaccattccctctttattcagctctcttcatcagggggagcatgtacttgtttttatctcctagaacaagtggtttgttactaaatcttcagcagctccactactccctgcccttcattggtttggaaggtacattctgtctctctctctttctctctctcgctctctcatgcacacacacaaagctttcaagtaaaataactcaaggcattgtcttttttgttaaattactatatttattgtcatctttttagaaatcagtgctacacatattcttcatttatattttttatgcatcatttatctattgctgcatacttaactacccctagacttggtggcttaacacaagaaccatttattcactctcaattctgcaatttgttctagactcagctgggtagttctgtttgtctcacctggtggtcattcatgcagcttagtcatctgtcagctcagctgaggctagctggttcaacatggcctcactcacgtgtctggagcatcacctggaagagttgagcaggctgtgcccctctctccatgtgatctttcatcctgggcttctttacaatgtgatggtctcaggttccaagagggcaaaactggaagctgcaaggtctcttaaggccttattcaaatgtcatacaatgtctaccacattttattggtcaaagcaagtcttaatacctgcccagattcaactgggaaagtagactccacctctggatgagaagagtggccaggaattgggggcaatttttaatctaacacatttccttggatgtgctttcaactttaatgttctaactagacttgttatattttctccttgaaatgcagtgaattggctctttctttagggattactatagtatgtgtatctcagagttcgtagtttcctgggtaatattcctaaaagaaaaggaaattttgctttgtgagagatacccaccctgtcccactttggtcttggagctgtcatgttgttttggttgtttcttgtattaaaaggtatattcagtgtgccatgaatccagctgggtacagtggcacttgcctgtggtccctactacgtgggagactgaggcaggaaaatcgcttgagcccaggagtttgaggctacagtgaactatgatcgtgccactgcactccagcctaggtgacagagtgggactgtgtctctaaaaaaaagtatatgtgtatatgtatatataatatgccatgaatccatgatgtttcctttgtgctttttatcttctataaatcctctccctttaccttctctttccagaatattaatctaacttttcaataaaaccagaagaaaagtctgttgctcttgcttcccaatagctagtttgatcctgagagctggataagttcattgacatcttcaataccagagcttaaaaggatgtagaaagatgattagtctagcatggtggggtagctttccctcctaccatgcttattccctcctaccattattcaaggtttcattattttcaggatcataaatgtcaaactactgggccatgagacttgcattcacttacttagctgcatcctctccctacttgccacatctttttggaaccctgtaatcagtccccacaagagctgaccctgtgtgttcctgtgtttttcaagtttcactagccacaaaggggaactgaatatgaacatgcatgcaaacctcaccagttccctttgcagccagctgaaagttatttttcatgtagaggaaacagtgtttttcttttgagaacaaactgaatttccacacaaatatgaagtgtttcatcttctgacagttcagaggacccaagagaagagggcaccaaattgtgagaaaggccattaaaagagaaactaggaaaacaaagagacaaactgaattggggaagagagaggtgctgctgagtacaggaaaggaaaaaagcagaccacggggaggggtgccggggtgctagaaagtctcaataagtaatggcacacaggacaaggcaggaaatgtaggaaggaactgtctgcaaagggcctataatagctatgccagcagtattaatggaaggcattaagaacttttggtttagaaatttgctgttggacaaaatttcaaaatataccacatttacgtgattactgggcctgcctgagttcatgctatggagccaggtttagatgaaggtgccttgtcctcacttcagaatgcaatatggtgacctgtttggtgtctctgattagacggagaaaaaccaagaatcagatatgtattaacatctcttctaattttttttttttagaagatctctgtcacccaggcttgagtgcagtaacatgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgcaaattaaaaccacaatgagataccatttcatacctaccagattggcaaaaattagtaaatctgataaaaccaagtgttggtaaggttgtgggtaaacaggaactcatttctgccttgtagtgagatgggcatataaattggtaaaatcactttggaaagcaatttgtcaaaactgagataagctgaaaatgtacatacccttacaaccaagcatttctgcttttaggtgttagccataaacttcacacatgggcattgggtatacaaaagaattcacttgagcatggtttcaattagtggaaaaagtggaaaccaccaaattgcccattgttaggggaaatggagaaatgaaccattgtttattcatgcagtaaaacactacatcagtgaaaatgaatgaacaagacctacatgagtctacatagataaacaaaatttgagtgaaaagagttacaaagaatgtaatagtaagataccatttgtgtaaatttttaaaagaaaaagtgcatattgttatgcatatgtatgttgtaaaagcacaaaaatatacgtcagagtgatatacaccaacttcaggaaagaggtttcctcagggaaggatgtgaagtgagctttaatatatctaacattttggatgatgtatacgggtatgaaaaaacttttaagtaaaacgaaaatgttaacatcttttcaattggggtgatgggtacttagctgcctgttatgttgtgtttttccatttttgtatgtttgaaacgttttataactaaaaactatttatatgtgaaattaccaaaaaagaatataagtgtaacagttaactgttgctcccaaaaaacttgcatgacttattaaagcaaaaagagattccatgtatcatcaacacctgtatccaaaccataattagaaggcctttccatcttctgatggttctttatgcatttcatgggccagaagcaaaactaataagggtaggatgctctaatttgattccattttttttcttctattcaacctgtatgagtttgttctggattatcgtacatgtttcagagagagcttccagagtatataaatgtgtgatggttagaagactagttttaaagattgttttttgtttttgtttttgtttttgttttgagacagagtctcactctttcatcaggctggagtgcagtggtgcaatctcagctcactgcaacctccacctgccaggttcaagcgattctcctgcctcagcctcccgagtagctgggactacaggtgcgtgccaccacacccagctaatttttgtatttttagtagagacggggtttcaccatgttggccaggatggtgtcgatctcttgacctcgtgatctgcccgccttggcctcccaaagtgctggaattacaggcgtgagccaccacgcctggcaaagattttgtttctttggcatcacacaattatgatgagtggtaagcagaaatttttgcccccaatacatattaatggcaatttatgtttttttattttattgtaatttatttatttatttatgtttttgagacgaagttttgctcttgttgcccaggctggagtacaatgacacaatctcagctcaccacaacctccgcctcccgggttcaagcgattctcctgcctcagcctcccgagtagctgggattacaggcatgcgccaccacgcctggctaattttgtatttttagtagagacggggtttctccatgttggtcaggctcgtcttgaactcctgacctcaggtgatccacccaccttggcctcccaaagtgctgggattacaggcgtgagccaccgtgcccggcaaagattttgttttttttgacatcatacaattttgatgagtggtaagcagaaatttttacccccaatacatattaatggcaatttatgttttttaaaataaaagacatctcagcaatcaccattgtgcttggacagaactaaacaaaagtgaaaagcattagcagagacaatgtcagtagaatggaagtctaccaacttgcatccctacatatgtaaaatacagttgctgcttacatcacaatgccatgaagattaactgatgataatgcatgggaagcacctagaacagtgaagggcacataaataaacaaatgttactttgcttcccattcccttgcatgtgaacttgaagtggggaaataaaaggaaaaatagaagtttcgaacaaacttactacctcctttccagttctgtgctcactgttaccatccccaaccagctctccaagtcttcatctgaaaacatggactgactgaggcactatggcagccactcagctgggccatgtagctatgacagaggacactacatcatccaacatgggaatgccgcatagtttatctctcgtctgagttgacataattcagattatattccgagtttcaaatcttttcttccgattaaaaatacccctacaagcctctttacaagtgaagtttgtttgttggtggctgaaataaaaggctctccagtaaatgtcatatctgttgtgaatatttttcctgctttgtacttttgcttcagtttttatggtttgggacaaagaatctaaatttttaagtcaaatctatgaatttttccctatagttatttctattattttgtttgaaagttctttcccatctacagatgaactagtcattttttaatcttttatggtctcattatttacacttaattcttgagtgtccttataaattttggggtatgataaaaggtaaggctgtaaattggccttttattttaaataggcacagcactattatttattaatccatcccttccttcctgatgctttttgtgatgtttcctatatatgcagtgattttctctgagggaggagaatgtatgggggtcacctgagctttgcaaaaacacacttaaccccacctttgcaagattccagcacatcttgactaacaggaaccttttttttttttttttttttttttgagacggagtctcactctgtcgcccaggttggagtgcagtggtgcaatctcagtggggcatggtggctcaatgcctgtaatcccagcactttggaaggcaaaggcgggcggatcacctgaggtcaggagttccagaccagcctggccaacatggcaaaaccctgtctccactaaaaatacaaaaattagccaggcatggtggcacgcacctgtaatcccagctactccaaaggctgaggcagaagaattgcttgaacccaggaggcagaggttgcagtgagccaagattgcaccactgcactccagcctgggtgacagagtgagaccctgtctcaaaaaaaaaaaaaaaaaagtcatatacgtattttgtacttttctcatatatcatctaggatctgcttagacatgtgtattcagttccacagataagtttatccttgtgtctgctccccagtgttatccttactgaaggataagaatatattttaatatctgataaagtattatattttgaaaacctaaaaaataattagcccattaacatgttgctgcagcatccaggttgcttgttgggagaactctcttcatattgcttttcttttgtgggataactttcagtaagtctttcgttcaaatagttatattacctctacttttatgtcagcaggaataaagaatccattttttaaagttgaaaataaaactgtactggaagaggattgtctttttctactgacctaatcttagaaattcaaccaccatcaaacctggctctatacagcatacttttctaaaactaacagcaatattcaacactgaggtctcactctgacagccagacaattcattttgcccatatttggttttgcatgtatgagatgttatttagaaagctgttctgaaggtctttgcaaggtaaagatacgtatatacttctgaatttccttttcctgtatgcttctagaactaaaccttgggttaggagaggtaggaactgtttcctgcttgcaaatactaatgcttagtaagaaatgaaagattatatgtcataagtagccttaactttggtaagacagtagcatattttttctaaaaatttagaaaccttctcaggattcaagttactctaaggcatgttatcagatttctctcagtaagcaatctgttataaatagacagattgatttatatcaaaatgtattttattccaaataatatagcaataattaattgagtatactttaaaattttcttaagaatgccattgtgcagagctttatagtaatcatctagtataatgagacagcttctagaactatgagtgtatttatattcattttaatgtcccttaaaagtgataataattgataatataatttcaccaaactgtatacaatgagatatgtaagatgtttaccagtaatgtaaaataaatttttaagtttgaggacatgaaggaaaatagaagttttcataacttaaaaccatacaaacagaaatgctaaatttcatttagatggtatgtgttaacattgtcagggcaaagtaattaatataattttgtcacctttttctgaccctctaatttttctgcaaatttcagtatttatcctcaaatattacttatttttaaaatatacttttgctttgacttattctttattcagttaattatatttgcgggcacttattgaaatatagttaactggccgggcgcggtggctcatgcctgtaatcccagcactttgggaggccaaggtgggtggatcacttgaggtcaggagttcgagaccagcctggccaacatggtgaaatcccgtctctactaaaaatacaaaacagccggtcatggtggcgggcgcctgtaatcctagctacccgggaggctgaagcaggagaatcacttgaacccgggagacagaggttgcagtgagctaagatcacgccactgtactccaacctgggcaacagagtgagactccatctcaaaaaatatatctatatatagttaactgagcactgtatacaagccaaatctcattaaaataaactcagttctgatcaaaatcttcatggtcattcacattgatttctcagccaatggcctaccttaagttttaagaagtattctgactctaaaaaaattttatacaccatgatagaaactttcagatgagtccttggagtttgtcctaagatgcttttacataaattcagtcaataacattcaggttctgtgtatgaccaaagaactggacaaatgctggccaaactttcaagaatgtttgcctaatgacaccccctagattgcaactgtatggtgttctatacagctatattcaaatggactaggaaaaaagctaattactcccaactttttttcttgtaagcaccccttccttccctttctccctatcttattcatccgtccattcttcttaattattcaataaatgtgtattgatctcctatagccaagaaacatactaagctccagggaggcaatgacgaacaagactaagaccgctttcttttagagcttgctgtcctgttattttttaatgtacatgaaaattgcagagtttgctccttttaattctaatttgcaggtttttattgttgtaaagtatttcaaatacccaggagtttaccaaaaataatataatcacgtgcctactacctagatttaagacattaacattttgccatatttgcttcaaatttctccagatataaccattaagttggtatgtatcttgtatatattatcatacatgttttgtatctttattttatatgtattgatccataagaatgtggtattgttttctaccaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaatgtggtattgttttatgtttttatattttacataaatgatttcatgcagtacatacccttttgcaattttgtggggttttttttactcaacattatatttgagatatacccatgttgatgcatgtgagtgtagttcatttcattgcatcgctacatgatattccatttcgtgagtaaaccagttcacttctccatgcctttgctgttatgtccttatttccagttgtttcgtattatgaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggttttgtgaacaatttctttccagtagcaagatgatacatttagctgtgaagaaatgtagatgaatcgaaaggcatgatagggaacaaaacatatagtaaaaatgataagtacaataaaggagttacgagctgtagtggcatatttaccagaattaggaaattttgacctccttttagaaatcctcaatagattcttcccaatcttaatatatgaaaggattattagtaagaaaattagccagaacattaccacaagaatgaagttaaaaatggcttctccttttgcgttatgcttatctctgtaatggaaacacattgtggaattatgccctcctttcttaagtgttaaaataatcatagttaggaatccaccaagagcaagcatccatactatacaacagacataaatactttgtttggttgttattgccttccgttgctgtatagaccgattaatttttatatagcgatccaaactgatgaatccaagcaaaataatgctaatgtacatgttcatataaaacagtgttcccacaaccttgcacagaatcacacctagtgtccacttgttttggttaatatgatacattattcggaaagggaggcagaagatgagtaggaggtctgcaatggctacgttaagtagataaatttgaatggaatttcttttacggtgaatacccagaaatacatagagggcgattatgttcccaaccagtcccacgatgaaaataacagagtaggatgtggttaacacagtagatagcaatttttcatccatgggacaggtagtaacatttggtgttgctgagaagttttgtggcggttggtcgctatgattggttataaagcgcattctgtgggaggagtaaggccagctgctgactgaagttgtcgtcattgttatggtatgacttctcattgtcttctgtggagatcaaaaagtgaaagtgctaaatgacatattcctcatgtgtagttcttatgtcttcagatttttcctacaacggaatgccaaacattgagtcatttgctattttaataacagttactttaactaaaagtgtaaataataggctgggcttcccagcacacgcctatggtcctagctactcgggaggctacagcagaaggattgcttgaacccaggagttcaaggctgtagtgagctataattgagccactgcactccagcctgggcaacagaacaagaccccatctctttaaaaaaaaaaaaaaaaaaaagacagtgtaaataataaatgatttattttcagacattgcgagaaactttacttttatcctactgtatgtagtaacattattgtatcattaaacaagcagcacatagtgtggtatctcatggagtttcatgctctaacctttcctgtggccatggcctacattgaagttctgtttcatgtattatattaaaataactcaatttatgagatcatcttctcttagggaagttcttatgggaatacagatggtggtgaagagaaatgacagctcatatttctcaaagatgagcatcagtttctctaaaggtatgtacagccataagagagctgggcccactgctggccctgcccagcttcagaaccacttcctgccttgactttttccctcatatgtggcattcattcattttgacatgtattgctacatggcgtgtgacttgtggtggtctcattctataagtgggaataaagaagaggatcctaaatttcttttcagcctaagaccaaggtaggggtcttagggcatgcaattaacataatagactaagagaatacagcacctgcaaggttacacagactcttgtatcactggacaggagaaaaaagtaaccaaacaaaaccaagttagctggcagctgccagttagccactcctaacctagaagcatagagtaataacgtagatgggaaacagcatgtgcaatccaagattttgaaagtaacctgaccaaagcttaaatgtgccctgggttcaataatttgagacttgctagaaccttcgaagagatagtgtttgaattctacttgtttgtggcagcagagaatatttgcaaagctacttattattggcccattgactgctgtaaagagcttagtctgagagctggtcataacaagtaaagaaagcatttctggaggtctcatcacattcctctcatagagtgactgccctatttctctacagcagccacttagcagggttaacataaagatgcccagagcaaggttctcaaaatcagacccaactaacttgtgaccaagggcaaataacttaatcttttctatgccttagttttctcatttgtgaaaatgaaaaatgcataagaagaacttaatcctggcacatagtgactgcttaataaaagttagctttaataaacaccttttgattaatctcattttagtaaatatctcacacttggctaagtactgtgtgggaaaggaaggtgaataagacagagaccctattagtaaacattttggaggagtggacattcaaaccctgactgctaccatgcaaagtggatttgaattacataaattaagtccctgatttgatcttatacacagagaaaaatagcctttcttaaagctctacacataatttgattaaaaacaaagcattttggtagagggtaacattaagatttaaaatgttgtaaagttggggagcattgattccacagaagaggaactggctggtgaagaggaagttatgtaatccctggtaagagcctgtttccagaattcaggaaagtggagggagaaaggaagggagcggggaaggactgagtctagtctgtcatgtgtctcaactgcaggaagacaaatttcagaaagtttatagaaaggtataggcatgtttcttgtgatctaagattctggtttttgtttgtttgtttgttttgttttgtttttgagacagagttttgctcttgtcacccaggctagagtgcaatggcgtgatctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaaggaaatcatttttttctaatgaaatgatctctcttgggaggcaatataaggatcttaccactggagatttttgagactaccaccaattgggttctttgtagaagggattatcagtggttctcaatcctggctgcatattagaatcctcttgagggttttttaaagataccagtgcttggctccttccccagatattctgatttaattggtctggaatgggtttcaggcactggtttcctttaaaagctccttaggggattttaatgtgcagtcagaattgaactcttaagctagatggccaaaccattaactaatatttatttagtactttctgtgtaccagacactgtgttaaacacatttatattacttcctttacataattcttgcaatactctgtgaggtaggtatcacaaaagaggtaatgaaagatcaaaaggttggccaggtacagtggctcacgcctgtaatcccaacactttgggagactgaggctggagaatcacttgagaccaggagttcaagaccagcctgccagccaaggcaacatagcatgaacctgtctctaaaataaaaaaaggaagaaagaaagaaagttcaagaggttatgatctttactcttggccacacaactctttttttttttttttttttttttttgagacagagtctcactctgtcacccaggctggagtgcaatggcatggtctcagctcactgcaacctccgcctcccgagttcaagcagttctcctgcctcagcctcccaagtagctgggaccacatccagctaatttttgtatttttagtagagacggagtttcactatgttggccaggctggtcttgaactcctgacctcattttccgcccgcctctgcctcctaaagtgctggggttacaggcgtgagccaccgcacccggcaggccacacaactcttaaatgacagtgcccaagttaggactcagatctgacttttagagcccatgatgcttttcaccaaatctcactccttatcacatagggtcagcattttctttattaatattgagttctatcagcagtattttgacatgattcctttaacatacactttaacaattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctctacaaaaagtataaaaattagcgggtatggtgacgtgcgcctatagtcccagctactcgagaggctaaggtgggaggatcgcttgagcctgggaagcagaggttgcagtgatcctagatcactccactgtactccagcctgggtgacggagtaagaccttgtctcaaaaaaaaagaacataaaaaaaaaaaaaattggccgggagcagtggttcatgcctgtaatcccagcactttgggaggccgaggcaggcaaatcactggagtccaggaattcgagaccagcctggccaacatagcgaaaccctgcctctactaaaaaataccaaaaaaaaaaaaaaaaattagcagggcgtggtggcacgcacctgtagtcccagctactccggaggctgaggctggagaattgcttgaacccgggagacagaggctgcagtgagctgtgttcatgccactgtactctagcctgggcaacagagcgagagtctgtctcaaaaaaaaattttttttttaattaaaaatcacaattacattctgttttaaacttggtgactgtttttttttctcctttgaagttggttagtacattacaatgtcattcactatataaggctatttactgatattttttaaactacctgtttgatatgttaagaattgcttgtgaagacaagaaacaaaccactgtgtttacataggggattaatttcccagtgggcattacttgtgacccatgtgctatattgaagtggtcacaatagttttgtaatagtagatagtgttttttaaatgttgttacttggcaaatcctattcacaagttcaaaaacctagtattagtgcattgtacccccgcaccaccacctactcctgcagttttttttcaactggctcatgtaggagtactggacccagagggcaggacccaacagattccactgtgactccagatgagcagaagcttttaaaatgcagtttgggtatgtttgtgaaaatatcacattgctatgttgaaatacatacctatttggtaatagtcgcaacctttcaccgtttttagtttgacttgataatgactgaatctattcagggcatgcttcaaaattgcattaactgctgtataaaaaatgaaaattgaaaacatattactttggaaataatactattaatagtgtgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagcacaagcactgaatttctgtttcttaagttttcatctgtacattattttagcatattttcatgtattcctttaagacctttgctaaaacaaacttgtattattaggactagatgagatttctgatggtgttctccccttttgatcactatgataaactctcccgagcaaattaaaacatcacctgtattttaagcgaaataatgatgggattctgcagtcttggttttgatcctagtccaaaatttaaccactatctgtccatctatgtaactgctggccctgcagtttagtgttatttccctttttttgttgtcatttgaaatgaagaagttagtttttattctccccataattgttatcctgcagcttgtttgcactaaatatttgactcattgggctgtatctaacattctaattatttctgggtacactcttctgaacattatattctccagagctttttgtttgttataaatatgatttatgggacaggatatttttaaattaatagaataaaaatgttttgtagctcttacttccccttagaacctctgagaaggaaggtggttgctgtattagtcctgcaatattgttgtattggcaggattttattttattgtggtacaatatgtaacattaaatttaccatcttaacttttttttttttttttttttttgagacggagtttcgctcttgttgcccaggcgacaagagattgtacaatggcacaatctcggctcactgcagcctccacctcccaggttcaagcgattctcctgcctcagcctcccaagtagctgggattacagacatgcaccaccatgcccggctaattttgtatttttaatagagacagggttttgccatgttggccaggctagtttcaaactcctgacctcaggtggtccacccacctcagcctcccaaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacaggatttccttcttttatcaaactgcattatattccactgtatatgcaccacattttccctatgcattcatctgttgatggatttttgggttgcttccacctcttgactaatgtgaataatgctgcagtgaacatgagtatgcatatatctcttcaagatcctagcaggaattttttaatgactaaataggcatttaactacgtgcattctatttcatataatctagcatgaatatatttttttctatattattttcctacacctaagacaacccttttcaaaacactaattgttttaatcttcagtttcctcatattgtgaccacattttctcctcaatgtgagtcagcacagctaccaccagatttgagtataatctttttctagttctttctttatataagctttttcctgttcattctgaacattctggtttgtctctgcgttcttagctcattttcgatatgtcctcttcccttcacgcttcctctttctcttgttgggattataaggtatttatattaagatagaagtagaaaagaacaaatgtatacgcttgtttggtgccatctattactgatatcactgttctctttaaatcccaaccctggttaaattcagctcaccacctactccaggcctgaaccttgccatgtaaaatgaggactgctggatacaaacactcaatgatgctgattggtctcacttcaaattcatgactacaaacctcaagtgggcccctgggctgccaacagtcctagtatatttccttagtccagtggttctcaaaacaggggtcccaaacgagttgcgtcaacaccactcagaagcttgttagaaatgtatgttcttagctgggcatggtggcgtacgcctgtagttccagctacttgggaggctgagatgggaggagcacttgagcctgagagtttgagtctagcctgggcaacatagcaaaaccttgtccctaaaaaaaaaaaaaaaaagaaagaaagaaaaggccaggtgtggtggctcacgcctgtaatcccagcatgttgggagaccgaggcgggcagatcacctgagggtcaggagttcgagaccagcctgaccaacatggtgaaaccccatctctactaaaaacacaaaaattagctgggtatggtggcacgcacctgtaatcccagctactcaggaggctgaggcaggagaatcgcttgaacccgggaggcagaggttgcagtgagccaagattgcaccattgcactccagcctgggtgacagagcgagactccgtttcaaataaaaaaagaaaaaaaatgcatgttcctgacttcatcccagacctgtgagccagaaattctggggatggggctcagcagcctgtgtgattctgatgctaaggtttgaggaccactgcttaatcagttcattcttctattccttgaaaatactttttcacacctgtactcttctcagactgccaggaacccctctccttcctcactcccacctggtgatcactttttatttcactgagaaaatagaatcactcagaagagaattttattgtcttccagtgtccacctctgctagtatatacaaatgtctctctaagaaacaaaagccgggcgcagttcttcatgcttgtaatcccagcactttggccagctgaggtgggcagatcccttgagctcaggaattcgagagtagcctgggcaacatggcgaaaacctgtctttaccaaaaactacaaaaattagccgggtgtggtggcacatacctgtagtcccagctactcaggaagctgaggcaagagggtggcttaagccccaggaggtggaggctgcagtaagccatgattgtgccactgcactctagcctgggtgacagtgagaccctgtctcaaaataaataaaataaaaaatttaaaaacctccacaaaaaagctctaggtactactatggaattacctgtagaatatattgttatgtggaaattttgaatatttgtacatattttcttatttttaaaaaactgaaggataaactgaaaactgataaaaatagttaccaatggggaagaaaagattgggagtgggggaagagtgcaaaagctagacctctctgaatagtatctgttttacagtttgtactttagaacctatgtacatgttttatacaattaaaacaccaaattaaggcaaaatctagttgaaacaaatgaacctcactctattgcaaagtgaaagcataaccacaaggagaattatttttggtaacttttaaaatagggtaggggtttttgttttgtttttacgtaattttagacttatagaaaagttatgagaacaagtacgaggattctagataccttttactcagattctctatgttaacattttttccttcatttgtttaatccttctcaatctctcactcttatccatttatgtatttcctaaaaatagggaattcctttacatagctgcagtacagttatcaaaatcagttaatttatgttgacctaatatcattatgtattctacagaccttgttaaaatttcatcagttgtcctagtaaatatcctttataacaaaaataaaaacaaaccgggcacagtggctcacacctgtaatcccagcactttgggaggatgaggcgggcggatcacttgaggccaggagttcgagaccagcctggccaacatgccaaaacactgtctctaccaaaaatgcaaaaaattagtcaggcatggtggcacgctcctgtaatcctagctacttgggaggctgaggcacgagaatcgcttgaactcgggaggtggaggttgcagtgagcagagatcatgccactgcactccagcctgggtgacaaagtgagaccctgtctcgaaaatatatatatattaaaaacaagatctatctttttagtctcctttaatcactttaacctggaactgtatttgaagaatataggccagttactttctagaatgtccctctttgggtttgcccagggttccttcatgattagatctcgttatgtactttggcaggaataccacagcagtgttgccaagttctcaatgcatcatatcaggaagcacatgctatcaatcagtcccattagaagcagtgttaacttcgctagtttctgctgggtttctcccttgtaaaattactagtttcctgtttgtaattaataagtatgctgtagggagatatttagagatcacataaatatcttaccactcttcaaacttccactcacaagttagcatccttgatgattcttacctgaatcagttacgataatgaaaactgacagattccagcatttcttctacatttaattgattttctacttaaagcttttcctccttccccattcatgtatttgtttatttatttacatcagcatagactcatggattctttacccagtagtaaaatgctattttgaccgggcatacctagtgggatatatcttaaggacaaaaagaaccacaaaatcttaaacagcattcagtggtgttgttattgataatgtaggtattactattattttaaaactttcacacacacatacacacacattctgaagcacaaagcaaatgagtaattatgttagtatcattaggtaccaagattacagttgacccttgaacaacatggggattggggtactaatccccgcacagttgaaaatccatgcataacttttgactcccccaaaacttaactactcctggaagccttaccaataacatagttgattaacacatattttgtgttatatgcatcaagggagcctcaagtgatcctcaagtgatcctcccacctcgaccttccaaagcactgggatcataggcatgagccaccactcccagccggtttgataattatagaaagaggtttggctttaaaaatgtcaaaatagcaggatgcagtggcacatgcctatagtcccagctactcaggaatctgaggcaggaggtttgcttgaacccaggagttctgggatgtggtgcattatgccaatcaggtgtccacatgaagtttggcatcaatatgatctcccgggaggggggtaccaccaacttgcttaaggaggggtgtgaactggcccaggttgtcagcggagcaggtcaaaactcccgtgctgatcagtagtgggattgtgcctgtgaatagccactgcgctccagcctgggcaacagggcgagactcccacctctgaaaataaattaaaattaaataatgtcaacataacaggaggatcagtttttgtcagcaaagaggcagcagatgagttctcagatgccattcagaaaagtattgaagaggagcaatatctgcctgaacaggctgttaatatggatgaaaagtgccctattctggaaagaaaatgccacagagaacatctattaataaggaacagaagcaagcaccaagatttagggcaggaagggatacactaactctaataagcatagtcctgatataattccaactgcatttgcacaaaacagtagagtcagcctatctgcctcacttgaggtcaggagtttgagatgagcctgggcaacataacgagacactctaaccccccaaaaaatgtttttaattagccaggcatggtggcacacacttgtagtgccagcttctctggagactgaggcaggaggatcgcttgagcccaggagttcaaggctacagtaagctatgattgcaccaactgcactccagcctgggtgacagagtgagaccctgtctcttaaaaaaaaaaaaaaaatttatcaaactgtcttttgccaccattgcattctccagcttttagatccttcattttttttttttttttttttttttttttcctgagacagtctcattctgtcacccaggctggagtgcagtgtcagcctcctgggtttaagcaattttaccgcctcagcctcctgagtagctggaactacaggcacgcgctaccatgctgggctaatttttgtatttttagtagagataaggtttcgccatgctgcccatgctggtctcaaagtcctccactcaagtaatctgcccaccgcagcctcccagagtactgggattataggcatgagccaccacacctgaccccttcaccttctttttgctttaagttgctatttcgctttttctcaaattatgttagaatctataggtatgtcttttttatacccacataaaagctgcattttcaatactacttaaaaaggtatttcacaaaaagtgcaagattttagcacctactggtgttagctgcaggagtagcttcatgaatttcctttcctttttttttttttttttttttacaatggtccttatgttggattcatttatcttgagatggcagccaattgcagttgcagacctcaatctacaatacatatcaagcaattcagctttttctttttttttttaagatggagtctcgctcttatcacccaggctggagtgcagtggtgcaatctcggctcactacaacctccgcctcccaggttcaagcagttctcccacctcagcctactcagtagctgggatttacaggcgcctgccaccatgcccggctaatttttgtgtttttagtaaagatggggtttcaccatgttggccaggctggtctcgaactcctgacctcaggtgatccacctgcctcagcctacctttttcttgtaatgtcatgactttcctctgtttcttaggagcacttctagcatcaccaatggcactttttatggatcctatggtttaaggtattgcactaaacacagtgaaaataatatgagaactgtgagattacttttactgtgatatgcaatttattggagagatgaactgctcaagcaaagataagtagcatcacacaacatattaggtgaatactcgcaagacttgagctcactgcaacagcaacaggagggagctgtgaaattattacagtagtataatatgtactacagttaattttatggttatgatttaatattgcattctttgtatttgttcacatttctcttgactgaatggcaccgtttacagtctgtgtaggtgtaagttttgataaattttaactctttataatagatttgtgtacatttttatagtactaaataataaaatagtatctaaatatgttttatgcatttatgatatagctttttcttaattttttattccagaagtcatccttcacctttttcttaatttttaaaatagttctaggcaacatggttggtccacgagttttttcaaattgttacgaatctccaaaaaaaactttcaatatattttgttgaaaacaatccatgtataagtggacccacacagttcaaacccatgttcaaaagtgaactatacttgccaaatcaaagaattaaagtaaaaatgctataattgaataggaagaaatattagcttgaacttgtggtttatttatttattttttttttttgagaccgagtttcgctcttgttgcccaggctggagtgcaatggcatgatctcggcttaccgcaacctccacctcccaggttcaagcgattctcctgcctcagcctcccaagtagctgggattacaggcttctgccaccacacccagctaattttgtatttttagtagagacggggtttctccatgttggtcaggctggtcttgaactcccgacaggtgatcctcccgcctcggccttccaaattgctgagattacagacgtgagccaccacgcccagcatggtttatttttctcctaaaaatgcattcttttttcagcactgtccactgaaaagccaaagtaataataacccagtaaaaataatatgcctagtacccacatcatggatttatttatatattttattttatttttatttttattattattatttttgagacagagtctcgctttgtcgccaggctggagtgcaatggcgcgatcttggctcactgcaacctccgcctcctgggttcaagcgattctcctgcctcagcctcctgagtagctgggactataggcgcatgccaccacgcccagcaaatttttgtatttttagtagagttagggcttcaccatgttggccaggatggtctcaatctcttgacctcttgatccgcccacctcggcttcccaaagtgctgagattacaggcatgagtcgctgcgtccagccaattttttttttttttttgagacaaggtcttactctgtcacccaggctggagtgcagtggtgcaatctcagctcactgggttcaagtgaagctactgcctcagcctctcgagtagctggaattacaggcatgtgccgccacgcccagctaatttttgtatttttagtagggacaaggttggccgggctggtcttgaactcctgacctcaagttatccacccaccttggcctcccaaagtgctgggattacaggcatgagccaccgcacctggcccacatcatggatttaaatcgttttttgcactaaaaagaaacagggctacttagagaaatggctgattccagatctggggcaagaaatggacatgacaagcctggaacatcatcttgtgactgaaagcaaggaagttatcagacttctggagtcttacaaaaatacagaagaactgacttaaaggggctcccactggcccaaaatgggacaatttgagcacaaaaatttgtaaaggcagcaactgattaaaacacattaaatatataaaaatctgtaagttcataataattaaaaaaaaaacacctcatcagtcacctttggaggttgcctagaaactaacttggtattctggaaataaattataacagctttattcataatatccaaaaactagaaatagcctaaatgtctgtcaacaggagaatggacaaactgatatattcatacaatgcaatacttacggcagtagtaaaaagaaatgaactactgatcacaacaaaatgaatgaatctcagaacatgctgaatgacagaagccttacataaaagaatacatacttacggttttgtgtctatcaagttctaatataggcaaaacaaacctatggtgaaaaaaatatcagagtagtggtttgcactgggggagatggcagcagagattgaatgggaaggggatgagggagggaggtttgtgggataatgaatttttttagggatttgggttacacaaatgtatgcagttcatcaaaactctaatggtacgcttttgtgcatttcacagtatatacattttttaccttaagcataactttattttttttttactttttatagaagttttaagagacagggtcttgctgtcacccacgcaggggtgcagtggcacaactgcagttcactgcaatcttaagctcccaggctccagtgatcctcctacctcaagttactggtcccaagttactgggaccacaggtgcacgccaccaaaactggcttttttttttttttaagtagaggcataattttaaacaaatattaaatttcaatgatatgtgtgctaaggtgtattaaaaagtaagatggatagaaggataaagagatagatatttgataaagcaaatgtaacaatatttaattgtagaatctaggtggctctttacaatataattctttcaattttctatatgtttgatagttttcataacaaaatgttgaagaaaacctccattttggcacctctaattatgggtctaggcatcaacatctgctaacatcattgagtgaaaagttgatggtgaatcttataatgatgggtcaggcagacaacacctgaacccactgctcaatcctgtcactaaaagtaggatagccaggtgctatgttcttcctgttgcaatacaatagatatatcacctatgaagtattagtgcataaaactaaaattgaatctgaatctaatcaagattctagatctaactacaaatttacaggaaatacaggagagtaaaaaacattaaataataccatgtaggtaccattagtcaagtacagattgtgggggatttcacaggaaaaattacctagtatcttaacaaatcaatggcatgaacattggaaaaaaaaaagcataaggaaggggatctgttacagagtaagagacactcacaagacatagtcatcaaatgcaatgtacagaccttggatcctgtctagaaccaaccaaccgtaataagacctttcttctttttttagtctgttctactccttcaagttattggtagagaaaagacatttttgagacaatcaaggaaaactgaatgtggactgagtattagatgatactaaagaagtattgctcattttgttggacttaataatgatattatggttatttttaagtcctgtgttagaaatactgaactattaacaggttaaattacatttatgttaaaatacttctggggaaaaaaagtaaacagttggggatagatgaagcaaaaatgaaagaatgtccttgtttttgggtttttcgtttgtttgtttttgttttatttttgcctggagacgggcaagttgcccatacatcccagcaggccaggggaggagctgaaagaatgtcagtaattgccaaagctgggtgatagatacatggaagtttattaatctattttctccacttgtaaatgttaaaaagaggcatcctcagcttcacactttcttctacatcccatttctccatttttactacagtaagactgtgaaagatatctgtatttactgtcactacatcatctcctcccattctctcctgaacctggtccaatggggatttttgcctccatcgtgccaccaaaaccactcttatcaaggtcaccagtaacttccaaattgccaaatctaatggtcagttctcagttctcattttaaatgacctttgtaacattgatgactactaatcattcctacttgaaaaagtttcttcacttgacttccggataccaaactgattttcctcctgcttcactgtctagaccttgttttctttgctagattttttcttctgacttcagatattggcgtgcaccaggactcaatcctctgactcttctctatgatttcctaagcaatttcattccttaccatggctgtaaatatcatctgtgtactgttgattcccaaatttacacctctaatcccagcttccccttaatgtcatcttataaaatctcaaactcaatacgtatgagaccaaattcttttttttttttttttcatttttctataaaatagagatggggttttgccatgttgcccaggctggtctgaaactcctgggctcaagcaatcttcccgccttggctccccaaagtgctaggattacaggtgtgagccaccgcacccagcctgaaaccaaattcttgatccaccttacaaactcctccctcagtgttccctgtttcagtaaatggcatcttcattttcactcagttgctcagaccagaaaactaattgttataattgacttgtgtctttctctcacgctcatatccagtagcaattcctgtcagctttacctttagaacataaactgaatttgactacttctcatcatctctgcttctgtcactctagtctagtccaagtcaccatcttctcttgcctgtgcaactgcagtagcctcttaattggtctcctttttccctgtttcttcacaatctcctcacacagcagccagagtgatccttttaaaacctaaaactgatgatagtactcccctgttcaaaaccttatggtgatttcccatctcgctcaacataaaacccagagttcggagagcaggccagagcccaggcccggcccagcggcgcccgccaggtagacccaggcgaggccgcgtgccggcgcgaggggagcccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttttaggagcccgtaggtcatcttggagggtcgtctcaagtattgaacaaaagacggaaggtgctgagaaaaaacagcagatggctcgagaatacagagagaaagttgatacggagctaagagatatctgcaatgatgtactgtttcttttggaaaagttcttgatccccagtgcttcacaagcagagagcaaagtcttctctttgaaaatgaaaggagattactaccattacttggcagaggttgccactggtgatgacaagaaagggattgtggatcagtcacaacaagcataccaagaagcttttgaaatcagcaaaaaggaaatgcaaccaacacatcctatcagaccaggtctggcccttaacttctctgtgttctattatgagattctgaactccccagagaaagcctgctctcttgcaaagacagcttttgatgaagccattgctgaacttgatacattaattgaagagtcatacaaagacagcatgctaataatgcaattactgagagacaacttgacattgtggacatcagatacccaaggagacgaagctgaagcaggagaaggaggggaaaattaaccggccttccaacttttgtgtgcctcattctaaaatttacacagtagaccatttgtcatccatgctgtcccacaaagttttttatttacgatttatgacaggtttatgttacttctatttgaatttctatgtttcccatgtggttttcatgtttaatattaggggagtagagccagttaacatttagggagttacctgttttcatcttgaggtggccaatatggggatgtggaatttttatacaagttataaatgtttggcatagtacttttggtacattgtggcttcacaagggccagggtaaaactgcttccctgtccaagcaaagaaaactgcctacatattggtttgtcctggtggggaataaaagggatcattggttccagtcacaggtgtagtaattgtgggtactttaaggtttggagcacttacaaggctgtggtagaaacataccccatggataccacatattaaaccatgtatatctgtggaatactcaatctcaatgtgcacacctttgactacaactgcagaagtgttcctttagacaaagttgtgacccattttactctggataagggcagaaacggttcacattccattatttgtaaagttacctgctgttagctttcattatttttgctacactcattttatttgtatctaaatgttttaggcaacctaagaacaaatgtaaaagtaaagatgcaggaaaaatgaattgcttggtattcattacttcatctgtatcaagcacagcagtaaaacaaaaacccatgtatttaactttttttttttaggttttttgcttttgtgattttttttttgatacttgcctaacatgcatgtgctgtataacaatccaagcataattgttaagaacacatgtattaaattcatgtaagtggaataaaagttttatgaatggacttttcaactactttctctacagcttttcatgtaaattagtcttttggttctgaaacttctctaaaggaaattgtacattttttgaaatttattccttattccctcttggcagctaatgggcttttaccaagtttaaacacaaaatttatcataacaacaaaaatactactaatataactactgtttccatgtcccgtgatcccctctcttcctccccaccctgaaaaaaatgagttccaatttttttgggagaggggagattgattagaaaaaaatgtaatatgttccatttaaaattttggcgtatggcattttctaacttaggaagccacaatgttcttggcccgtcatgacattgggtagcattaactataagttttgtgcttccaaatcactttttggtttttaagaatttcttgatactcttatagtctgccttcaattttgatcctttattctatttgtcaggtgcacaagattaccttccttttttagccttctgtcttgtcaccaaccattcctacttggtggccatgtacttggaaaaaggccgcatgacctttctggctccactcagtgtctaaggcaccctgcttcctttgcttgcatcccacagactatttccctcatcctatttactgcagcaaatctctccttagttgatgagattgtgtttatctccctttaaaaccctgcctatcctgaatggtttgtcattgtctgcctttaaaatccttcctctttcttcctcctctgttctctaaataatgatggggctaagttatacccaaagctcactttacaaaatatttcctcagtactttgcagaaaacaccaaacaaaaatgccattttaaaagaggtatattttttcttttagaatgtaagctcctcaagagcagggacaatgttttctgtatgttctgttgtgcctagtacactgtaaatgctcaataaatattgatgatgggaggcaaaaaaaaaaaaaaaaaaaaaaacacccagagttctcaccacagtttcaaggccctacacctttgatcatccctcagatcacatttcccaccgctctgccccttgctctcatgcctttccagacacactgggcttccttcttcttctccaaacaaccctccttattcctgtgggcctttgtattggctgttcttctcatctggaacttgcttccatgtggcttgctttttcacttcgttctggtctctgttcagatattacccattagagaggccttctctgaccccaactaaaatagcaattccctagtccccatccctataacacctccttaccagcttaattttacttcctaacaagtaatactacctggctttacattctgttaatttgcatttatggctctatttgctttcttaaattcaactctttaggccaggcacagtggctcatgcctgtaatctgggcactttgggaggccaaggtgagaggatcacttgagaccaggagttcaagaccagcctgggcaacatatcaagacccctcatctctttttaaacataaattaatttaacttaattaagttcacattttataacttgtcttaaggattcaagaatgactgaatctacacagaggagaattatataaattcccttgtaacattaacttaagcctaaacatcatcaacatactattaagggcatacagaactttggagttctgatttcagcttctactccttcctaaggtgataacagttacacagccatggccagaagaccctgttggagtctagtttgcacttttttcttctgtatcatgttcattcttttctaggcttgctcacttgctgtgtcccatactggaatcatgctaggggtattgccatcttagtctgttgtcattgttctctctttgaaccaacagaaagttctaactaacagcagtctatcagttgatttcggtagaggtttgcctgctctcccatagactcttcttgctactttgtgtcatgctgtggtttgctcactattcatttctacacttgccttccttctttctctggctctcacatacacacttgtatttcctggctcatctctgtttgtgctagactattggaaaagtctttaaacttctttggacagaaagaataacttccaaagtagaatcctgatgctcccattgggcagagtaaggattcctcccacctgtgtgtcatcatcaaacacaggtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaaccctcattgttatcacaaagcatatgatataaaggagccctggtcaagcaggataccccttggggagaggatgtctttgccctggactaggaatcaggcaagtggttttctttccccttctcctttttcacctcccacccccacagagaggaaaagcagatccagagaagacatgcccaggaagagcgttgaagtccctgggaacaaggcttaattaaaatcattaaatctgacccatccatgtagtactccttggcttaagggtggaatgaataaagcaaagaaaagaggactgggcagggtggagaaagaaagggccatggctatcccctaacaaccaggatacaatggctctgtaggtaaaatcagaggtttcaagaaacattttggaagtgtaaaatatattttttcctaaagaaatctagactgtcactcaaaggaagacaatattgcatagtaaggcaaaaaaaatgtatctgtgtttcttgaacatccatgcttccttagtaattcttagcactgtactctaaccttacaagcaaataatacctaaagaacattggatggaacaggtatgtatttggagaaatcagccagacgtgagaatatgacaaataattcaagcatccagaataatttagaagtttttaatgtgtttctctattatcatgttatctaattttatgtaaactgcattgttcatcttcaatgaatccttatcttcgggtttgttttttgtttgtttgttcgtctgtttttcttttcagccccactgtgttctccttgcctcaaaagaaaactcggcacctgttaaacttggaggctttggggtagctattcaattaggggagtctggacttgtagctggaggtaagactgctttaaaaaaaaaaaattcttcaaaacctggtcacttgcgactggtataaaactttcaagctacatattagcccaacctcagtgtttcatacctcattccaccccaccccaactcccaaaaagcatcatcagatagtttttaatttaataactctgtagtcataactagaatcttagtcccttaagaatagactcttttttctctttgtacctccagtacttaagagactgtacaagattaaaacagtgttcagagaaaataagtttgaggcatagtgccttttaaagttgaactggccaaatgaagtcaaatctaaaatgtgtagattagccacttcctggtttacactgatggctaatttttaatttcatactgtttgcctttttccatttatcaaagaatcctgctcaagccatcagcctgtatattagcaaagaataagcagatgtgaatgcaggctgattttattattagccaaagcaaaacataatttttaaattcccatgtcagaataaaaagaaaaaagttacaaattatataatcttgcacagcacatttcatataactcaattccttatagctagaacatcaagcagtaacaacatagaccatcttcagaaaaatgagccataggtcatagttgtaatttttttttttttctttcagacaatgtcttgctctgtcacccaggctggagcgcacagtggcacgatcatggcacactgcactgcacccttgaccttccaggctcaagtgatcctcccacctcaacctcccaagtagctaggatcataggcgtgtgccaccatacctagcaaactttttttatttttagtagaggcaaggtctcactacattgcccaggctggtctcaaactcctgggcctaagcagtcctcctgcctcagcctcccaaagtgctgggattacaggtgtaagccactgcacccagccaatagttgtattctttaaataattttttcaccacagtgccctctaaaattaaattacattcaaattttcttttagtttcacattcttttccagttaatcatttccaataatatgcaaaactgcaagctgagtatagtttcaaagaatgctaattttttcccctaatttaaaactttctgttagtgattggaagactgaccaaagggtcaggtagtaaagcacagtttaatcatagaatctcaggactccaaagggccttaacttctccagtcttgtaactaatgattgaattcttccataatattcccaagaaaagattgagttctggtattaaacctcagagagcaaagtagtcactacatcccaagacagttcatttcatttttggataactccttaagtattaaaaagctcatctttgcatctttctgtaacttctacccagtcatcctaatcctgacttttgaaaccactctgaacaattttcatccttccgtatgataaccgttcatctgtttgtagacaactaccatgtccccctaggtcttatccaagttaacttccctagggtgatttggccattcttcatataaactggttcaaaatctcttcagtatccacaaagtacagggcctgaactgaacactctaactacaggtagtacagtacagccgatccagtgcacagtagcattgggctatcacttttttgtgttctgggccttaaatttccctcgagttccccaaattgcattagctttttggacaactacatagcactgatggttcatactgatcttgtaatcaagtgaaaatcctaaattattttttaaacaaatgtcactgttaagctaactctctcaattctggtacttatacagatcatttctatgttaagactacgtaattataacaaataatttctgatgattatattaccaaggttaatgggatgaaatgaaatgaatttattttatatgttatatactggccatatataatgactttgtttctgttgctctggatctatatcctgttggtatttagaatgtcatgttcttcgtattttattgtacatcttgactgggggggaaaatagatgcattatgtttacctggacattttctccatattaatctttttctaaagtccatgaacctttcacctaaattgtttatttttaaagctaattttgaactcccccccaccgcccaccgctggtatgtcagtattcaaaatgtatttttctccatgcttctagaattaaaatacttcctgatggtcaaaatattgtcatttcttagcacacctttttttgtattcttgaaataactgaatgttacgttttaaaaaatagaatatgaataaattagagataaattatttctcttagaaaaagcttttctgctgtttaaggtacttttgaaattttggtaattaaggttgggcacggtggctcatgcctctaattccagcactttgggaggctgaggcgggcagattgagcccaggagttcaagaccagcctgggcaacatggcgaaaccccatttctccaaaaagatgcaaaaattagccaggcatggtgacaagagcctgtattcccagctacatgggaggatcgcttgaacccgggaggcagaggctgcagtgagctgagatcgcaccactgccctccagcctgagcaacagagcaagaccctatctcaaaaaaaaaaagaaagaaattccgtcaatcatttaattatttatcaactttaaagcagaaagccattttcctgtcagtttgaaatcccagtccctagtcctccaaatagaaaggaattcatttctttatatgttgcatatagtaaaaatcatttaaacatatttacactccccctacctgaaactcagctatttaggaaacttacttatccagaatacaactagaaacctagaaaataactacaatagcagcaaaattattcctacccttaaaaatccactcatgctcctcacaattgagcatctaaagacactctctaaggctgacttgctcccatgttttaaaaagttgtatagattcgtgttccttcataccttgcacatgctattccttctagttggagtgccttttgttattttatctatctggttaactcctactgttctggaaggctgagctaacaattatctcctctttaaagcaggcttaccttcaccatcccgagttggatagccctattccttctctctatattcccataactatctgggctacatacctccatgtagcattggatgcagggacttacatcaaagactgtgatttgtaagagtaagggggaccatggctgagggtatctaggacctagcaagcacttaggaaattgctattaaatgaaataaactggttgctagtcaggttctagttaatagcagattataaaagcaacaaattaggagaacgcagaactaaagcatagtgagagaaaagaaataaaagcctgacaaaaatatatatgatatatactgagcagacaccaaaacttggaaagcgcaacagcctttcaatatgaaagaaatcaactcttgcatacctctgaagttcctgagggtgctttctgttctacagcctaggtctttaatcagtatctacaatgacaactctgagtcatcaagaaaaggttaaattatgagcagcattctgtgtaaaagaagtcaggaaattgtagaaagccatacaaaattatttaactaaggtgggcactgtgactcacacctgtaatcccagctacttgagaggccaaggcagaaggatcgcttgagcccaggagtttgagactagcctggggaaaatagtgagactctgcaaaaaaattattaaaacaaaaaggattgtgcgcataaagattcaaatcacaatgtatttaaaaatgtagctattcagaacaattctccccctgagattctggtaggaaggttttattgtattatcaaaatatataatatttaaatatttgtccaaaatatctcaaactgccatttaatttagtttgctaatttgtttccttttcttaaaattttgtggtcaaagtcctaaaagtcaagaagaagtatcagcaaaaacaaggatttttaggaagttggtgtatattaaagattaactccagtcctttttaccttctactgatttacatgaaataaaagagccttcctctacattctttctaccatggtttttcccctatcatctgtgagcaaattattgaaccaaacaacaggcatcttcccgaagattgaacactaattctccagaattgggtagtcttcgtctagctaaatggagagaaccttctcaggatggctgggactggccatggtcgctctgattattcccaagttaaggcccccattttgagtggcttggcccaggaagtggtaggagtcaagttgagtttcaaagcatcatccaaactgtcagcaggtacctaactggtaccctggtaccaattgaatgatactggtttcccctactcctgctagctcctgtccatcagaacaaggctaattctccagtggcccctccctgtccaggctattaatgaagtatggaaggcttagttcccatccctgcagcttcttcgtgttacttgaggaagcaaaatggggcaatacagaaataaaagtatttctctagccaggtccttctagtcaatagttttcactgatctatcgtacattttaaatgaaaatattttcactactggaaccctgaacttaagcttttctattatggggggaggaagggaaaccatatgatctgcagcaaaggtacatcctgatacacaagctaagagctcttttatctttctgcatcccaactgagtttcataatcatgaacagaacttgatatattctctctagctgaaccagaagatctctaaggtcttttaaaaccacagttctgagttctagataaagtattgcacaatcttcaaactaaaaattatcttgaactcagtatgatgaaagagagagacagagggaggaagggaggtggctgggcttgcatatatctagaagagctgccaagtctagtgggcagtgccccatcccacagtgatcttcctgccgggtacaagcctttcattccacaatagaagacttcttttgggatactgagttaaagatagttatgaatgtgcaaacagctagtatcagattccttacagaaagctaatttttgatagagaaacaaaagaaaactctttaaagaagatgaaagtcaaagaggattgaatgggaggagcttcataattttgcttttgtttatgccatatatttgctctcattctcttcatatgttaatgttaggaggaagctaaaaactcctactataacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaaccttctttgtgtaatttgagaaaggggcttcatttttaaagccttctgcttaatttgtaaagttaaaatggaatttcatccaggtataattttagtcattctttatcttaattttaaatttaggccagcacagctgaaaacatttgccatttacattccaggataaactgaaatgccaggatgacaactgcatttcatgatacaatatagaggcatttcagtgtggcttaaacattcctattcttctttggctattaggtgttggcagcctcatgtactatcacagacttgtgattagtaaatcattactttaactagtaaaaaattgaaaattcattactgactttatgaatagcgatatcacaaacacctaaggacttcttggaaataagtaagcttaaagttgatttcactaccccagcttttagactcctttgccctgtcccacaaggtacgactgacagtgactaggaggctgggcatgggaagcatggggatgtgtgtgtctgggtatcaggttaaggctgtttaagttggggaaattctttttcctctcattattactgaaactcatactttctattcaacctcatcactgtttcattttcagccatgactgacaacataaaaccaaaaacatgtgtatgtaacactggactctaaaactatgaggcccctaaagttttctcttcaattcctcggtaatgttagaattttatatgggacttggaaaaataaaatttaaaaagaagaaaagtaaagtggttccagagttacagtcttatccttttaagccataactgaagtttatggagatgagaatggtatatacttttgttggtttatttacctcactcaccatcagtttatgagtgcatataagtttgtcttttgttttagttagtttaagatatataccaaaactctgttaacagagaaagatgttttcagtgtagcatattctgctcctcccagagtcagctggccactggggaataaaatcaatacttaccaggtaactaaatgtctcaggaaactgcttgtaagtagtcatccctcttcaatccagggaagttgtaagttgctctcaggaatgcacagccaaattctggttgaatttagccaagtgaaatcacagatactaacgttttaaaagaaacatgattagtgatacatcagcataataataatactagcaataatgatagctaactcaggcatagcacatagcatagcatactttacataagtaaagtgcttagaatagtttaattcatttaaccctcacagcaacttgtgaggtaggtaccatataataataatcccccacctgcgtttttgagttataggcatttgctaataatagaattcttcctttgtgtttgttcagttgttaacttcctagtttccaaggcaatgtgcttcattccaacagactctggtattttatttcgtctatttttaaaacattgaatagttatttttgtttcttggtaaaaagacttagactattcacatatgtgcaaaaattaagtcatttaaaaattccctcttcctagtattatagtaagtcagatggatggtggcagctacatcataatttttttttgtacctggggtttgaagctttgaggttaataatttatttacttttttacttggctaacctcacctctcatttatcttcaggactttccttacaaaaagcctaggttttcaccaccttagtttgaagtatagatccatctctaccatctatgatgaatctcggcctttttcttttagtatactgtcatatgattctgtcagcatttatttttctatcttttattatcaaaaatttcgaacaaaaatagtagagagaatagtataatgagctcccagcttcagtaacacagacaatcttgttttatctgtattcaacatattattacattattttaaagcagatctcagctgggctcacttgagctcaggagctcaagaccagcctgggcaacatagggagacctggtctctacaaagagtacaaaaattagccaagtgtggtggcacacacttgtaatttcagctacttggaaggctgaggtggcaggattacctaagcctgggaggtcaaggctgcaatgagccatgatcacaccactgcacttcagcctgggcagcagagcaagaccctgtcttcccaaaaaaaaaaaaaaaatagatttcaaaaaaattatttcatcaccttggtggttcttttttgagacagagtcttgctctgtcacccaggctggagtgcagtggcacgatcttggctcactgcaacctccccctcccaagttcaggtgattctcgtgactcagcctcccgagtagctgggattacaggcgcatgcaccacgacacccagccaatttttgtatttttagtagagacgggggtttcaccatgttggccaagctggtctcaaactcctggcctcaagtgatccacctgcctcggcctcccaaagtgctggaattacagctgtgagccaccgcacccggccacatttcatcaccctaatggttctgagcaaaagaactattaacaaaattcttgatctctatggatattttaaagaaaagtttgatgacaccttttaaatgcagtactttttttttctttttttacctccagcagttgcaaatgtgagaccacattagaaaatactgtttcactggagtatatgctaacacttaacctcaattaacttctttgtaaagggcaaaaatatatttcccaaaccatatataagaagtgtaatgtcatatcattattacagataaccagttagtatatacacagcaagattctaagctgctatgggtttggtattcaaataagtaagattgttttatagccttattttgttcccccgtatagattcaatctccccaatttgttttagctactcttctcagctgaaggaatagaaaatcctgtgttggactgtcttgtaaaaaggacaagggagtatccttctaaacctctactcatttcagaaatcttaccacccctttcagatgatttctcaaccactttgtcaaggaaaaattattcagactttaaagagcacattcgctccaggatagggagaggaaacaagtctacccaagccctgtctaatcacttacctcatttcaaactggtcagttgaccacaatttcactaggatgaaaagtgtgggatttcatccctcccaaagtgtgggattacaggcatgagccactgtgcccggctggataatgataattaaacagccttatggcattagtcttaatgggatttgacaagcagaagtggctactatttgaaattctgcctgttggggggaaaaatgaagcacacttcaattttaagggctatccccaacataaagacacttttcactccccatcttcaagtacaaagtctcacattagtcagagctaatgctagcccttgctcaaattgtgatgattcatttatactgcagtgcaagtactgcagtttcatttggctttaaaatgttgtggagtttattcttcatctttcttccttagaaggtgatgtaggtctctgcctgttaaagccatggctttgcttgaaggtcctggcactgggtagctcacataaactcaccccatcagtaaacctgttgatattgaacaaggaatgagaccctactctgtctctgtctcctttccccacttgccttcccaaccccatgccctaaccactctgatttttttttaaatgattctgggtctcagacatatcccttttcccaggagccttctagcacttggctcacagatccacagcctttctcataagtcctgtgtcttttgaacaattcataattatttttgtttgattttaatcaatataccatgtggcttagttgtctcatctctaaaagagacaaaagtaacttcactgaggacagtattcaagcaaatctgttattctgtgggacctacggtagtagaatactttttcctaaacaccgaagttgatatgcagtgaccaaaatatcctattaaaaactttgcacagttcacaattattgctaacctcgattttttaaaacatatcttaaaaatatttctttaaaaattttaagttttattttagttctttctggatcgatgtattctagtctccctagctaaggatctaaagatagaaactggaataatgaacattctagtcttcaattattgaaaatattatcacttacataacaagaatatgggtatggaatatttactaacacaaattcttatgtagtaaagaacaacagaagaattgcatttgtccttttcttagaatgcaagcctttagaatcaaatttctgttctttgctctcagaattttattcacattgaagcaatataggaatattaaataatagtgaatgttaatgtctcatttaaggtaactatgtagttttcctttcctcctcctcagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttctgtcttaggaaaacggcaggtttttttttttttttttagacaaggtctgacaacattgcccaggctggagtacagtggcaccatctctactcactgcaacctctgctcctgggctcaatcgatcctcccactttaacctccccagtagctgggagcacaggcatgcagtaccacacctggctaatttttgtattttttgtagagatgggggtttcaccatgtcgcccaggcttgtctcaaactcctggactcgagcgatctgcccgcctcagcttcccaaagtgctgggattacaggcatgagccactgcgcccagccaaaaggcagattttaaaagttcattttatatcccatcttgccagtgagtattaaggaaaattataacttgggacagcagtgaaacagtactttttgattaaaacattatacagcccaataattccaggcaattttcattttagatgttagaaagactaacgcttggagaggttaagaatttgcgccaagttggccgggtgcggtggctcatgcctgtaatctcagcactttgggaggccaaggtgggtggatcacaaggtcaggagtttgagaccagcctggccaatatgatgaaaccccatctctactaaaagtacaaaaattagcctagcgtggtggcgggcgcctgtagccccagctactgaggaggctgaagcaggagaatagcttgaacccgggaggcagaggttgcagtgagccaagatcgtgtcactatactccagcctgggtgacagagcgagtctccgtctcccaaaaaaaaaaaaagaatttgcaccaagtcacagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatctctactaaaaatataaaaattagctgggtgtggtggcaggtgcctgtaatcccagctacttgggaggctgaggcaggagaatcgcttgaacccaggaggcagaggttgcagtgagccaagatcacgccatagcactccagcctgggctacaagagcgaaactctgtctcaaacaaacaaaaaaaaaagaaatataaaagaatatataattcaaaagacactgccacattactagaatctcattcaggcattgataattagttcagtccatcatcataatgtatgaataggtctcccagcatgaggccactcaggtttgcaggctttccattgatcttgccaggttctaaaagcaggaatggtcttggtttcaccgtttcagacacctgatataattgagctaagaaacagtatcctttcttgctctgagtctctttcaaggtgttaatgtaatgtgataatggatttccctgaattcataacacatttatttattcctttactctcagctgttaattttttcctcactttattaataacctttggaagaaacattagaatcaacatcgtgctggtctagatggcagacagcaatattagtctagtaattacctcctcctcagtccactcccatgcagggagactaaggttacataggtgccaatttagtggaccgtttttaccaccaggcaatatagctgcattcacaattaacccgttttgcacaacccacccccatcaggtccttaggaattctgacacaaggtttaaaaacatagttacaatttcttgtttaggaatcatccctggttctaacactggtagttatggctctggtcctagaaccactgcatagggaggggcagggggagtttagatgatatgggaaagaaggaaagaaaaaagtatagtcattatatcagcatactcccctcttgtcaagaattgcatagtcataacagcatcctctaccaccccccttccccagatcaatcagaaaaacgaaagaatatctagtggggacactcctttagccccactcatgttgagtgtgagtacacactggtaaaggcaagtaagccagcccttcctgctttcatctccccctgttttagacaaccaatgttttcattgcccattttagtctctatcaaactattactctgagaagaatatctctgcccactgctggaacattatgggctgtaccgtgtgttctttggcctaaagaaatggtgttcagctctccaaatatgtgcaatatcttctgttctggcttttttatggtattctcatcattcacatcttccaccgggcaagcaaagcccagtccagaatcagtgtctactcctgtcaaaacccatctgtggcctcccagggttaccagcatcagcctcacttgccagcttgttcagggctttcccaccagggaaatctgccccacagccatgggcagtgtctgtctcttttgctggcagacagaacagttcttattggcattttgtgcctgaaatgatacaaaagaaacctgtctagatgcagcccatctctgcactgttgcagtacccgtttatccactcatttgatggacccaggtggccacctcgagggagcacacagggttctctgcttgtcaatgtcaatcattttccaaacccagaaagaggctcttatgatgggcatcaacatattctacttattgcacccctcaaatttccatagggccattctccatatgggcatccctttaataaataggccaggtttccactgcccttctgcctgaccatgtgaccaggccactggtgactgtccatgagtcagtaaaaaaccaaacacgggagcttttgttattgttcatttcttcagaatgcaattcaactgccaagctaatgtgatcttaccttctttgatcaagagtggcatccttccaaacaggatgctgtcgattcaccttggaactgtcatccacacaccaagcagctcttcgttggtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcccatagcaaggtagtaaatgcaccgagatggaaattctctagtgcaaagtcctagtggttgtcactgggagatgctcacagactttggccataagccccagtaaacatcctgcaaagggcgagcagatggagaatttgtccctaccagcactccagcttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatctcatactcctatcaaccctcacttttaccctttcttgtttaaaaaaaaaaaaaaaaaatgttgagtccccaacagcaggttgagccaagggaccttgccccttttgtcagtctttgtattgattaacctgcctcaacattaccccaagtaactgttggtcagctttctcactgtaatctctgccttctgactttttcaatttctccaaactggggtgaatacagcaaacctgtttggaatcccttaacattgggagaacagcagaagctccctaccaacctttgatagtattatattgagatctttgttttaaccccatcgatttccactttattcatctcatttctttttatttcttttttatttttttgagacagagtcttgccctgtcacccaggctggagtgcagtggcgcaatctcagctcactgcaacctccgcctcccaggttcaagccattctcctgcctcagcttcccgagtagctgcgattacaggtgcccgccaccatgcctggctaatttttttgtatttttattagagagggggtttcaccatgtttgccaggatgctctcaaactcctgagctcaggtgatccacccgcctcggcctcccaaagtgctgggattacagatgtgagccacagcatccggccctattcttcccatttcttattagccctctaaagattccaccctgctgggatgagtcccatgattctcctctttcttttttctcttagtttcaccccatcactgttttcttcattcaccttatttattaataaccatttaaactttccaccttcctgggatgagtcctgtgactctcctctctgcctttccccagtcttttgttaattacgctcatgttttcattggtgcccatacaaaagaggctccctcagccatagcatttactacagccagagtaatggatgtattcagtgagtgaatatctcagtcatcataaagccagtcccacatggcctgcataggaaccaaatgagccgcttcacctggggtactccacttggcattgataggtagagttggacagtctctaccttctcagggtgtacagaccttacagtggcttttattccattcactaggctgactgttccctcaggaataactccctgtgtgtctggatcacattatacccattgttgattgttcagtagtgagctgtgggtcctgcatcaacccaaacatgcctgtccactctgcagcatttaaaaccaaagaaagtgccctaaattagttattctcacaatccattttagtaaaggattttcagtaaactgatgataccaatctatgaaatgagacaatttcttcacactgtaccctctggtttcagtagtttcttggttttgcccttccctcacatcaactaccttcgtggtaaccacaggtcgtagaggtactgtcatccctgtataatttttcctttgggggtcagcttgaaggctagtggcctgggctcagatagactgaaatctgagcttggtctagcatcaaggcctcatccagcatttgtttcatttctgttcagctattacagacaaccaccaccaagggagtgaatatttcatctttttcttactagtttgcatatccttatgcatccagtgaaccaactccctgagttggatccatctctaaattccactggtaacttttacctttagcaattgattgcgacacagttgcagctccaaaccatggaagaccacgataatgaaccaggaatcaaaggttcctcatctcccaccctttcattctttctcttcccaaaccacatatttctgtgagccagggccgttctagcaaaccctacttcactgacactaactgaaggtggaaaaactcagaactgttttcctctgctctcgcaccacacaacaacaacaatcaacacacaagacttctttcaccaaatgtgtggggatttctccccattaagaagcaagtaatcagccctgctgctgggtattctctaattcaattctgacactatagtatcacatcccacagtttgagggcttggtccccaaggcctccccttcccaccctttcagacaccagtcacaagtccaggcctccagaatgtcagactgactggctacaaatcagagatcctacacctgctctttgggttccattaatttgttagatcagctcacagaagtcagggaaacacttttaccattgtgttataaagaaaattacaaaggatacagatgaagagatgcattgatggaggtataggggtgaagtgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaaggtgatgacatggaatagtattacaggacaattttgagatttcagtggatcttgattctccttaagaatattacttctcagcctgggcaacatagggaaatcccgtctctacaaaaataaaaattaaaaaattagccaagcgtggtggtgcgcacctgcagtcccagtgactcaggagcctgaggtgggaggactgctacttcaaaaatatgcattcacctctctgatactcagtgctagttattcctgatttcccctagaaaagagtagtgaacaatttttagatactttctttgttttgttttgttttttatttgtttgttttgccctcccagatatataatgaacactttagaggtaattcctatttctcctttacttttctcactttctccataacggggatcttttgttcattcaaagctggtttaaatgccaaataacaatgaaaatggcaggcattttagtcatttttcaaatctcttagaaggtggtttaacattataccatacctacttacagtgctttcaaagcttatcttggctaatagcatatttatttttggaaacctttgttcctgccaatgattatagttctcgttctaagtaatttgagcttaatacataataaatttctagcacaagaaagacaaaaaatgtcagtaacttaaatgaaaaagtttaagacggctctttgagctgagtatcgcatgccatgtctaaacaacagtttaacttcactacttatgtcatctgaagatggaaaaactcaattagaatgttatccagctggtaagagcaggcttatgttatatttcagtatttgtccatgtgtatttataaatcattactgtggatgtaagaggtatttttttagaatggttgaaatttaaatatgaaaaacacctggataccttgcaaattgaagaaataaaatgatactggttgcagtggcttgagcctatagttgtctcagctacttgagaggctgagtaagtaattactgagtaattactctaagtaattagagtaaggtgggaggattacttgagcccaggagtgaaaggctgcagtgagctacgaccatgccactgtactccaacctgggagacagagcaaaaccctgtctccacaaaaagaaaaaaaaaaacaaataagatgaagaaaaactttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatggaaaacaaaaaaaaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacctagattcaaaaagcaggtccttagagacctaaaaagagacttagactcccacacaataataatgggagactttaacaccccactgtcaatatcagacagatcaacgagagaaaaagttaacaaggatatccaggaattgaactcagctctgcaccaagcagacctaatagacatctacagaactctccaccccaaatcaacagaatacacattcttctcagcaccacattgcacattccaaaattgaccacacagttggaagtaaagcactcctcagcaaatgtaaaagaacagaaattataacaaactgtctctcagaccagtgcaatcaaactagaactcaggatgaagaaactcactcaaaactgctcaactacatggaaactgaacatcctgctcctgaatgactactgggtacataacaaaatgaaggcagaaataaagatgttctttgaagccaatgagaacaaagacacaacatactagaatctctgggacacatttaaagcagggtgtagtgggaaatttatagcactaaatgcccacaagagaaagcaagaaagatctaaaattgacaccctaacatcacaattgaaagagaactagagaaacaagagcaaacacaattcaaaagctagcagaaggcaagaaataactaagatcagagcagaactgaaggaaatagagacacaaaaaacccttcaaaaaaataaatgaatccaggagctggttttttgaaaagatcaacaaaattgatacaccgctagcaagactaataagaaaagagagaagaatcaaatagacgcaataaaaaatgataaaggggatatcaccaccaatcccacagaaatacaaactaccatcagagaatactataaacacctctactcaaataaactagaaaatctagaagaaatggataaattcctggacacatacaccctcccaagactaaaccaggaagaagttgaatccctgaatagaccaataacaggctctgaaattgaggcaataattaatagcctaccaagcaaaaaagtccaggaccagatggattcacagcccaattctaccagaggtacaaggaggagctggtaccattccttctgaaactattccaatcaatagaaaaagagggaatcctccctaactcattttatgaggtcagcatcatcctgataccaaagcctggcagagacacaacaaaaaaaaggagaattttagaccaatatctatcgggggacttgccccgataatcacgtaggttcttttctatttttcttaagcgtcggccggcatgataaataaagggacagagtacaaaagagagaaattttaaagctgggcatccaggggagacgtcacacgttggtaggatctgtgatgcctttcgagccacaaaaactagcaagtttttattagggattttcaaaaggggagggagtatgcgaataggtgtgggtgacagacatcaagtacttaacagggtaatagaatattacaaggcaagtggaggcagggcgagatcacaggaccacaggactgaggcgaaattaaaattgctaatgaagtttcaggcactattgtcattgataacatcttatcaggagacagggttttgagatcaactggtctgactaaaatctattaggcgggaatttcctcttcctaataagcctgggagtgctatgggagactggagtctatcttacctctgcaatcttgaccataagagacaggtacgcctcggggtgggcgggggccagttcaaagacttactcctaggtgcgcattctctttctcagggacgttccatgctgagaaaaagaattcagcgatatttctcccatttgcttttgaaagaagagaaatatggctctgttctgcctggctctccagcagtcagagtttaaggttatctctcgtattccttgaacaattgctgttatcctgttcttttttcaaggtgcctacatttcatgttgctcaaacacacatgctgtacaatttgtgcagttaatgcaattattacagggtcctaaggtgacatagccttaggctgacaggattaagagattaaagacaggcataggaaatcacaagggtattgattggggaagtgataagtgtctatgaaatctttacaatttatgtttagagattgcagtaaagacaggcataagaaattacaaaagtattaatttggggaactaataaatgtctataaactcttcacaatccacgtttttctgccatggtttcagccggtccttctgtttggggtctctgacttcctgcaacatctctccctttctttttatataaatgtgccatggcgatgaaggcttgttcgttctctcgattttgacgcaggattctttgactggtccagcacactaaaaacaaaccgattaaacagagaaacttaattctaaaatttactacagtggagcccccaataggcttaatctaagtcgtggggtttaatctataaagattttctgccacctgatctaacgcctcagctccaggcagaatggataagtgagcttgagaggcttcaaaaatttgtttctttaattatgtctaatgataaattatcttctttacctagaaggtgtcctttgactttttcctatgaattatcagtctcattataggaatacggggtgatgcagaaatccgaagtattccaatcgcactgcatttgcaatgcgatgttcgagactcactacttgatctctaagccaaataacagactgtcttaaatcattaatttgatttgccaatttttgatcgatgccttgttgagaattccacatttgggtggaattggcttgccaatcattaacaaaatgagccctttgaatagattggtgtaatgccattctagcagtggtggccattgcagtgacagtaattaggcctatgataacagcaattaaagtgaaaacaaatctcttagatctttttttagaattcgctgtagcacttcattaattaaatgtattgagggggaggatacctaaggtctaggtaaagttaccggaacctagattccttcttgagctcgaaccaacattacacttttcctggagtcaaaatgggagttaatacaagtgtatagatgacaattgatgcatcggacggtttgattattcgtctaaattttgatatttcctactaacagtgtgtaaggaggcttaacacaactctgtatgggaatagtcaggttggaggtaagtaaagcagaatgtctgggtctacgttgatactgagagagtgggatggtaatgggaacaacagtcgaaatagttttcttttcctatactggcagtccagacatggcaatagccaatttttaaagttctgggtgttctgggctcagaatggggagtatcatacgaggcctgggggtgggtaatgcctttatcttcctattttaagagaaagaatgagctgatcctcgtatgcacagtagaatgatgattctcattctcctgataagaagtaaaataagtagcctccaggcattcctttccaccagaggagcaattgttttttaaatagccttttggtgcctagtctattactagaccatatgagtcattttttagtattactgcatgtgagttaacacagtcttcctaaattaaagttttagatgggccctcaaaatttttagggcatggttttcctgcaggtttatattgaaagtatggggtatctcctattactcctcctttcatttgttttaaaggagaaagggagagaccagagactaaatgtcctgttttatctgtagctgatgtttccggaagataagcagcctagacttgagttcgtagatggatgcaactaggtgcatgtccgaggcacagaggggggtatttataacctatggtaacattaaatgcagtgccttcttctcctggttgagcagggcaacggtcatctgtggctctaggcatccacacactatcgttagtgtagatttctgcaggagcatctatctaggtgagaggtcgaataagtggaggaaaaggcacataagcctaataagaataattatgtgtagcaggtaaatcagtgtgagaggaaactggtgagacagaaagtataaggaggagaatcattaaataaaacctagtgtaagcgagattgagtgctgaaggaggaagagaagaacagagggatgttattttcaggctaatagaaatggtgagatttttaggtttgtaaggagaaaaagaaaagtaatcaggagaagtgggattagttagatgggtctccattgccttcagggaggattgatttacacctattgtgatttgatgtgcctgtttctgaggaatcagcacagatctcatcatatctgaaggcagtctctgacacagacgtcttttctctgtggttttgattgtcagtattcacctgaagcttgagtcttctggtgggtacttagacaggggattgatgatctcctggtgaaacacaagcatatcctcttcctcatgttataattgtgccaggttcctaggtattggtttgggagtttttccataacactggcttgccttcgtttaaggaaaattttttgcctgtataatggcattcggctgcagttagagtattatctttaggaacatttaaaaaatttaaagtaaacaatgccaaatgtaattgggagtggggagttgttaaatcatgttttggttgttcagactgttgggacaattgggtttttaaagtgcgattgtaagggattctagtagtaggatctgtgatgcctttcaagccacaaaaactagcaagtttttattaaggattttcaaaagaggaaggagtgtgcgaataggtgtaggtgacagacatcaagtacttaacagggtaatagaatattacaaggcaagtggaggcaaggcgagatcacaggaccacaggactgaggcgaatttaaaattgctaatgaagtttcaggcactattgtcattgataacatcttatcaggagacaaggttttgagatcaactggtctgactaaaatttattaggcaagaatttcctcttcctaatgagcctaagagcctataggagactagagtctatcttacctctgcaatcttgaccataagagacaagtacgcctcaagggggccagttcaaagacttactcctaggtgcgcattctctttctcaaggacgttccatgctgagaaaaagaattcagcgatatttctcccatttgcttttgaaagaagagaaatatggctctgttctgcctggctcaccagcagtcagagtttaaggttatctctcgtattccttgaacaattgctgttatcctgttctttttttgaggtgcctacatttcatattgctcaaacacacatgctgtacaatttgtgcagttaatgcaattattacaaggtcctaaggtgacatacatctttctcggctgacaggattaagagattaaagtaaagacaggcataggaaatcacaaaggtattgattaaagaagtgataagtgtctatgaaatctttacaatttatgtttaaagattgcagtaaagacaggcataagaaattacaaaagtattaatttgaggaactaataaatgtctataaaatcttcataatccacgttcttctgccatagtttcagccagtccttctgtttaaggtctctgacttcctgcaacaaatatccctgatgaacatcaatgcaaaaatcctcaataaaatactggtaaaccgaatacagcagcacatcaaaaagcttatccaccacgatcaagtcagcttcatccctgggatgcaaggctggttcaacatatgcaaatcaataaacataatccatcatataaacagaaccaacaacaaaaaccacatgattacctcaatagatgcagaaaaggcctttgacaaaattcaacagcgcttcatgctaaaaactctcaataaactaggtattgatggaacttatctcaaaatagtaagagctatttatgacaaacccacagccaatatcatactgaatgggcaaaaactggaagcattccctttgaaaactggcacaagacaggaatgccctctctcaccactcctattcaacatagtgttggaagttctggccagggcaatcaggcaagagaaagaaataaaaggtattcgattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaatagagagccaaatcatgagtgaactcccattcacaattgcttcaaagagaataaaatacctaggaatccaacttacaaaggatgtgaaggacctcttcaaggagagctacaaaccactgctcaatgaaataaatgaggacacaaacaaatggaagaatattccatgcttatggataggaagaatcaatatcatgaaaatggccatactgcccaaagtaatttatagattcaatgccatccccatcaagctaccaatgactttcttcacagaattggaaaaactactttaaagttcacatggacccaaaaaagagcccgcattgccaagacaatcaatcctaagcaaaaagaacaaagctggaggcatcacactacctgacttcaaactatactacaaggctacagtaaccaaaacagcatggtactggtaccaaaacagcatggtactcgtaccaaaacagagatatagaccaatggaacagaacagagccctcagaaataataccacacaactacaaccatctgatctttgacaaacctgagaaaaacaagcaatggggaaaggattccctatttaataaatggtgctgggaaaactgggtagccatatgtagaaagctgaaactggatcccttccttacaccttatacaaaaattaattcaagatggattaaagacttaaatgttagacctaaaaccataaaaaccctagaagaaagcctagacagtaccattcaggacataggcatgggcaaggacttcatgactaaaacaccaaaagtaatggcaacaaaatccaaaattgacaaatgggatctaattaagctaaagagcttctgcacagcaaaataaactactgtcagagtgaacaggcaacctacagaatgggagaaaatttttacaatctacccatctgacaaagggctaatatccagaatctacaaagaacttaaacaaatttacaagaaaaaaatcaaacaaccccatcaaaaagtgggtgaaggatatgaacagacacttctcaaaagaagacatttatgcagccaacagacacctgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaaaacttttacactgttggtgggactgtaaactagttcaaccattgtggaagacagtatggcaattcctcaaggatctagaaccagaaataccatttgacccagccgtcccattactgggtatataaccaaaggattataaatcatgctgctataaagacacatgcacacgtctgtttattacagcactattcacaatagcaaagacttggaaccaacccaaatgtccatcattgatagactggattaagaaaatgtggcgcatatacaccatggaatactatgcaaccttaaaaaagggtgagttcatgtcctttgcagggacatggatgaagctggaaaccatcattctcagcaaactatcagaaggacagaaaaccaaacaccacatgttctcactcataggtgggatttgaacaatgagaacacttggacacagggtggggaacatcacacactggggcctgtcgtcgggtcgggggaggggagagggatagcattaggagatatacctaatgtaaatgacgagttaatgggtgcagcacaccaacatggcacatgtatactataagtaacaaacctgcacgttgtgcacatgtaccctagaacttaaagtataataaaaaaaactataacatgaaaaaaataaataaaagtaaagttttttaattaaaaaaaagataggaattatttctttgataaaaccaccaaaaaaaagttctattcacttatttcacatcaaaaaagaatttgagtgttagaccaagtaatatgttaatgtcttatgactgttaaatgatacctatttaacacctttatctctctgaattaatgatacttggtgtgaatatttattccaacaaaagtaggccatctaagattatattttcctcacagatggttgagctcttctcacaccctctatagccttaatatatagactgtaaagtatactgtcattttaaaaaaagtgaaaaggatatttatatcaggctaatcaatttgaattttgggtaatgaacacaccaattacccgtgttttccaaatctcatgtgcacaagggactatgaatcatgtacttcattaaagtgcaaggcacattactattgaattttttctgaattcatattacattattattattagtgtcaggagatactatttaattcagaaaaaacagcctggacaacatggtgaaactccgtctctactaaaaatacaaaaattagccgggcgtgatagcgcatgcctgtaatcccagctacttgggaggctgaggcacgagaatagcttgaactgagaatgtggaggttgcagtgagccaagatcatgctactgcactccagcctgggcaacaagagtgagtctctgtctcaaaaaaaaaaaaaaaaaaaaaaaaagacgagataccttaacagacttttttttaaatcttgtgattttactagcttagaaaataattgatatcataattgaagcataattttatttaaaaaaatacattttgactctgtcctcacctctctttccacatcaccttagtgaatggtgagcagaaaaggtgtttgctaaaaatagagttcacagtcagatatgtagtaaacttaaacatatttgcaatatgtaaagaattctcaaaactcaataataagaaaacatacaaacaacccaattcaaaatgagaaaagatttgaacagatacttcaacaaagaagataatacagatggcagataagcacaggaaaagatgttcatcattagtcattaggggaatgcaaattaatgccacaatgagatacctgtaaacatgttttacagtggctaaaatcaaaaagactgaccataccaattgttgacaaagatatagaacaatggaggccaggtgcggtggctcacacctgtaatcccagcactttgagaggccaagacaggcagatcacaaggtcaggagatcgagaccagcctggccaatatggtgaaaccccatctctactaaatatgtaaaaattagccaggcgtggtggcaggcgcctgtagtcccagctactcaggaggctgaggcagaagaatcgcttgaacccaggaggcagaagttgcagtgagccgagatcatgccactgccctccagcctaggcgacagagcaagactccatttcaaaaaaaaaaagaacaatggaaactcataacactgttagtaggaacgtaaaatggtataaccactttggaaaacagtttggcagtttcttaaaagttaaacatactcctatcatatagcccaggcattctactccttagtatttacctaagaaaaatgaaacacatcttcatacaaagacattaatattcatagcaactttatgtgtaatagccaaaaaatggaaacaactcagggtccatcagcaggtgaaaggataaattatgatacatgcatacaatggaataccactcagtgttaaaaaggaatgaactattgatacatgcaacaacatggatagattcaaaatcattatgctatatgaaagaagctggacaataatgagcacatactatatgattcaatttatataaaagtctagaaaatgcaaactaagtgacagaaagtagatcagtggctgactggggatggggatgggggctacaaaagggcatgaagatacttttgagcatgatggatgtgttcattatcttgatcatggtaatggttttatggttgtaaatatatgtcaaaacttatcaaattgtacattttaaatgtgcagcttattgtatgtaattatacctcagaaaagctttttggagaaaacaaaaaaatatatattcagagtctatctctctttcaccctttttattatttccagctggtttcatccaccatcatctttcacctggattactgtaaaagcctcctaactagtcttcccgctttttttttttttttaaaccctcatctccttccaatctattctcggcaaaactactaatgtttatttacagttcagggttgaaggctgggcgtggtggctcgcgcctgtaatccgagcactttgggaggccaaggcaggcagatcacgaggccaagagatcaagaccatcctgcccaacatggtgaaaccccgtctctactaaaaatacaaaaattagctgggcgtggtggtgcacacctgtagtcccagctactcgggaggctgaggcaggagatttgcttgaacctgagaggcagaggttgcagtgagccgagattgcgccactgcattccagcctggcgacagagtgagactccatctcaaaaaaaaaaaaaaaaagttgagggttgaaaatttacctattagttctgtaattgctctggcttggatatcttgtactgtgttgaataaaagtgagggaaaacaagaaaaattacctattgaatacagtgttcactatttgaatgatgggcacactagaagccaaacctcactgttatgcaatataaccatatagcaaacctgcatatgtaaccccagaatctataaaaataaagtcagatcatgtcactctagctcaagaccctccactggcttcctctcctactcagaataaaagccaaaggcccgcatggcctaccccagccttgtcatctctctgatctgacccgctattctccttgaccccttcacatcacttcacacacattggtctcctggctacttcttgaaaattccaaacatactccctccattgggcctttgcattggttattttctctgcctagaccactccctcacctcttctaaatgtcactttctccattgggcctactctgaccacccaatttgtttttgtttttgttttttagaaatggggtcatgctctgttgcccaggctggagtgcagttgcagtcatggctcactgcagccctgacctcatgggttgaagcaatcctcagcctcccaagtagctgggattacaggtgcatgccaccacgcctggctaattttttaattttttcatagagacaggttcttgctagatcttgaactcctagcctcaagtgatcctcccatctcagcctcccaaagtgctgggattacaggtatgagccaccacacccagccaaccaccctattttaaatatcaaggtacccaatccctcttacctgctttacttttttgccttattccatagtacttttgacatactctacaatttaccttttttgtgttttctcatcttcttgcactagaatatgatctacatgagggctggaatctttgttggttttcctcatgtatgccaaatgcataggacaatgcctggcatataatcagctcttgaaatatttatgaaattaatgagtgcttatagcatatgaatcctcaagatacattggcaaattagagtaggaccaaagtggggagaagagtaagaagaggtttaaaatacacatgagggaccaggcacagtggctcacacctgtaatcccagcactttgggaggccaaggtgggaggaccccgtgtgagtccaggagttcaagaccagcctgggcaacatggcaaaaccccatctctacaaaaaatacaaaacttagccaggcatggtggcacttgcctgtagtcccagctactcaggaggctgaggtgggaggattgcctgagccagggaggtcgaggctgtggtgagccaggatctcaccactgcactccagcctgggcgacagaatgagaccctgtctctaaaaatatataaataaataatgggggattcatttatttttgagacagggtcttaacgctgtcacctaagctgcagtacaatggtgagatcctagctcaccacagcctcaacctcccaggctccaacaatcttcctgcctcagcctcccaaagtgctgggattacaggtgtgagccaccacacctggcttgcagtgagctatgatcagcccactacactctagcctgggcaacagaggaagaccctgtctcaaaaaaaaaaaaaaaaaaaaaaaaaaaaaaaagcgtgtcctaattagaagagtctgtaattgttatagtccatgacaacgtagaatgctgaatcagttgtggaattgatttttcaaatgcttgttttacctggcaaatcatgtcaaaggtaacctgaggccaggcagagtggcttacacctgtaaatcccagcactctgggaggccgaggcggaaggatcgcttgagctcaggagtttgagaccaacctgggcaacatagcaatactccttctctattaaaaaaaataaaattagccaggctggtgcacttatatcccagctactcaggaggctgaggtgggaggatcactttgagcccaggggtttgaggctgcagtgaggtatgattgtgccactgcacgccaacctgggcgacagagtgaaaccctgtctcaaaaaaaaaaaagtaacaatgcctttataataattacgatttgttattttagccacatagccatatatatgaaatttacgtgacctattatttcagccctttattgctgaaaatgaaatattattttattactatcagtttaaccttaatatccctcatttcagattgcttaccagtatcatggaataaaatctccaatctaaaattcaatctgagttttatatttaagaattttagctttattatttgttttagattaagcttctgcacttttttaaacggttatatatgttcattatctttcatcttacataggagcgggatcgttacgcctacaagattcatcttccagaaacagtagagcagctgaggaaattcaatgcaaggaggaaactaaaggtaaattaaacaaatcagcaaaaaagccaaacagatatagttaatgatcatgtttttattctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttttcaaacttaaatattttgacaaatgtatgtttagttcaatggaaataactttgaattagaattggaattaggggccgggtgtggtggcttatgcctgtaatcccagcactttgggaggccgaggcgggcggattgcctgaggtcaggagttcaagaccagcctggctaacatggtgaaaccccgtctctactaaaaatacaaaaattagctgggcctggtggcaggcgcctataatcccagctactcgggaggctgaggcaggagaattgcttgaacttgggaggtggaggttgcagtgagctgagatcacaccattgcactccagcttaggcaacaagagcaagacttcatctcaaaaaaaaaaaaaaaaaaaaaaaagaattggaactaggattgaacaactatcagaaagcagtaaataaaatcttacactaccttgatctactagaaaatattttcagctcagatcacttttctcaccttctttattcttcctaggtgtctttctccctcttactactctccctatcctccacctcaccaaaaaaaaaaaaaaaaaagaagaagaagaaaagaaaactggtaatcaccccatatggggagtccatttgactttaaaaggttctgaaaaagaccagacataaagtaatggaatcttttcagcactgagagaaaatgctgagagaccatcccccacccaaccctccagagtaacaaagggaaattgattatcttaacttcttagaattaatttatgtttgacttacttttgatactgaaaaatgttaactgttctctaagtggttgattagatagtagtcttccttagtcacatgactcctgccaactataaaacttttcttcttaagtattttcagatatgccataaattctaataataccattttatttttcaacccctgaaattagtgaattattatgtataactctagacttataaaaacatttatatgaattttgaggaaactattaggctacaatattatcctatagacctgaaacttttaacatggtacccactggccacatgcagctatttaaatttaaattaattaaaattaaataaaattaaaaggtcagtttcccagtcacactagcacatttcaagtgctcagtaaccacagttggctagtggctactatattagacagcacagatgtagcttgggacatttccatcattacagaaggatctattcaaccatgctactatagaacaagggaaatattaacatatcattgttggtgttgattattcccattttagcctttcttctcactgattttgcagtcaagggttcaaagtgactcttctctatttgctttaaaaatccttggccaaaataattattaatgataagccattattgagatggtagccaaagaagtttcccaaaacttttattctttttgccttgatatccacctaaacctgtgtagcctacaaataaaaaactcttttattattcaaagtgaaatttggtcaactgtttttgaagttagtttcctccccaaagaaactattattacacttttttgtcaacttttctataagtcattctaaacctaattgctttggcctcatgtgacattacgctgtatggggttgaacctttcattgcccaaatacaaacatttcaccagagagcttgggcttgccccatcacaagaaacacatgctgtacttctcccggggccacagaatcagacttgggcctaaaatagccaaagtggtgactaagattcatttggacagggccaagctgtcaaaacagagaggggtcatgtggatttaccacatccccttgcagggctatttaaagttttaagacccaccaaacaacctagaactaggaacatcagcagggtcattagtgaatgtgtttggcttctgataaggctgtattcttttgagtagttcagccaccttgttaaaacatgttacacctaccatcctcaaggaactaattcccattctgcctcttcagtggacttctagaacagagattgcaacttccttggctttcagagtccaccacacactttattttcacacaactaggtgctcatcctacccagacactattcttaacctcctcagtggtgggtgacagtttaatttgtaatgactcccttggaagtgattaaaagggagttcacagaaagcggtagaaaattacttttgtggccaggcacagtgtttcacacctgtaatcctagtacatttggaggccaaggcgggcaaatcgcttgagctcaggagttcaagaccagcctgggcaacatggtgaaaccccgtctctacaaaatatacaaaaattaaccaagtgtggtggctgtgcatgcctgtaatcccagctattgggggcctgaggcaagaggatcacttgagcctgggaggcggaggttgcagtgagccaagatcacgccactgcactccagcctgggtgacaaagtgagaccttgtctcaaaaaaaaaaagagaaaaaagaaagaaagaaaattactttggtaacttagtcatgatggaatgatggaaaatgtattttccccattttggttaccacatgtttcatgtgtcgagttttttcctcctaattcatactaagctctggaattgtaatacttcattaaaaaaaaataaaaaaaaagaatcctctagataacaatactttctttaataaactacatcgttctgagcacagaactgaatatgaggacattttctcaaactgaatattaggatacatgagacagactgcatgatctccaggctgtgtggaaaatctgtgctctgtggtctggggcttttgagggggcacacctgtactctaaccctggctgtcatctactgaaggaggtactgaggaaagtggtaactgttgttatctgaggatgtctatccagagaagagactcaggagggaatgtattctgaagtcatccctattgcttcttcaattatttctacccctagaaagcaaattccccacagtgaagtgtgttgaagaaattctatacaaatagaagcaatattctatgtttgggtaagtttattgcagtccatttaagaaatggtgagtcgagtccacgtgattcagttaagaggataaaatcatttatttcctatatatacagaaagcaaggatttctaataactttctacagtttttctttattattattattatttttttttttttttttgagagagtcttactccatcacccaggcttagagtgcagtggcgcaatctcggctcactgcagcctccgcctcccaggttcaagtgattatcctgcctcagcctcccaagtagctgggactacaggcaccaccacatccagctaatttttgtatttttagtagagacgggatttcaccatgttggccaggctggctttgtactcctgacctcaagtgatccgcccgcctcggcctcccaaagtgctgggattacaggcataagccaccgcgcccagcctttattaattttgcaaattgcaaaagtattctctgacttactgattggtcacttgtgttcctgaactgtgcataactacgaaaggtttgtttaggagtgccattttctaatactgtataaagctgtactatccagtacagtagtaaatagccatatgtaactgtttacatttcaattttaataaattaatattaaataaaaagtaaaatttggttgctctgttgcgctagcacctttcaaatgctcaataccacgtgtgactgatggctactgtattagacagcacaggtttagaaaatttccttcatcacagatagttctattgtatggtattgctatagagtcttggtaactgcagagtaatgcttatacataagcagcactttttgataggtcaaccaggaagctataatagatattttttggcaattttctttctgttagttcaacaaaaactaacttaaagatttatcaaagacctttgtaccgtaatgaaacccagcatttacatacagtcctctctgtagtaagggtttgtacaaaggcagtaaattgagatagcagtcgttgtgggcttcagctaatcagagcattaaatctggtatccaaaaggtaacctttgagcctgagcaacataaggagaccccggctctacaaaaataaaaaatttgccgggtgtggttgcacacgcctgtggtcccagctacttggaaggctgaggtgggaggatcacttgagcctgggaggtcaaggctgcagtgagctgtgatcacaccactgcactccagcctgagtgacagagtaagactctgtctcaaaaataagcggggtggggaccttaattctaaaaactgaaaacttattctggtatgagcagttccgcaaatattctggtatgaacagttccacaaataataagtgaagtgattttgatcttacatattgattttacaaatcaattaatttgtgattttttttaagaaatacatatataggccaggcacggtggctcacgcctataatcccagcactttgagaggctgaggcgggcggatcacctgaggtcaggagttcgagaccagcctgaccaacatggagaaacgccatctctactaaaaaaaatacaaaattagctgggcatggtggcacatgtttgtaatcccagctactcgggaggctgaggcaggagaattgcttgaacctgggaggcggaggttgcagtgagccaaggttgcaccattgcactccagcctgggcaacaagagcgaaattctatctcaaaacaaaaaaagaaaagaaatacatatatagatatatgttgttttttcttttttaattgagacagggtctcactctgttgcccaggctggtctcaaactcctggactgaagcaatcctcccaccttggcctcccaaagtgctgggattacaagtgtgagccaccatgtcccaccagtttatgattctgaaatgtagaatatattacttcctgttgggcaatagattttgaaaattatgtacatttaagaccatctctataaaatacttttacatagacccaaaagaatttctaagatatctattctgtgcaattactcttaaatataactatatctagtacacttacaagtctcatttttcattttctctagagaaaatactgcagcctcttttagtcatatatcctgactgaaaattatgaaattaaaggttttagacctatgtttaggttatgtttgagtattatatatgtataggctatgctgactaaactgaatgataactctggttttggctatatggagacatatcaaaagttctgatttaattaatcatctcacctaattatcatctaggacctaattattaagtataatcaacccaaattctttaacatctctaccttgaaatgattttcttgacttttggtcatctctgttcagcctcaacctctccaaattctccaccctttttagggcttttgagttcagtcgtctgaattctaataggatgattatctttcaaatttctttgtcacactcctattggtatgttctggtgatacactttctcccctcagtatatttccctgttcactcaggaatatgactatatattaccttgttatttaggtacaaagccaattattctatatctgatacttgtatattttgtatttagatgttttaaaatgtaccctcctgccatgactgtgtattgccttgttatttaggtacaaaaccaattattttatatccaatacttgtgtattttgtatttaaggtttaaaaatgtacccttctgccattgtgcctatcaaacttcatgatgcgtgtttctgagctcaggaaataccaaaaagggagtattcggtttttggtttttgtcttcaagtcagcaatacatctttgttcagctcttgtgttcctcaataactttgttccctccttaagtgcattcagtagttaaacttagcagaaatctgacctaaccattttcttgttttccacttccttaaatgccacacagaatcatctagccagaagcataccattttgatgtttgacatattgacatttcaagaaaactataattatgattaagaattatttctagttcttaactacaaattaaaaacttgtggtgctctttttctctgaatttataatctgccttctcctttctaggttaatttgcttgatagaaaattacaactttaatattatttatcttaacagattgtgaatagtctaattaactcaaaagtattatgtttcgcccttaaaagatactaaattataccttctaaattaaagcaggtagaaaacttctttgtcaagggtttaataaaccagaaagtttgaagaactacttgtataaaatctgattttttaattgttgtattacattattgctatcgatgagcaatattacattattagcaatcagtagcaataatgtaatacaggggttggcaaactatgacctgggggtcaaatccaacccactgcctattcttgtatataaagttttattagaacatagcaaagtacattaatttgcatattgtccatggctgctttcacactacagtggtagaactgagtagttgcaaaagagatcatatgacctttagagcctaaaatacttactgtctgattatttacagaaaaaaaattgctgacccctagtatagtagaaatccttgaactggggagagtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattatttaaaaaaaaaacaaactacgtaaacaaaactgctagtcataagacagataaatttaaagcatactactattgtttcaaaagcatttgcatctcagggctcttttagatactgttttcctagtagtataggtatttattacagatctttgacaatagtagcaagaacaggccttgaagcgtataactaacatcttaagaaatacagttgtacttcatttggaaataaaaataaagcatctctaaaagcctagtttccgtgtgtgggaaacgtgatttgatatataaaaattccattcccacccagcttttaggaaacatgtataatacgtaaagtaaaataagtttttataaaaagaagaactcaacattcactactgttttttcaacatggtaactataattctgcataagaacctttcatgcgtaactttagactttcagaaatctcaaaagttacctggaatgttaacatcaatatcacttctctctttttgcccttccctttctacagtaagtaaactttgtggaaatatattttattaatgttttctggccaggcgcagtggctcacaccagtaatcccagcactttgggaggccgaggtgggtggatcacttgagcgcaggagttcaggaccagcctgggcaacatggtgaaaccccatctctacaaaaaaatacaaaagttagccaggcatggtggcacacgcctgtagtcccagctacttgggagactgagatgggaggatcacttgagcctgagaggttgagactgcaaagagccgagattgtgccattgcactccagcctgggcaacagagcgagaccctgtctcaaaaaaataataataatgttctcatattagcagatacctaaacacaaacaagttttatctttccagaaaaattcaagagttaatatttaaaatttagacttagactacttaggtgatttgataaactaactaaatgagtgattctacatagaccagcaaaaggctgtgctcatgttctagatctttattagtagagttagtaatgatatgcacttacagaatgctttacaatttgcaaagcactttcattaatacattatgacttttgccaatcctgtaagataagtccattttaatattctttttttttcttttttgagacggagtttcacttttgttgcccaggctggagtgcaatggcacgatctcggctcaccgcaacctctgcctcccgggttcaagcaattctcctgcctcagcctcccaagtagctgaaattacaggcatgcgccaccatgccgggctaattttctgtatttttagtagagacggggtttctccgtgttggtcaggctgatctcaaactcccgacctcaggtgttccacccgcctcggcctcccaaagtgctgggattgcaggcgtgagccaccgcgtccagcccgttttcatattcttactttacagataagaaagcctagagaggttaaatgatttactcccaaataccacatgttctcccttataagtgggaactaagctatgggtacacagaggcatgcagagtagtataatggacactagagactcagaataggggagggtggaggggcaagggatagaaaatcacctgttgggtacactgtacactactcagaagacagattcactaaaagcccacacttcactactgtaccatttatccatgtaaccaaaaaccacttgtacccctaaagctgtttaaataaaaaataaaataaatatgatttactgaagcagtaactcccaacatttttccactctacagtcctaagggatgtcatgcactcaaatggcagtgatttccaactaggaataaggggaggctatgcatatagcttaaaagagtcatatgtagttgattctgttgtgtggcctgatggagaattactatacaaaagtaagacattgtcattgttaaaacaaaaagagggaaaaaagattttaaaaagaaaaatgacacataatcctaccacccagagataattaataacattctggtgtatatgcagtcttttatatccatattaacttttttacccaaaaatgagattataatatacattgattttaaacctttttcatgtaattaatcacagacatcttttcattccactaaacacccttctacaacatcattttataataactgcagaatattccatcctgtgttacatgtttgaattcaagatgtaagtggtttcatatacttctacaattcccgattagtgttattctggtatatgcatatgtaatttatttcaaggaatctgaaataatttaaaaactacctctcttctagccatcatctcctatatatttgacttaatggataatccttaagataaataatttgttaaataacttatttatatttgtgtatttgttttaataatctattttttcatctctttgttttagggtgcagtactagccgctgtgtcaagtcacaaattcaactcattctatggggatccccctgaagagttaccagatttctccgaagaccctacctcctcaggtaattggataattcacttattcacctgtgtgggtcatttggcatttacatccattctctcccattgtgaataaacttttcctgtgcatttagttaaatcctccaacggattctaaggaagtttgtcagcaaccaaatcctgtctacatgtgtcttgttccttttcattttaataccaaagttgctttctcctgtggctccaaaaccaacacttcatttttttttcttttcacctcagtaatacttcttcccctttccacactctagacccagcattgcactccatccaatccaacatcctagtcagtcttttgggatctttctgattaccttctctctcaacaaaaacttctaatataagcttttccccaggtcagtcgtattagatcagactgtgggcagcactgctttgaatggaatctttcagtgtagagctgtcttgtgagttatctcctgaaacagttaccaagttcttctttctgtataaaaatctataacacggccaggcatggtggctcatgcctgtaatcccagcactttgggaggccaaggcaggcagatcacctcaggtcaggagttcgagaccagcctggccaacatggcaaaaccccatctctgcaaaaacacaaaaatacaaaaaaaaaaaaaaaaaaaaaaaaaagccaggcgtgctggcctgcgcctgtagtcccagctacttgggaggctgaggcaggagaatcacttgacccgggaggcggaggttgcagtgatccgagatcatgccactgcactccagcctgggcgataatgcgagactccatctcaaaaaaagaaaaaaaaaatctgtaacacatgcatacaagtatccaaaggggaagaacacagaagagttatttgttttgatgaactgtatataagtacccctgaaacaacctgccagtgttcacaaaatcattttataagccagtgcagtggtgtgcatgtgtagtcatagctactcaggaggctgaggcacccggctcagggggatcacctgagctcaggagtttgaggatgcagtgagctgtgatcacaccactgctctccaacctggacaacaaaatgagacctcgcctcttaaaaattaagagataaaaggccaggcacagtggctcacgcctgtaatcccagcactttgggaggccgaggcgggcagatgatgaggtcaggagatcaagaccatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgctgacttggtcattatccagagcccttcccacatgaaaggcagggatctagttgtgtttataggtgtggtccccagtgcttcttattgtttcacgtctgtcttttcttccactccattttgttccctccacctgtaacttcttttgttagctgaaacctctgtcttctctcctcacactcagattacagtggaccctatttaaggggagtggatccagtaatggtttgtattgtcatactgtggctgtatgatataatcacatgcttataatatatttaggataaatctctttgagattttaggtcaagatctctactaccattttcatctttagaaatggagctaaaggctgggcatggtggctcatgcctgtaatcccaacagtttcagaagccaaggcaggaggattgcttgagcctaagagtttgtgaccagcctgggcaacatagggagaccctctactttgtaagaagtcaaaatattagccaagcgtggtagcacacacctgtggtcccagctactagggaggctgaggcaggaggatcacttgagcccaagaggtcaaggctgcagtaagccgtgagtgcatcactgtactcaaaactggatgacagaacaaaactctgtctcaaaaaaaagaaaaggggccaggcacagtggctcatgcctgtaatcccagcactttgggaggccgaggtgggtggatcacttgaggtcaggagtttgagaccagcctggccaacatggtgaaacccccatctctactaaaaatacaaaaattagccaggcatgatggccacgcgcctgtaatccacctgaggcaagagaattgcttgaacccaggacacggaggttgcaatgagccgagatcgtgccactgcactccagcctgggtgacagagcaagactccatctcaaaaacaaaaggaaaggaaaataaaaagagtaatactctatgcatttaggaaaatatgaatatttaaaataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctcaaaaaaaaaaaaaaaaaatcaatgttgaaatattcttttctcatatttcaaatcaagtaattcagaatcagaacccaacgtttgatgtctgaaatcccaaacagttccagtgattgtactcatggaacatgagggctcactttggggtcagctgggggaccatgcttctggtggctcatgtagtgggccgaactgtggcttgataacctgcttgttctaaaatcatactgtttgttgtttgtccatatgctgccttcctcctaggacttctagcagcagaaagtaggtatccctttgttttcctttaaggtgtatcttttatgcaaaagtgtttggctttgcatggttcgtaatcagcttgactttttccttggctgtttgtgtgtagttgtttaagtattaattttaacactgcctggtcataaaattaaaacttggatatattgatttttgaggcattgttgcacaaacaatattaagttctcacttctttcataagaggaaaaaagacagtgttaaaatttcaacggcatttaatacttcacatctgaatttcacatacgaatacattaattctggggaaagagtaacatttattttagagtttgctttcaagaaaactttcagggtaagtgaatttttctttgacaattacatcacctgtaagtggtctttattgcttcctgttactgagtccattttcagtttatttggacctgtgaaataaattctgaaatcatatctcttaacaacttttaccatcagatagaacatttataaggaataatgtaatagctagattttaattacaaaggggcataatttgagtttgggagaaaattaaaatgtaagaaatgtacacacagttgagtacatgtaaaactgaggcaatctgaataagatgggtggattgtatcaatgtcagtattctggttatgataatatactatcgttttgtaaaatgttaccaatgggggaactgagcaaagaatacaagggatctctctgtattatttcttacaagtgcatgtgaatctacaattatctcaataaaaattctaattaaaaaaataaacctttacctcaaagataaatgagaaagcctgggtactaatgattgaattcattttcacattttcttacattagttatctgtagctcaaattgcagctgatttaatataaatcttatagtatattagttacctattgttgggtaatgaattaccttaaaacagcagttgtcatctcacagttcctgtgggtcaggaatctgggcgtggcttagctgtgtgcctctggctcaagatctctcatgagattgtggtccagtgctgctatctcaccggaaggcacaactgcaggaggaatcctcttccaagctcactcacatggttgttgccaggcttcggttccttactggctgtggtcctcttcacagggctggctgttcacagcatggcagctcacttcccagcacgaaagataaaagaggggggcaaaagtgagagacagtgcccaagactgaagacacagtctttacagcctaatctcatagtgacgtcttatcacttctgcactattctgttcattagaaatgagtcagtaagtccagcctgcactccaggggaggggactgattacacaaggctggaaataccaggagaccaggttactggggcccatcttagaggctgcccaccacgtacaaattaataactattaaaatgtaagattcttcccgtctagatttagcgctcctcttttttttttttttaaatcagccaacctgtcatgttatttgagaatgggcatcttggatgtatcagtagtgattttccttagttgtaaagctttacacgagtgggtacttaatagcagaatgttattaaagtactttgaaaaatctgtgctcgaagatgtttctatatggaagcataaactattttaataatcataatggcattagagattataacatctatacgctgacagaatacatatgcagagtttacttcctttaataaatttcaaggtatctgtaccataatccacatatggagaatctaaagcatgtatcaccatatgtaagttctcataacttgagttggatatggcacagatgcttatgtccaaaatacagtttccattacaggattcattattgcttataacttgattgataacaaagaatttgctttgtgcagtgggaataaaaagtgttgaacagggtgtggtgatagagggaagagattggctgcaaagggacaagagagaacttttttgaagtgatgacagtgtacacttaaatggcgacttttaacttaaaacagtataccttagtaagcagattttttttaaaaagtattgtgcttgcaaggaggggctttgattgagtaggtgataatgtgtgtgtgtagtaatacaatgtattaattgatcgctaatataatagaaaaggtattgattactcttagaagaagctaggctaggttcagattctagatttgctcagtgatgctgagtttcatagctatacattgtaaattaagaaatacacacacattgagaatttaatgtgttattttgtgaaaatctgagaagcaggaatgggatttaatgatctcaactgtcatccatctgaaaaacctaacttgtgattttaaataagatggcatactgccttccactattcccttttaaaaacaggaaatgtccctgcttttatctttatgaagttttatttatgaataaagtttgtactatttaaaaaaaaaagaaatacacaaatctttattgaaacaattacagtgaaaacttgggtatatcaaaactcattgaatggtacacttaagatttgtgtatttcattctatgtaaattttacctcagagagaaaaataagcattgcaatctttgctgaagtctttaagggtgaagtgtactaatgctggccactgccatttaatttgaaatgaatgaaaaatacgtgaactgatggatagatgggtagacatgtgataaagcaaatacagcaaactgtcaacatatgtaggatctaggtggtgggcacgattctttcaaactttctgtatgtttgaagcttttcgtagtaaaatgtaaggggaaaaacttttaagacatactcagcctactttaacactgagaactttttagtctaaacatttgactgtttatttttctgtcctccttttggtttatttttacttggtcaacctttttatgagacttccactctcgtaatgagattattctagactcaaagcttttattgaccttaaaagcatatttctctttaaagaaatagaaacattttttaaacagttgacatatttatgctttttttgactattatttcataatagtagcagaaaacttttgaaaaacttgtttgtactggtgagattatttgaaaaagtagaagtattcaaagttaaaatgtgcaggccagtcatggtggctcatgccttgccagcactttgagaggctggggtgggaggattgcttgaggccaggagattgagatcagcctgcacaacatagtgagatcccatctctatttaaaaaaaaaaaaagtatgattataaacctgatttttagatacaaactttattgccaaatgaattatgaaaacaaaatactattctgaaggcagggcattatagtatctaataagttcatgaatgtggaagtttggaccaagggctaggaaaaaaccttatatggtaaatcaaattgagattaaagagagaacagaaattaggcatcacgcctgtaatcccagcactttgggaggccaaggcgggtggatcacgaggtcaggagtttgagaccatcctggctaacacggtgaaaccccctctctactaaaaatacaaaaaaaaaattagccaggtgtggtggcgggtgcccgtagtcccagctactcgggaggctgaggcaggagaatggcatgaacccaggaggcggagcttgcagtgagccgagatcacaccaccgccctccagcctgggcgacagagtgagactctgtctcaaaaaaaaaaaaaaaaaaagaaattggacatcacctcattaccaaatgcaaatcattctgatgcattgctgaggataaaacatgattttgtgggtgggggacagtctattatggaaggaacactgaattaggagtgagacctgggttctaggatttgatcttctgcttattgcctgtggcccttggaaaggttatttaaccctactgagcctctggtttttcaaatataaaaacacttgctgaccaagcatggtggctcaatgcctataatcccagcactttgggaggctgaggcgggaggattgcttgagcccaggaatttgagaatagcctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctactttaaatgcctgctaacagatgcctttgtgctttccagcaaagtatctgctggtcctgtcaacacagctttgatcctgtgtgggggtggtgaattcctgctcatccacctctctgcggctccccaactcctccctaggcagcctgtgtgtcagtttgtttttacctcttctataccgtttacttcagggtataatatgcctacttcacacaccagtctgagagccccttcctcagggccggtgatcatatctctgatttctctgaagcccttgcctagtacctagcaaaaagcaggaatattcaataaagattttggggccaggcgctgtggctcacgccagtaatcccaacactttgggaggcctaggcaggcggatcactcgaggtcaggagttcaagaccagcctggccaacatggtgaaaccccgtctctactaaaaacacaaaaaattagctgggtgtggtggtgtgtgcctgtaatcccagctacttggaaggctgaagcaggagaattgcttgaacccaggaggcggaggttgcagtgagctgaaatcatgccactgtatgccagcctgggcaactgagtgaaactctgtctcaggaaaaaaaaaaaaaaaagattttggttattgtctgacccaatagggcattgttcaagttcttttccaacctccatattcatgcataaaccacacaacttcttgttgaaggtttcctgtatgtttcctagcatagcctattagtgtagtaagttaggcaaaacatagactttgaagccaaacaaacccaggattgagtcctggctccaccatttactagttatgcccttccatgaaccttctgaagctcagttccctatctagaaggtgggataatatatctgccttactgtgttgtcctgaggatgttcctggaacataataaacactcaagaattgggagctgctgttagtgtttccttaagtacttaattcagtgcatactttgtagatattataaaatgaataaaataaagagctgccttaaggaccttacagctaagggaaaaaaagagtgaacaagcacgcacataagtaactcatggagtgcgctggtggtacaggaatggcatggagcacttgggaagttcacagaccaacaaatgatacatccctggtctggtacagccaaaattgcttcctggtcttgagactgaccatcttagtattcacttgataaaaggttgtttttgctttaatcttatattattaataaactgctacataaactgtatatcagcatgagcaatgctggtaaaaggccgagcacagtggctcaggcctgtagtcccggcactttgggaggctgaggcaggcggatcacttgagcccaggagttcgagaccagcctggccgacatggtgaaaccccgtctctactaaaaatacaaaaattagctgggcgtggtaacctgtagtcccagctgcttgggtggctgaggcacgagaatcgcttgaacccaggaggcagaggttgcagtgagctgagatcatgccgttgtactccagtctgggtgacagagtgagactctgtctcaaaaaaaaagaaaaaaaaaactcagtaagatttcagtaagataactgagtgaagatgataattaggtttctgtggtatcagctgaattttttaatatacaaaaaaggcacttgattagtatttttgttattgtggtttcataagtccagaagtttagaactggctttagtaacttgataaacctagcatcatttaattctgttgttgatgacatgctggggtcaggggttcagtgggacatttgggactaatttcttcacatcatctcttgctttccaaggctttcagtaaaggatgaagagaaaattggcttttaactaatttccagattttttgatggaggggggggcactctgaacaaagtaaatcctgagaagatcaggtagaaggaagtggattgggttaatacctctttaggaataacagaggagatgaggactgatttctgccatttatctcttttatcccacttaatatccacttaatgttttcagtgaaaggataccaatagcctggcaggcataattcaaaatttaatattatccagccgggcatggtggctcacacctgtaatcccagcactttgggagctcaaggcagaaggatcgctttagctcaggagtccaagaccagcctgggcaacatgacaaaaccccatctctataaaaaatacaaaacttagatgggtgtagtggtcccagctactctgggggctgaggtgggaggatcacttgagcacaggaggtcgaggttgcagtgagccgagattgtgccactgcactccaacctgggcaacagagcaagaccctgcctcagaaaaaaaaattatccaggccaggcgcagtggctcacgcctgtaatcccagcactttgggaggccaaggcgggcagatcacgaggttaggagtttgagaccaacctgaccaacatggtgaaaccccgtctctactaaaaatacaaaattagctgggcgtgttggcacgcacctgtaatccccgctactcaggatgctgaggcaggagaatcgcttgaacctgggaggcagaggttacagtgagccaagatcatgccactacactccagcctgggcaacagaacgagactctatctcaaaaaaaaaaaaaaaaattatccatagttccttcaacagacgaatggtcaaacaaactggtacatccacacaacaacctggatgaagccccagataattatgctaagtgaaaaaatgcagtcccaaaaggttacatactgtatgatttcatttattctttttattttattttattttattttttaatttttagagggactcctccttgcagaccagggctaccccataggcagtatgcccagaataggagcctcatttattatcaaaatgacaaaattgtagaaatggagaacagatgagtagttgccacaggttaggaggggatagggtaggaggggaatgagcatggctataaaaaggcagtatgagggatccttgtggtaatggaatgttttatagctcgactgtatcaatgtcaatatccaggttgtgatattgtactacagttttgcaagatgttactattggaggaaactgggtaaagggcacatgagacctttatgttattttcttttacaactgcatgtgaatctacaattatctcaaaataaaaagtcaaattttaaaaaatagctacagtaatttccacgtggacagccacacagtatgtggcttaagacccaaatctttaacataattaaatagagctacaaaaatcagtagcttatatagcattttgttttgttttgctattgtagaaaaacttggaaagtatggataagaacagaatgaaatagaaataggacagtaaagataacaactgtaacacttttgctgtgtttcattctgttttttgtttttccggagtttgcatatatgttttgtttggttttttatcgtaactgggaatatacagtttatttagttttgcattctgctttcttgaattcttttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcctgttctcaatgagctgttgggtacacctcccagacggggtggtggccgggcagaggggctcctcacttcccagtaggggcggccgggcagaggcgcccctcacctcccagacggggcagctggccaggcggggggctgacccccccacctccctcccggacggggcggctggccaggcagaggggctcctcacttcccagtaggggcggccaggcagaggcgcccctcacctcccggatggggcggctggccgggcggggggctgacccccccacctccctcccggacggggcggctggccaggcagaggggctcctcacttcccagtaggggcggccaggcagaggcgcccctcagcttccagacggggcggctggccgggcggggggttgacccccccccacctccctcccggacggggtggctggccgggcggggagctgacccccccacctccctcccggacggggcggctggccgggcgggggtctgacccccccacctccctcccggacggggcggctggccgggcagaggggctcctcacttcccagtaggggcggctgggcagaggcgcccctcacctcccggacggggcggctggccgggcggggggctgacccccacctccttcccggacggggtggctgccgggcggagacgctcctcacttcccagatggggtggctgccgggcggaggggctcctcacttctcagacggggcggctgccgggcggaggggctcctcacttctcagacggggcggttgccgggcggagggtctcctcacttctcagacggggcggctgggcagagacgctcctcacctcccagacggggcggcggggcagaggcgctccccacatctcagacgatgggcggccaggcagagacgctcctcacttcctagatgggatggcggcggggcagagatgctcctcactttccagactgggcaagccaggcagaggggctcctcacgtcccagacgatgggcagccaggcagagacgctcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccatctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctaaggcaggagaatcaggcagggaggttgcagtgagccgagttggcagcagtacagtccagcttcggctcggcatcagagggagaccgtggaaagagagggagagggagaccgtggggagagggagagggagagagagagggagagggagagagagagggagagggagagagagagggagagggagagagagagggagagggagagggagagggagagctgctttcttgaattctatatcatgaagatttctctgtgtctttgaaattcttcaaaaacaattttcatttggctacatattccattatatggatattctataacctacgtaatcatcctctattagatttattttccattttgtatgataatatcattatatataaatcttccatttttttccttaaggtgggtttttgtaaatggaattactaaatcgaagtgcatgaacatttttaaggctttttgatatatgttaccagattgctttctggaaaagtggtactgatatatattctcaccaataattgcatgagaatggataaggtctaagtcaggaagaattagaaacagagttctggagcataaagatttttatctttatcaaaaatataatttctcaaccacagcactactgacattttgggccagataattctttgttgtgggggctgtcctgggtattgtaggatgtttagcagcatccctgacctctacccactagatagcaatagctgccctcccgctgtagttgtaacaaccaaaaatatctctaaacattgggaaatgtccacctgggtaacaaaattgcccctggttgagaaccactgatccaaagacttaaatgtgcaatgagacacttattcttagagtttctctactgtgtactaatgttctgaagcttagctccttggagctctttttttgtggagtatatatgtgtattctgcatattgcctgcaatgtaaaagaggctgatcttttttttaaggctgtgtaaatggctttgttactcctcattgtgtatctttccctactgacatctgcctggtttcctggttatgagaagaaacttaaagtgatggcacttccatttgctttgccctacaaaaatgatttgccttgaaatttaatatggtatttggaagtgtcagtcagcgtccctatactttgtctttatcttctgagtaagaagggtaagagtaaaacagaatgagaatgactttggatctcttgagtctgtatgtaaaggaaaaaaaaaggagtggactgggatttttgttaactaaagttcaagtcttaaaaactaagaagcctattttaagcagcaggagttcccagttgaaggtctgttccctgtatctacagctggctttaccttcagttcttgatggaatgcacctgggtaaaaggccaacctcgtttctataatatttcagaacatcttggagtcctgaaacccatactctcttcctgacataaaacttgctgtgtccagatcttctagtgcttaggttatacttgataaatttcattaattcaaagaagataagctgcagtttcctctgaaaaatgaagagcacacaaatacattaataagaacatgaactctctgaaaatactgtgtccttaaattatatgaaactcatttaagtctatccttcagtaaagacactagcctttgaagttctgatatgaattcattgttcttaagtgtaagatttaggtttaaaaagttagtttgacattgactttctatactggctgtttcttttctgtttgtcccccttaggagcagtctcacaggtgctggacagcctggaagagattcatgcgcttacagactgcagtgaaaaggacctagattttctacacagtgttttccaggatcagcatcttcacacactactagatgtaagtctgtctttttattattcttcttttttggtgaattgaatattggccgggcacggtggctcatgcctgtagtccaagcactttgggaggcagaggcgggcgtatcaggaggtcaggagactgagaccatcctggccaacatggtgaaacgtggtctctactaaaaatacaaaaattagccaggtgtggtggcgcatgcctgtagtcccagttaggactgagctgaggaggcggaggcacaagaatcacttgaacccgggaggcggaggctgcactgagccaagatcacaccactgcactccagcctgggtgacaaagcaagactctgtctcaaaaaaaaaaaaaaagaaattgaatatttagcatacctttttactttacatgaattctcagatgtctatcataacaattcttttcagttgccttaagcctatgagaaatgtgggaaatcatccatcaaaaattcatgattgaaatacagtatatggccgggcaccgtggctcatgcctgtaatcccagcactttgggaggccaaggcgggtggatcacctgaggtcaggagttcgagaccagcctgaccaacatggggaaaccccatctctactaaaaatacaaaattagccagttgtggtggtgcatgcctgtaatcctggctactcgggaggctgaggcaggagaatcgcttgaacccaggaggcagaggttgcagtgagccgagatcgctccattgcactccagcctgggcaacaagagcgaaactccatctcaaaaacaaagaaaaaagaaatacagtatatgtacagtacaaatgcaacagagcctagcaggctacaatgggaaaaaatttatatatctttatatttataaattatatgtacataatgcatgcaagtggtatgtgagttttaaaaaagagtagagtacaatcctactttactgaattatcttgtatttctgttaaaagaatccattgaggttagctgtgattactttttattgctttgcacattactttaaaacattatacctccagcatgagtataggagagagaaaagcaaatgagatactttgcaataggctgtattcccacacacatttcatatttaacattgttttgttccatagattcaatgtcttctccttaaaacataagcatatactccatctttaaatattacaggctccactgacagcagactgggatacaaaggaaaaaacagaagctgaccattttcatttcagtcacattttaagtaaaatacctttcttagagaacttggttcacttcagcaatgaaaactcttgggtggtttcgatggtatttgaacatgttagtctttttacaagaaaaatcttcccttaatgagagaatcatacttgctttggggtgcctagaactgtttggtgctgaataattcaccatatgatgtaaatgaagctaaagcaaaatttcccagaatgtgttctacagagcatggctctgggaggttgctatgggtgttgccatggtgggagggggaagtagatcttaaatttattggttaaattatttattgactaaataagtttgggaaatgctacattctttagtctttttatacagatccacaatgggtgttggtatattgatagctctgagatgatctaaagcaaagaaacctttttaactttctttatcagcatttctcaaactaatttgggcacagaacttttattcacaatcctgttgagttctgttttgatgaggaccagtttgggaaaagctcagctaagagtgtttgttgcattatgcttcagctttacactaaatgcagccgtaggtatctaacagttgcttctttccccaaatgtggtcagttcaaattaattatcagattttcatggctagtttggcctttgtatatagtgtacatattaattagggctgactaactgttataacatgtgattctaaaatttgagtggcttaacagaatagaagtttacttcttgctcacttcacagtccaatgcaggtagatgagggaggtcttttccacaccgtcattcagagacccaggcctcttccactaggtcacactgctatttcccagggtcttggaatcttctactgtatcctttgtacctagccagcaaatgagagaagagagaacatggagaatcttgcagggtcaagcttggaaatgggtttatctcacattctttggcaactgctagtcacgtgctcacctggatgtgagagctgaggaacgtagtttagaaatgtgctcaggaagataaggaattgggtcttctctttagtgtaatttatcttaagtagtatctattcactgtcattgctgcagaaagttttcacaattgtgtatttcccactgaagtttataccctttactagaactagttagtgcaatatttagaaaaggctacagcagtgtgtggagattttgtttattttattgtggtcagtgcttaggtcattgccaggtagatttactgaccttcttttgaatcaaggactttttgtaacaaagactttttgtaatttaaacactgagagaagcccaaattggtttcaaagttgtattttttcttactgatatagcaaggtatctgagcacatcaagcttgagattgcaggggagaagcaggaacattactggcttacacaaggaaaggggcagctattcagacacgaataactgctgcactgtttggtataaattgtcacaatttcagaagagattcttagatgttagtgagaaaaacatacttaactttcctttgcatttgtttacattataaagaagtatctgccttattggcatctgccctgtcagtgcaggtcaatttgaaagaggagctgttggactgaaaatgaaccatgcctattaaaaaggtgcagtataagaccaggagtagtggctcacacctgtaatcccagcactttgggaggtcattgtgggaggatcacttgagcccaggagctcaagaccagcctgggcaacaaagcaagaccccatctctacaaaaaatttaaaaagcagctgggcatggtggtgtatgcctgtggtcccagctactccagaggctgaggctgaaggatcacctgagcccaggaattcaagggtgcagtgagccatgatcacactactgcactccaacctgggcaacaaagtgagactctatctctaaaaaaaaaaaaaaggtgcagtatcttctgaattttgtaaacaggtgccatacatgagctccagtcaaattaatgactatgaggccgagccctggacaatatttgcatgcatgtggttctgaatctccaaactgagctatttctaaatgaaagtttaggccaggtacggtgactcacgcctgtaatcccagcactttgggaggccaaggcgggcggattacctgaggtcaggagttcgagaccagcctgaccaacatggtgaaacccatctctactaaaaatacaaaaatgtggtgggcacccataatcccaggtacttaggaggctgaggcaggagaatcacttgaacccaggaggtggagattgcagtgagccgagatcgtgccactgcactctagcctggtcaacagagcgagactccgtctcaaaaatgaatgaatgaatgaatgaatgaatgaatgaatgaaagcttaatcatcatgaatgaaataaaccatcattagaatgtgccctcataccctacatcccataaataaggcttattaagctcatttcacagctaacaggctacattttaataatataatcaatgaagaattcaagtgactgccatatagagaaatctaatcatttaaaaaattttaatatttaaatgtttgtggtatacattaaggaagaaaaatggctatgacgaactcttgaggagcagctgttaaaatgttggattttcagtctgggtgcagtggctcacttctataatctcagcactttgggaggccgaggcgggaggatcacttgaggtcaggtgtttgagaccagcctggccaacatggtaaaaccctgtctttactaaaaatacaaaaattagctaggcatggtggcgcatgcctgtagtcccagctacttgggaggctgaggcaggaggatcacttgaacgcaggaggtggacgtagcagtgagctaagatcacaccactgcacggtagcctgggagacagagcaaaactctgtcaaaaaaaattgggcctttcatttttctttcttcccatgttccacataccatggttgatttggaattgttttattttgcagaatcaaaacgaattcttctgcctttttttgtttgttgtttgttttttgtttaagacagggctctcccaggctggctcactgtagccttgaccttctgagctcaagcaccctcctacctcaaccacccaagtatctggaccacaggtgcaccaccacactcagcccttttttttttttgaagagacaggtctcaccatgtttgcccaggctaccaggctagtctcaaactcttgggctcaagcagttctcctgcctcggcctcccaaagtgctgagattacaggcatgagtcattgccccagcatgaattcctttttaaggattccaagtagggacacccagggggcatagttttatggaccatgaattaattaaggctaattaatcccactgagccattttaggaaatatctttaccatttttatgttatttctgttaactcaataacattctaaatagctaggtatgaagccataattttaaggctgacaaaaagaaacaggattaagttcctaagaaaaactaaagattatctatgacttctttattttttctagtcatgttcttaaaataataacaagctcaaaatttgaagaagcattattagaatttgtttacaggaaacaaaactgccaaactgaaacatttacattaaaatggagaagtactgtgattctactgaaagggaaatgctttctgaaaacctttgaatttgagtaaaacacatttagtttaatctgtagttagaaactgatacagaaaactctaaatatttgctatccaagtggttccagcctggcacacatatgcagcttctcattttgtgggaagaaatacagaggcatgaggaactgcttggtccagcttgttgcagtatgcctgtatttaaaaattaaaagcactggtgctaagatgatcttcgtatgaaatgtatagatcaattagtaaagtacaatttgacattagtttgctaggactgccataacaaagtaccacaagttgtgtggcttaaaacaacagaaattgattgtctcatagttctggaggctggaaagtcctaaatcaaggcattggcaggggcatgctccctccaaaggatccagggaagaatccttccttgtcttttccagtttctggtggttgcctgcaatccttgtcattccttgacttgtagatgcatcattccagtctctttttccgtcatcacatgtcattctctgtgcgtgtgtgtctgtgtatttacatggccttcttagaaggacaccagtcattggacaccctaatctagtatgacatcatcttaattaattacatctataaagacacttatttccaaataaggtcacattctgaggttctgggtaaacataaattttgagtgagggacaatattcaccccagtacagcatggaaaactgatttaaccctgaattaattcttcacgtgtgagtgcaaattacacaaatctaatataaaataatgaaatgttaccctgtcatccattaattatgctttattgggaattggtgttaaagtgttatttatgtcttgtaatgatattttgaatcagttatggattggaatttgtatgtgatacattggaaggtcagtgggtgggtgagtttttgatggactgaaaagccatgttttttggattaaaaacattttacaaatattatttggtagtagttttcagtcttctcagtttctagtataaattttcctattaaaataataaatgtttagtttgtaaatcaccagtgttacaaaacattgttaaatgacacatctctctgccaaactttgacaactaagttttaaacattaactggccatctgtcatacctctgaacagctgttagcatttgttacgcactgctgtttccatagtaaatgcccccacctaattaagattatttttgtaagaagtcttaaaattgtggtttctgaaaatataatgggtgattagattaatatagcaatttattgatgaatttttaaaattgcagtagcaattaatttaggagtctttataatattaatttataagtagacttttataatagacttagtaacttttaaatattgcattagcaattaactgatacttggaatctttcatattttgtatggccaacatctttattataattttttaccgtttagggagagttagcatttttccatctggcctggagttagccatggaaaactacaattcttgatttactatttcgcttttttgagatgacattaaattagtagccatatttagaagagcttatttttagaactcagaagtttcctaaaggaaaaagatggaacttctacaataatctggagataatgtttttgagcaatttggggtctgagaagtaagttaaatacaatgttaggtttggatatttaaagagattgccaatcaggaaatgccaaagctaagtttcccaagaatttgtagtccagccaatttgcatttaaatgtctagaataataaagcctatctgaggaccttcagaggatgagctactagtaatttctcagggccccatccagtcttaagagtcagctttggcaattatgaaaccagctgcacagtgggcccctgcccagtggtggtggtctttgtgcttcttgcctcctggggctgtagactgaagcgcattgctgttccctttgaatttgagtgtctctccactgttttctaactggaggggcaaaacctcccatatctgtttctctccatgtattgaagtagtattgtcagtgtaaaagtacggcatgaaacaaaatacctgaaagctagaaataccatatgtcgtgaatattctcaaagtatttttccttctttcttaatgtaaataaatgtcaataaacttagcaaaaaaaaaaaaaaaaagccgctaagcatatggttctttgttaagcagcaatagaaaactgatagaaccaggaacaagatgaggattgtccactccccacttctattcaccattgtcccagagactctggccagtgcagctaagacaagaaaaagaaattcagggcatgaagattggaaaggaagaagtaatatcatcctttcccagagttgttatcttgcatgtagaaaatactaaggaatccacaaaaaatctaatagcattataggcaagcttagcaaggtcacaagataccagattaatatacacacattatctaaatttctatatgtgagcaaaaaataacccaaaaataaaattaaagaaatattcacaatattataaaaagaataaaataggaataaattgaacaaaaaaaatgtaggatttgtatactgaaaactaaaaaatgctatgaaagaaagatctaaataaatgagcagagatatactgttggattggaggacttaatattgttaagatggcgcttttctccacattgatctatagattcagtgcagtccctatcaacatcccagtaggatttctttgtagaagtcaacaaggtgatcctaaaatttatataaaaatgccaaaacaattttgaaaaagaaaaaaattggataactgatttcaaaacttactataaggctacaataatcaaaatagtatggtgttggcataaggatagatatacagatcactgaaacaaaaaagagtccagaaataaaccctcacctttatggtcaatttattttcaacaagattgccaatgcaattacatggaaagggggatagtctttttttttcaaatggtcctggagcagttggagatccatatgcaagaaatgaacttagaccctgtctcataccatacacaaaagaaaattgcctcaaaatggatcatagattcactttaagagcttaaaactataaaacttttaaaagaatataggaataaatcttcattaccttgggttaggcaaagagttcttagatgtgacacaagggaatttggggggattacggaaatgttcttaagctggattgagatggtggttgtacaactatataaatttactatcatcccactagatttcacagggccattacactaaattaaaatttagctttgtggctaagaatttaccactgattcaaaaatactaaatatggttttttctcccaagaactgttttattaaccagcgtgtagttgtgccttatggaagaagtccaaattgtgttttttgtttgaaaatgttatgaattacataactttatagattttcaatatggaagacaccttagagcaacttattttagttcattccttctacattcaagtacatatttgccatttccaaaaattcacagctttttgatacttttttaacatcaattttttggtcttttttgttgtggcaagatatatataacataaaatttgccacttgcaccatgtttaagtgtacagttcaatgacattaagtatattcacattgttatacaaccatcatcactatccatctccagaactctttcatctttcccaactaaatgtctgtacccattaaatactgactcccattcacccctctccttagcccctggcaaccacccttctactttctgtccctatgaatttgactactctaggtaccacgtatataagtgaaattatccagtatttgcccttttgtgtctggcttatttcatttagcatgatatcttcaaggttcatccatgttgtagcatgtgttagaattttcttcctttttaaggctgaataatattccatcgtgtgtgtatagtacattttgtttgtctactcatccaatattgatgttttgtggttgataattatgtactaggaaaaaccaaattctcagaataaggctgtctaatcgtagggaattctgcctcgttccatctccacacaattactctttctaggatgcaagttaaatcttatgctatacatcttcgtgaaggaatgtgtgatttccactgaaagtattaatgactacggaagtccctccaattcccttatttgttcagataaattacttcttaaagcagggtttagaatttactctagaataccaagaataatgaatcagcttgtcaccagtatcagtgttacccactgagtgccattctctttttatgacaccatgatcaactttaccaaaaggcaaaggaatttgcagaaagccttctaagtacaataagcactgattcttctttatgctatgctcaaggaaaggaggggtttccccctagaaaggaatgtgatatgctcagttaaagaatgttcgatggagtggcttgcagcattcataatccaagaacatagctgttttcttctctttgtggcccttcaaacatgatctcataaaactcttctgccagactgcctttgtgctattctctttaaatttttcatgacagaaattcatttttgctacagctacaccaagtacaaatgcttggtgtttacctatgcaaaataaaaaaggtagcaaaagccaaaaataattaaataaaatattatctgacacacctaatgtaacataaatgttaccttttaaagcagcacattaataattgtatgttcatttaatgtaaatatcatttaactcttgtagttgcttaagaagagccaagctaggaaatgtgattttaacactttaaaaaaatagaaaggaaattaatatcatagtgaaaatttctcatagttgggcaagctcttgtatctgatactaaaaagtaccgtatttcagaagattttattaaaacaagataaaatctgcctatattatatcatgtaactggtttttttcctcatgctttcttttgctcaagaataggcattatgatttgtgttttacagggcttaattttagagttatttgaccacttgaaaaaggcatagagaacagtcaagctaggtcatctgaggccagtgtttgagtttctcagaaatagctgccaactgaccagaaatctgccacactggcctatgttgttaggccaccaaaggcacagtcttcttggattgaactaggaggtcaagcaagtcttaatttcttgaattcaaaaataaatccctgtaagtgcgatgttctaataggattagaacaaaagcagccctgtatacagacaaataaaacctaaacaaaacaagggcctccttagaggttcttttgctgtcaggatccaaaggatttttgcagctttttcaggaaatcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactccatcctaggcaacacagcaagaccccgtctcaaaaaaaagaaaaaagaaaaaaacttcttcctagtgtttaattgtagctccttaagtttttgaaaatgccattttaaattttgcaatgtttctttcacacttacgttgcccatcatgcaatctttaggccactgctaaatacactgctcttctccaagcttgaactacatgatgtttaatgatgccaaggatctttgaaaggactctgtgtgtgtgtgtgtgtgtgtgtgtgtgtcagggcctcagtctgtcactccggctggagtgcggtcatgcaatcatagcacattgcaacttcgaccttccaggctcaggcaatcctcccacctcagcccttcaagtagctgggattacaggagtgcgccaccacacctggctaatttttgtattttttgtagagacgaggtttccacatgtggcccaggctggtctcaaacacctagcctcaagcagtctgcccaccttggcctcccaaggtgctgggatgacagatgcaagccactgcacctggcctcaacaagtttatatgtaaacttgagcaagaaaaatagatttttagatcttacaaagttttctgtgatctccaacttcagaaaatcagttccagtacagtaattgaatatcagttctctgtgtttcagtattaaatcagctttccctaatattttgctcaatttcaaatgtatatgagaaaatacctgttatgtattgatggctgatctgctcagttcactgaaaagatgtgacattgaaactttgttcctatttacccacgtaattcacagaaactgaagaaagttcttaataagatagtcagtgtttccagaacaagttatttcaatggtcattattgctacacagtgtaattccgtgcacactgttattatctgttttattaggatcatcacagacacattcattaaatattttgcagctaaatatttgattcttgcaaactttcattcttttccagcaggaaacttcttcagtatctataaagtaagtgataagatgatggttgctaatgaacatcaatgttctttgcaaccctacaagcctatgcctacagtatagttgcaaaagttatcaacttgtctgaaacagtatacattctggtccttagatttggttttctctgtgcaaaaaaagttagtgggacatacaactcagtgataattattttatagcttcttaccatgcattccattttaaatgttgatcttgataaatactgcacataaactatgagcaaaacacaggtttctatttgataactaagaaatcagaagataatgtgatataatgagtatgataaaaaatgaaacttgatttagtgctttgaatgtaaataaaaggtgacatattaactgattttatcatctttatgtttgaaagtacaatctcaggagatttgaatttaatatcactaccaagtttattctgcttcatttgaaaacccatgtcaaatgtagaatgtgttctctttatggaactgtggcgacacttcctaagacagaaagatgaatgaagcgtgtcggtgtaggtatgtgtggtcatatctgactcagtaccagagatttgcagagagcaggcctatctgtgagacaatatgagacagtctgtttcccttgcagctgttcacatttccttgttttgccctggtgttgtgtgtacatgttttttgttttttgttttttttaataaaaagtgctgaatttgggtaatgataatttcattagaaaaagagagtaaacagtaacagattcattcttgttttccctctagggataatttattaacattcttccttctctcttcctcccccttcacacctcagctttacaaatacacctgataccttcaaatttcaggaaagcaaatagcaaaaggaaatacattttgtcattccaatataacttgaatttaagcttctagagcagggattcacaaactatggccctcaggccaaatccagctggccacctgtttttgtaaataaagttttattggaacacagccatgctcattcatttatggattattaacagccgccctcatacaacacaacagggtttagtggctgtgacagagatcatatggcctgcaaagcctaaaatatttcctatcttgccaggataggattaggatcctgatattctttttttttttttttttgagacagagtctcactctgttgcccaggctggagtgcagtggtgtgatctcggctcaccttaacctccacctctcgggttcaagcgatcctcctgcctcagctaccttagtagctgggactacaggcatgcaccaccacacccagctcatttttgtatttttagtagagatggggtttcatcatgttggccaggctagtctcgaactcctcacctcaggtgagaatcctgacattctttaacatggcaaggcttgtaattgagtagctaatagttttcaaatcatattgagtgtatttttccctgcagcctataaatagaattttttacagcttttttcccaagtatttgccaaagatatctccctggcacaaggcattgtgtattactgaattctagtaacaagctgaggagatctggatgagagaaaggacagcatatcagcagggcagggtcaggtccctgctactctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttaccttgaaagttgtataaagtaagtcagacttaaaagatacaaaagaaagaattaaatatagtcaaaacacatttcttaattttgagggaaagtttttaactgcacatgcaggatcgaagagaaataatatctggttcctaaagaaacaagctgaaataaatattcctggtgtgtttattttatgttactctgaattttttttaaatctatttacaatttctatgtactagtccaaatataatacttattttttctagaggaagcatttcttaaacactactatgtactcagcctcacgctaggggctattacctaatgtcagagaacccgagtctggtcgtgggaaagaaaaagaaccacttaaacagcatgttctataatgtacctcagacattcagttccctcttggctgttgatgcccttggtgtggcagacaccccagtgttggctctgtcctgagttgcagacgtgtggtttctgcatcgtcagtatactcagcacctggtctcagaaacgttctcgtcccctgcccccaggggttaccacatagctttttacttctgagtcctcttgtcctcctgggcagggctgtatccagatggctccagccaggctaccttctgcagtgtctccttgactcatgggaaacacacacatgcttaactcaacatacactacaagcatggcctgccccaggcggcctccagtcatgaaagaggcaggcaccagtctctttttgcttaggaccccaaatgctacatgtcaagctgccccaaggactctctctcacacagagatcctttctagtgtaccaaggtgggcctataagttgctacaattcagcaagcatccctccagagaatgagatagtgagctcttctggctggcacctccagtgtctaatgcgtggttcttttggggcatctaccatccttcactttgtatgagggagggtgcaatcccctctcctttcctcccgaacaagaaggagaagggaataatcaaatacttgctcttcttagtcctgtgactcctacaaatcccagacttctgcctctataggcagaatgaggggtcctggggtgaatatggaagggccattttgactgcctttcagcaagcccaggagaagtggtctagcagctttatagcaggttcagtgccatttacttcctcttggccttagctttgggctttagctgaaagtccaagactactggtaaggtcccaagtaacattttatatattctttatatatgatagaatggggggtgggtaaagggtaagaaagacaagctgcagtcttcctttgttctcaaaacccagctacctttcatttgccccagaccttgacaaaactctacctagatttgaaatttgagtcctgcatatctttgcaggcagcatataatatgcagatgacccatgagaatgagaaatccaaaagcactatgtttctaactactgtttttaaacacttcaatgttacatcgcattcgaacttttttccattgatgactttttatttacctgctttgccatatttctcaaatgctttgtatatgctatggatatcactaaagtattttgagtctctaagacaaaaatgtagaaattggtgggggaaatgaaggttgacatattatgcatatacatcaagatactttccaacttcgggttgcccactgagatcattgccagttgttattgctggggaccaaactacttactctctggtctccaaagggttgaatccttcatacatttctgggcctttggttatacagatttttggaatttgtgagctctttgaagacagaaactcatctttttcatctctgtatccctagtacatagaaccccacattttagtacctagtaagacttcaataaatattgagtggatgggtatgtggatgaaccaacaaagggtcacttctctctgacagtgacaaaatgagcccattcctcactccctcctgcttcagttcttacttgcccttttggttgatgagccagcagccgagattcacagtgtattctttgccacatggacaccatcctctctatcctgtggctgccttgagaggtgcagtttctaggacttgagagctgcagtttttagaagaagcagagcccaatgcccccacctcaggtagaagccccaccttttaattccttcccattgtatctgcctttcatattaagcatcccacctccccctcatcctgccactacttccactgaactttaggtgagttgaatttaatttaagtgattgaactggatcagaccagaccaaaggcgtggaaaaaaatttggtctgagtattttccttggagcagtgcctcaaaagagattccaggcacttgtgtgccacctatgaagttgtatggatagaacagcggttctcacttgaccactctgtgcctcatttttctcatcttaaagtgagaatagtaggggtaaccaactgcgtaggattgtttgaggttaagtgaatgagtatatgttaagagcttagactagtaactatcatctagtaagtgctcaataaaagtaatattgttgctattagtagtagtactattagtactctcaaaagttagcactggacataagattttcaaatacctaaggagtttattaaagcacagatttctggacctccttcttaaattctgatgttgtaggtctggaggggggtccaggaatctatgttccataagtactacatctgattcggccacacgttcttaagaaattacagatataagacctaaggaactgtatatgacatagtaagaccaggtcaaaaattatctccaatttggggagttgtgggattattttttctttgtgagaaaaattgatgtgcatttattaaatgtttaaatagaaacgaaccataatcatagttgaaaatgttggaaataatagtccttgatcaagaaaaaggcaaaacttacagtttatcatggaattagacattataaagtgatggtgctatcaacttgtaaagcctcaaattaaatttgctttttttctcaaacaggtttgagattttttttttttttttttcgagacaaagtcttgctctgtcacccaggctagagtgcagtgatgcgatcatagctcactgcagccttgaccttctgagtagctgggaatacaggcatatgccaccatgcctggctaatttttgtatttcttttgcagagacagggttttgccatgctgcccaggctgttctccaactcctgggctcaagcaatctgcctgcctcagcgtcccaaagtgctggaattacaggtgtgagccactgcacccagccgggtttgagattttataaaaatatttttatgtattcacttagattatttaaactttgcttgataatattatgacacgtcagggggtgactaaatgtgtttttaaagtgttatgtatttttttaattgtgataggaacacttaacatgagctctaccctctcaacaaatcttaaagtgcacaatacagtattgttggctgggcacggtggctcacgcctgtaattccagcgctttgggaggccgaggcgggcggatcacaaggttaggaattagagaccagcctggccaacatggtgaaaccccgtctctacttaaaatacaaaaaaattagctgggcgtggtggcacgcgcctgtgatcccagctactcaggaggctgaggcaggagaatcgctcgaaccgaggaggcagaggctgcagtgagccgagattgagccactggactccagcctgggagacaaagcgagactccgcctcaaaaaaaaaacaaagtgcacaatacagtattgttaatgatagacacaatgttgtacagcagatcactagaacttattcatcttgcaaatgtaatgtagtgtgtgtgtatatgtgtgttttatggtttcttagtttttttggttttgcattttgtttgggtttgggtggtggttttttgttgttttactattttttattgcatgcatgcagtgcaattcatttctataggctagtctggaaacctaatcactatttataacattatttttctgggaaaatatgatcccagttacaacattgacatttctttagagatagaaagcattcagaagatggagactgcccacatatattttacagggatttgggcaaacttttgtggacgagccacaaatcaccatttccctaaaatgttaatataatgttttaaatagagcagcattttactagtctacttatactatttatttaatctctgatttagtagtgctttcttaattaatacatcatttaaaaaattgtccctgctctatcttcacattgcttttgttaggcatttttatgtatgatgtggcccaaatatttataagtcataaaaatttatcttgcattagtataagcaaatctgactataatctgaagaatgtttatagtcagtatttgacttctcaactagcattggtgtacagagtaggtgaagaaaaaaaaaagaataaaaccgaccacgaaaatccccacctgttttagagaagttaggaaataaaagtgttcacaacagccgaggtcatctttaacttttcacttttcaaagcagactgttgactatgaaacactttatttgaggtagaaattaatattttaattgtatttctaaaataattaaatgtatgttcttcagaaagctgaactttggatcatttaggtttgtggaattttagaaatatatttagtttctttcttttttttttttttttttttttttggagacggaatctcgctctgtcgcccaggctggagtgcaatggtgtgatctcggcccactgcaaccttcacctctcaggttcaagcaattctcctgcctcagcctcccgagtagttggggttacaggcgcccaccactatgcccggcaaattttttttgtatttttagtagagacggggttttgccatgttggtcaggctgttcttgaactcctgacctcaggtgatccgcccaccttggcctcccaaagttctggcattataggcatgagccatcgctcccagcgtatatttgctttcttttcagtgtcttctccactctgaattggcagagtcaaaagaaaaaaagtttatgtccttgacttcctgctgaaggataccagcactgattctgttaatgaacagccctagtaaaacaaccataagcctttgtgagaacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtttggaaaataaaaatagatccataatctcatcaccctaacacagtagtttccatttttatatatcgttttctagtcactctccatttgcatataaatttttttatagttgtaatcaaaatgtgtcttttttaacctaccgttatataataagcatatttccatgtttctacttgatctttacaaatataacttctaatgactgcaatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaattagtgaagaaaatttgagtggaaagagaaaataaggctttaaaaaattgttctcttaggctccctggcatttaaccctaagagccattagcagaggcatgactttctctgtgtgggcagatgactatggggaaaaacattgatccggcaggcatttttgcattttctacattacttaaagaaaaattacttgtgtattcttaattaagtagtctaattaattagttctgttcttgaaatcgtttctatttgtgcctgtgtcattttgacatttctaaagggaattggcagtgctgttaatataaaagaaaacttcttattaactttttgtccatattgatttttatggtgagtttggaaaaggatattcagagatactcttccgttaagtttcataaatctgtaataaatatatgttgcagccttgtcattttgctttatatttttcaataaccttttaggttatagttgacagacttttagaacaatttgcttcatttttattaccatcaatactgttcttctatgtattaataacatttgaataaaatgaaaagtttttcaaaataattgttttgcctgccataaaaatccactcataatttttaacttaaaagaatttaacattttgtaaatcttgtgtcatgtttgtattattgtatatcttgtttattttttaggtattggaagaaatttcatgttaccctgagaataacgacgcaaaggaactaaagcgtattttaacacaacctcatttcatggtaagtaataattaaacttccatagaactgaaacctcactttcaaaagaagtttttaaactaccctcataaaatgtagccagcttcatctcatgcatttttatccatatcatatgagactattaagattacaataccaggtaataccaaatattttaagactgttttgtttactttgtgtcacaactgtaaagatactcttggtgaagtggcttttcagggactgtactcatcagacaagggattttctttcttatggggtagtcctttagtcactggaactgtttatgttacttaaaccacaaagaactaaaattagagacagttttcaataataaggaatcgtctgaatctaggtgatatattggaagaattacatctcttttgacaatgcaaaactgctgcactttcttggttcatttctactatatggaaaatggggataacacctgtatttagccaaatataaagctaaatagctaaacaaagctcaaagctcaaaatagataagatactttgctgtggaaaaaggtccatgcttatctacctaactgcaatacaaaaacacaattacagatggaaattcatgttgaatataccattttaaaagcattagccacatcagtttatgtgaaaaatatgtgaaaagtggaaaatttacctcactgccctttgggagaaaatctgacttaaaagccttgttcttataactactattacagatgatactttgaatttttatttatttatttacttttgagatggagtctcaccctgtcacccagggtggagtgcagtggcgcgatctcagctcactgcaatctccgccttccaggttcaagcaattctcctgcctaagcctcccgagtagctgggattgcaggcgtgcaccacgacacctggataatttttgtatttttagtagagacgaggtttcactatgttggccaggctggtctagaactcctgaccttacctcctgcctcagcctctcaaagtgctgggattacaggcatgagccaccatgcctggccacaggtgacacttttaaaataatagtaacagtataatatgtgtatcaaagcaattacctgtgagttattatatatatgctgttttatgatagtgtttctttttttctttttcttttttttttttttttgagacggagtttcgcactgtcgcccaggctggagtgcagtggcgcaatctcggctcactgcaagctcagcctcccgggctcacgccattctcctgcctcagcctcctgagcagctaggactacaggtgcccgccaccacgcctggctaatttttttgtatttttagtagagacggggtttcactgtgttaaccaggatagtcttgatctcctgacctcgtgatctgcccgcctcagcctcccaaagtgctgggattacaggcgtaagccaccgtgcctggccctttatgatagtgtttctaaacttttaaccaagttattgaaataaagtttttttcctaaaagtaactacctggaaagaagcaattaccatattcatccttcctaactctcccacccaagcattaaaggctgaattcaagtataatccttgagagtatttgactttattctatggtaacagcactgtccagtgaaatacaattaggatacaggttctaatgcctgtagatgagtgcatttttacaacctaggtgtataaacacagaacttcgttcaaatctcacctcttttatcaaggtatcttgtaacctctctacccttctcttgaactttctcttctctaactcttttccacttgtttgtattcacctgcataacattctaatgcttgctggcctgccagagcaggtctcttcccagtgaatgagccagggcaatttttctttgtccttccatatcccagcccagttttgttgttctcattgagcttatctcatttagtcattgtgattatctctatttcacagagcaggagaataaagaaactatatgctttattaataatcctcaaatgtgatgaatcacaaatatctgcagttaaattaccgttaatattaccttgttcactgtttcatgcatatgtgctgtgtttccccagattataattcattcccttttagacagcatgtcttctatagcaggggtctccaacccctgggccactgaccagtacccatccgtggcctgttaggaaccaggccacacaacaggaggtgagcagcaggccagccagcattaccacctgtgtccccctcctgtcagatcagcctaggcattaggtcctcataggagtgggaaccctattgtgaactgcgcatgcgagggatctaggttgcatactccttatgagaatctaatgcctgataatctgaggtggaacggtttcatcccaaaactattccccgacctctatcccccacccccacccaccctgccatccgtggaaaaattgtcttccacaaaatgggtccctggtgccaaaaaggttggggaccactgttctatattataaaagtggttaaagatgtgaattcagatgacctggggttgaactccatccttgccaccgtaactttatgaactctgactctgagtcaacctcgtggagtcagaataagaattaagtagctgatatatctactgtgcgtagcacaatgcttgacatatgcttagtgcctaatagatgttatctgatacctattattagttgctccatagtatctatcatgtatagggcacatagtaagttatcagtaaaacattgaatagattaggaacctgcccgtttgcagataggttaggctctccttggctgactgctctgtgcagtgttccatagctagaaacagatatataataaattttggaccaggcacagtggctcacgcctgtaatcccagcattttggaaggccaaggcaggaggattgcttgaacccaggagtcaaagaccagcaacattgggagaccccatctctacaaaaaattaaaaataaactagccagacatggtggcacatgcctgtagtcccagctacttaggaggctgaggtgggaggatcacatgagcctgggaggtcaaggctgaagtgagccatgatggcaccactgcacttcagcctgggcaacagagcgagaccctgtctcaaaaagtaaaaaatgccaggaactgtggctcacgcttataatcccagcactttgggaggctgaggaatgagagtcatttgaggtcaggagttcaagaccagcctggccaacatggtgaaaccccatctctactaaaaatacaaaaaaaaaaaaaaaatagcctggcgtggtagcacacacctgtagtcccagctacttgagaggctgaggcacaagaatcacctgaacccaggagacagaggtttcagtgaggcgagatcacgcctctgcactccagcctgggtgagagtgagactctgtctcaaaaaaaaaataaaaaatgaatttggacagacatgtctttctataaattgctaagtaaactcagctcaattcagagaatgatatagggccgtatgagaccaatagatctttcagatttgaagtaagctaaataaattaacatatacccaaataggagccttttttttcatcaaaatcattacggctcatatagcccattgtatgacagcttatctgtcttctaagtctcgatatgttttgcttttctgaagtcagagagaagttaatatgtgcattgctattagtaaacattttcagaaataataagtaatttttataatttattgaatacctagctaggtgcttaaaagacattttcattcatttatcaaataagtaaatgcctactgtatgccaggcacactatgccaggcactaaggacctagtaatgaataagacaaacaagatccctgccctcatggaacttccactctagtggaggtggggtgggaggacaggtaggagaggtagaggtagacaatgagcaagtaagctaacaagataatttcatatggcaataataactatgaagaaatgaaaggataatggtgcagagattatagtaaagtgggagctgctttagataggggaaagcccctctgaggagtagacatttgggctgagactcctttgaggaagagcaaatgcaaaggcccagagacaggaaagagctttgtagattcaaggagcagaagtcctttgtggctgagatacagttaacaagggagagagtggtacttcctgtaccaagagaggtcagcagaggccagaccaatttatttatttttttaatatataaaataaggccaggcatggtggctcacgcctgtaatcccagcattctgggaggccaaggtggacggatcacgaggtcaggagttcgagaccagcctggccaacatggtgaaacctgtctctactaaaaacacaaaaattagccaggcatggtggtgggcgcctgtagtcccagctactcaggaggctgaggcaggagaatctcttgaacgcaggaggcagaggttgcagtgagttgggatcgcaccactgcactccagcctgggagacagagcgagactccatctaaaaataaaataaaaaatataaataaataaaagccttccaggccattgtaaggagtctgcagttttctcctgattgcagtaggatgacactaagtgatggcacgcaggaaaatatctaatctgtgccttgctggagctgatgtgtagagaacggactgtaggggggataagagtttagggagaccaattggaaggctgttgtgagaggttgtagaggcttggagaaaggtgaggatggtagaacatgggcagatggggtttctgtgttggagatggttacatacaagaggacttgctgatggttgggatgtaagctggtgtaattaaacccatttcacaattccgagaggaaattgtgccctaacaaggtaaagagacttgcttaaggtcactcaccaatcagtggcctcaatgaggttcaagccagatcctgctagcgccaaagcctatgctcctaaaagtcagttgatttataatgctaatcagatttctaataaatttaagttgagctcattggtcattcctaaataagcttttgtgtagataatatcttatgtgggaaatataattctgagatatatatatatatatatactatattaaataagcttttaaatgctggggctttctatcttataagcgtttttaaaatcatggcttcaaaatcttggtatttttaaagaaatattaatagctaaggggaaatatgttaatacttacaatttttttattatgccaaggtttgggagttattcttggcatatttataatttcacacttatttgctcagtcatccgaatttttctttgctttctgattattataacatgaggatttaacattgaattacccaacactgaaaatccagatacttgtagatatttacagtaactaaaggaagaggaaataagggtaaatttaaacgactttaaaattctgtgttttttttttttaagagacggggtcttgctctattgcctagataggagtgcagtgacaccttcttagctcactgtagccttcaactcctgggcaaagcaatccttctgcctcagcctcccaagtagctgggactacaggcatgcaccaccatgcctgtctacttttttttattttttgtagagacgggggtctcactttgttgcccagactggtcttgaactcctgagctcaaacagtcctctttccttggcatcccaaagtgctgggattacaagcatgagctaccacacctggcctaaaatctgtatctttagaggtcatcataaaagaatattatctcactgattacttttttagttattccatttgaaaggctgactttttaaaaagaatatttcctttgcttattgcagctgtaaaatatgaaacattaaatagtcagattttttccactctagtctgatgttgttagttgtcttatacatatccttactatagtacaaaaagtgaaagtgtttttttcctattacacgattgttacgtagttaaaactgacagctatttcagcttagtgacaactgctcactcatacgtcttaacatatttgaagaaaaatgttcaaattttggtttccctattttttattttatatactcttttaagcttttaaaaagatagtctgtaagtggccccctttttctgtttggatatgaattagagctttaggttaagtttcgttttgtggtagcaatcatttacagtgccaaattgtggttaatatcgagtatgaccttatttggtgacatcatttaagcatttttcttttagagtccagtttgagtattattttatgattgtgggcttaatccttccttgtaaataatgcattaaatacaaatgtttgcttatataatttaaaagaatgagtagaggcctgtaatcccagcactttgggaggccggggtgagtgaattgcatgagctcaggagttcaagatcagcctgggcaacatgatgaaaccccgtgtctacaaaaaatacaagaatgatctgggtgtggtggcacatgcctgtggtcccagctacttgggaggctgaggtagaaggttcacttgagcccaagaggtcaaggctgcagtgatatgacgaacataattttagcaaatgaaatgttccagtttttatgttactgatttttgctttttgccctaaatcttggtttcttatgtgaccacaattaaatcagaaaaagagggatttgcccacataggacagcctctatacttgggctcaggagtaccagtacaaggtgcagttagggcactggtgaggaagccaaggtccccagggccatcatggagcactactttcaagctatatattgcttagtgccccttggtgctcctcacccaaatcccagtttagaccagccttctgagattgtgaaaatatctgccatttccattagaaactcaactgtgtataatgctcaaagcatattctttactggtaacaaatcagcattatcttctttatgattttaccagattgttaccttttttttttgcctcgtatgcatgcctttaaaattaaatagccaagtcatgacttttttaagccttttaataaaataacttaatttcagatgctatgagttattatttttaaagcaattttaactgcatttcattatctgcagatattaccgcacagatcccaaattaaaatagaaccaaatttatagttagcacataagaaaatataatctttgtataaagctccagacattttgatagctgtagattctctttgaaatagaaatgttcaaatatttatgcttaatagaaagggtttattatgatggcacaaaaagtgtggtgagtagaaggacattcttttttagggaaacaagggacattttattgttgaagttcaccaagctgacaaatagagatgtcagttcaaagaaatcactttctctttgttaataggctttgcaaaaagaagtcataataataattctcaacttattttttatttaaacaagtgctccaaaaaatataatgaacaaaaaaatttaacatatttagagtttgagttccatatcatacgtgatattttggaagattacgtttttaaggtacatctgtgtgtatttttttctttttctaaatcatatgctataaattattttcatcctttgggttatataaaagcgtcattgtaaatgccattgatgaaagatacttgctcaatactccaattattgcactatttctttttaaatttgtttcaattctaagccccagcacaaatttgccaactctatttatagatgattcttttagctaaattacttgaaattgtaccgtctaccttcatttgaacaagttagttgataacacctctgacccagataatcatcaaacacatctcttcattgattcactcatttattcacttacgttttaaaaaatctatttatcatgattgtcacaaaaaaattgagatagttggatgtcgatattacacactttatgttctctttagatgaatgatacctttgagaggaaaagaatgagatatgtttatagaataaatttgtcagccccatgtctacaaagaaaacatttaaaaattagccaggtgtggtggcatgcacctgtggtcccagctacacagaaggctgcaaaggaaggatcgcttgagcccaggagatgaagcctgcagtgagctgagatctcaccactgcactgcaccctgggtgacagagtgagaccctgtctcaaaataaataaataaataaaataaatttctgctgaaatagtaatgttattaataatttttttcttcataaaacactaggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttggagagccctcagcttagacatttctggtcctaatcctcatttagtaatctttgccagttatacaatattatcttgcagcacatggggggcatgcagatcacctcaccccttctggtactatccaggcaactctttggcttaagagcataggctacagcaggttttgggtgtcttgggcaaatcacttcatgtcagtggacctcagttggctcatctctaaaagcatagttgactaaatgaatgatccccaagatcccacctagctctgaaagtctaatattccattcattcattttatatattcattcatttattcaccaaatatttttgaagtccctactaagtgcaaatcactcttattagatgccagtgatctattgtcagataagacactgccccttactagagctcacgttccacagggctggctacattaaacaagtaaatttgtagcttagcacggtttacttaacaagcccagttatgacagagctggagaggagagaaagctgtgttggagaggcaggaaggtgtgatgttcagccaggcaaagcaggcaagaaggtagaagggaccacaagaaggaggcctcagagtgtcttgggatcattaagttctcaagcagtccagtgacagctgcttgattgtttgtgtgaagactcactacatagaaacatagactgaattggcccggtgcagtggctcacacctgtaatcccagcactttgggaggacgaggcgggtggatcacgaggtcaggagttcgagaccagcgtggccaatatggtgaaaccccatctctactaaaaatacaaaaattagccaggtgtggtggtgggtgcctgtaatcctagctactcaggaggctgaggcagaagaatcgcttgaacccgggaggcggaggttgcagtgagccgagatcgcgccactgcactccagcctgggcagcagagtgagactccgtttcaaaaaaaaaagaaaagaaaagaaaagaaaaaagaaacatagactgaataaaagcataaaactacatccctgagttactttttcagaaagcgtaaaatggtcttgagtctcccctaaaagtctccttccaaaagcttttctgtcttcgatgatcctagtgaagatgtatatttcttctccttttgatgggtttccatgaaaacaggaattattttatgtgaaatataaaatatatattttcaataatagagtgtcaatctctaatgcatttaatacaactttatttgctttcttagttgtcttattcaaagcattatgttactgtgcaggatattcctatatgatctgttttgtttttcagaccctctgcaatgtgtccattcctcaagggtgacatactcctgttacacacctctgttttcccatttgtagcatcatactcataatttttttttttattgattggaattcccatagttgcaagtgacaaaaatcaagcttgaactagcttacaaaatagaggaaaggcttatataaacagggaaaggccaggagtataactttcctaatatctcccctcaagctggtaggttcaggagtaggcacctaacccaagctatgccaatgccttccctagaatttgtgaacttgggaacagagagaaagtgaatcagttcctctctacagagaaatgtttgggacctacagaataataaatgttaactacagttggtttgaggtgaacttctcctggccatgggagaccctttttgtctcatttgctactgtacctagcagagtgcctgcctcatagtaaattcacgttaatgttagttgaatgaatacatacatctattagtttcaagggtggaagctgtattgtactatcatttcccttatgaaattagatttgacttacacactaatttacagcatttttccaggaacacttttcttagtaaccatacaagctgattgaatgtacaagttggaaatgaaacttgaatattacaattgaatcttaggactggaaatattttgataaaccagtttttcacattgctcacctaccacttctgaaaactgcaaaataggaacaatgcaaagttatagtttgtggagtggtacaaattaagtttagagtataaagtctcagatatttttatcaagctttctgacagtgttattctctagtgaaaaataaaagacacagtccctacccttaactgtctcaaattcaaggccactttccagcaagggagcctgttaaaaagtacagatttccgggctccattcgaggcctcctgagcttaaatctaaagagtgggtttaagagtcagcattatttaaaatttccctgtgtgattcttaggattaaccagatctagtgcaaaaaatatgtttatgaatgcttgttttttttaatagtggataatcagaaaacaaaaagtaatccactctgtagaatagtattctggcattaaatgtgactatagaactttcatttctgtccaagatagagtaactgggaccagatttatcctctcatttgaaacaacccaacatataaaaaacaaaatatcatgaaagaacagttttcaagacattagacatcaggcaactaaggacagtgatctcttgtgagacaggaaacaaggtgacccatatgaatgccccaccatgctgccttgagagagtttccaggccacagcacagggaggggaactaaggcagagtaggcagactccctaaattgaggggacagagctgagagtctggggtgaccaaagcaactagagttcataggacagagtactgaagaggagagagctgcacacagacagaacctcagatctgcagaggatctccctcaagtattcagcagagtatcgatcagtgcatgtctaataggaaattccccaacactgagaaactccccaacactctccactttggatggaaaaaaaaaccatccaaaaggattggaaggaacagcgcctgcactacctgttcccaccagtcagactagaaaaatttctaattcatggctcattgtgtagagcgctcagggaagtcttatctctgtaatgagaagtaattagccccaaactgacaactgctccagacctgcctaatggatcatgaacgcaagacccaaaggatcaaactatgtccgagtaactgatctaagtctcagaacaaaacataagaatatttttaggaatacaaaaacatcaactatgcaacaaattcacaatgtctgacatctaatcaaagattactaggcatgtaaaaagaccagaaagtgtgacctataatatggagaataatcaatcaaaaatgacatagaactgacagataatagaattagcaggaaaatacactatgggattaatggcagattagacatttcagaagagattagtgaacttgaagacagagcaataaaaactatcaaaaatgaaacacagcaagaaaaagaatttttaaagatgaaaagagcatcactgagccgtgggacaacttcagtcagcctaatacatggttaattggagttcatgaagaagagaggaaaagaaagaagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaaaaaaagaaaaaagaaattttacacacagaggaacaaacataaggatgacatcaatgtcttatcggaagcagtacaaacaagaacagtgtcataaagtactaaaaacaaacatttctcaacttagaattctaaaccaagcagaagtatctttcaagaacaagaaggcaaaataaaaatgtcttcagacataccaaaactgaaagaattcagcagacccacactataagacccacagtatatttaggacattcttcaggcagaaggaaaacgataacagattgaaatctgaatctacaaaaagggaataaagagcactggaaatgatagctatatgggtaaatctataagttctttttcttattacttcaatctcttataattggcaatttaaacaaaaataacaatgtgttttagagtttatagtatatggaaaaataaaatgtatgacaacagtagcacaaaggtcaggaagaaagacatagaagtactatatactattgtaaggctcttatatgatgtaggggggataagggttatatgtgaagtggtataatatcacttgaaggtacactgacaagttaaagatagatgctataaaccctaatgcaaccactaaaacaacaaaatgaagagttgtgagagaaaacacaggagagaaaacagaataaaaaataatacaaagaaaggcagaaaaagataacagaacaggtggaacaaatagaagtcaaatagcaagaatatatatttataccagactgtatcaatcatcatgttctgcttgtaaaacatgcacttcatacacaaagaatagtttcaaagtaaaaaggtagaagccaggtttggtggtgcatgcctgtagttccagctacttgggaggctgaggcaggaggatcacttgagcccaggagttcgaggatgcagtgggctatgattgcaccactgtgctccgcctgggtgacagtgtgagacttcatctcttaaaaaaaaaaaaaaaagtaagaagatagaaaaagatatactgtgataacattaatcaaaaggtagctggagtagctttattgatatcaaaatatattctcagaccacactgggattaaattagacatgaataacagagagagataaatcgccaagtacttgaaaattaaataacacaattctaagtaacccatgaattaaagaggaaatcaaaagggaaattaagaagtattttgtaatgaattaaaatgaaccacagtatgtcagaatttgcaggatgccactaaagcagtacttagggagaaatatgtaccattaaacacctatattagaaaagaagaaacatctcaaatcaatgacttcagcttataccttaaaagtaactaggacaaaatggagtaaattaaacccaaaatgagtagaagagaagaaataataaagatcaaagtagaaattaatgaaatagaaagcagaaagcaatagagtatcaataaaacagaaaatactttttctttggaaagatcagactgatcaggaaaaatggctatacaatcacggggaaaaaaaacatgaattaccaacatcaggcatgagagaaggggcatcactacagagtctacagatataaaaaggatgataaagaaataaacagatttatgccaataaattcaacaacttagataaaatggaaaaattccctgggagacagaaactactaaagcttatttaagaaggaataaactgaattgccctatactatctgaaaattgaatttgtagttaaaaactattcctcaaagaaaactccaggtcaagatggcttcactggtaaattctgtcaaacatacaatggagaaataataccaattctatacaaactcttttcaaaacattgaaaaaaaaggaatttttcccagctcatcctagaaagccagcattgccctgataccaaaaccagttaagacattacaaagaaagaaaactatagactagtattcctcatgaatgtagatgtaaaaattctaaacaaagtcttagcaaagcaaatccaacaatatatgaaaaggttaatatgttctcacttcagcagcacatatactaaaatataaacagtacagaaaatattatcatggcctctgtataaggatgacatacaaatgcatgaagtgttccagatctttaaaatatatatatgttatgatcaaatggtgattaacccaggaatacagctttacttataatagcccaaaccaggaaacaattcagtgggtgagtggataaactgatatgtccatacaatggaataccactcagcaagaacaaagaacaaactactgatacatgcaacatcatggtggaatctcaaaataattatgctgagtgaaaaaaacaacaaaaaagagttcatactgtatgatttcatttatgtacagtgcaaacaaatctgtagtcagcaaaagttgactgtatcagcctttggtcgacaactatattatcagctttttgattgtcacattagtagttgcttagggatgtggtggggagggtatggagggatgggagaatattaccaacgagcatgaggaaacttttgggaatgatagatatatcactatcctgattgtggccatagtttcatacatatgtcaaacttatcaaattgtacactttaaatatgtgtatgtcaattatatatcaatgaaaactgtttttaaaaataataggcaacattaaaaatggagcaacagggaaaataatcataattagaagatttaaaagcactatcggccaggcatggtgactcacacctgtaatgccagcactttgggaggccaaagcaggtggatcacttgaggtcggcagtttgaaaacagcctggccaacatagtgaaccatctctttccttaccctcgtctctactaaaaatacaaaaattagcttggcatggtggcaggcacctttaatcccagctactcaggaggctgaagcaggagaatcacttgaaccctggaggtggaggtagcagtaagctgtgattgtgccactgcactccagcctgggtgacagagtctcaaaaaaaaaaaaaaaaaaaagaaaaaagaaaagaaaagaaaatagtgtgttaaaagcattatataaaatatatgtatatagcaatcaaaaaatcaaaaatagtatttttgtcatggagcaattttgtgtgcgtggcatactggatggtcttctccattttccatattttctttaattttttttaactggtaattaaaattatctaccgcaaaatcacaaatattaagagaagcactgtcatagtaattctacttttgctgaactttttattttttttttaacagggaatcactttaaaaatgaatgaactaaatcattgtattgttgcaagaattatgcatgggggcatgattcacaggcaaggtaagtttcatatatatttctttctttgccttccttaattttttttccctgtagcctagtgaagaaaatgtttttgtttgttttgtttttgagatggggtctctcactatgttgcccagactggtcttgagctcctaagtgcaagcaatcctcccgtctcagctttccacaggtgcatgccatcacacccagctaagaaagtataaaggatacatataaagaatcttttaaaatcatctttgattttaatcattattggcctccattgtttcttattcatctgcacaggctccagcatgtagataatgaagggagaatatattagagttctgttagccagagcatctctgtattagattactacttacggggaccacgggagataaagcaaataattacactgggcctcacgatgtaggagagacatctgttctagagtaaaagatatatgtaaataaataaccatttaagaagtgttctctcattcatttaggaattagatatgctatttataaattaggacatcatagagttaaataatacaaaaattaaatggtaagagatgtcaaatcgatgattaaattattaatacctgccatggtgagtgcagtcattctgtggagagaattcactaagaactggaatagacaaagaatgatgtgggggttttttttgagacaaggtctggctcagtcacccaggctgtgcaatggcacaatcttggctcactgcaacctctcctcccgggctcaagcaatcctcccacctcagcctcctgagtagctgggaccacaggtgcacaccaccatgcctggctaacttttgatatttttgtagagatgggcttttaccatgttgcccaggctggtctccaattcttgaacccaagcaatctgcctgcctcctcccaaagtgctgggattataggcatgagctaccttgcccagctcgaagaatgattttttaagaaggtgcatcttcagttaactctcaaggatgggcagggtttggatatgtggatttaggctttttctttgaaaggattgagttatatgcactagtatttagaggatgttccaaaaatgattcttctggcagactctctgtctttgagatagggttatttttgtacttaacacctctttccttacccccagagagcgagaagtaacactctaagcattttagtgccttattctcctcttgagaataagaggagatcactgtgtacacaacatgatgtctggcatcattgctgctttcagaggaatccttgtaggcgtagagggtgtacagcactcccacaggaggatatttggttttagattccagtatgtgttttttgtttgctatttttaataatttttatatgttcagtaaagccacaacatcattctttcttttttttttcttttcttttttgttttttattatactttaacttctagggtacatgtgcacaatgtgcaggtttgatacataggtatacatgtgccatgttggtttgctgcacccatcaactcatcatttacattaggtatttctcctaatgctatccctcccccagccccccaccccctgacaggccccagtgtgtgatgttccccgccctgtgtccaagtgatctcattgttcagttcccacctatgagtgagaacatacggtgtttggttttctgtccttgtgatagtttgctgagaatgatggtttccagcttcatccatgtccctgcaaaggacatgaactcatccttttttatggctgcatagtattccctggtgtatatgtgccacattttcttaatccagtctatcaatgatggacatttgggttggtcccaagtctttgctattgtaaatagtgctgcaataaacatacgtgtgcatgtgtctttatagtagcatgatttataatcctttaggtatatactcagtaatgacatggctgggtcaaatggtaattctagttctagatccttgaggaatcgccacactgtcttccacagtggttgaactagtttacagtcccaccaacagtgtaaaagtgttcctatttctccacatcctctccagcacctgttgtttcctgacattttaatgattgccattctaactggtgtgagatggtatctcattgtggttttgatttgcatttctctgatgaccagtgatgatgagcattttttcaggtgtctgttggctgcatggatatcttcttttgagaaatatctgttcaaatcctttgctcactttttgatggggttctttgtttttttcttgtaaatttgtttgagttctttgtagattctggatattagccctttgtcagatgggtagattgcaaaaattctctcccattctgtaggttgcctgttcactctgatggtagtttcttttgccatgcagaagctctttagtttaattagatcccattagtctattttggcttttgttgccattgcttttggtgttttagtcatgaagtccttgcccatgcctatgtcctgaatggtattgcctaggttttcttccagggtttttatggttttaggtctaacatttaagtctttaatccatcttgaattagtttttgtataaggtgtaaggaagggatccagtttcagctttctacatatggctacccagttttcccagcaccatttattaaatagagaatcctttccccatttcatgtttttgtcaggtttgtcaaagatcagatggttgtagatgtgtggcattatttctgaggcctctgttctgttccatttgtctatatctctgttttggtacgagtaccatgctgttttggttactgtagcctcatagtatagtttgaagtcaggtagtgtgatgcctccagctttgttctttttgcttaggattgtcttggcaatgcgggctcttttttgggtccatgtgaactttaaagtagttttttttccaattctgtgaagaaagtcattggtagttttatggggatggcattgaatctataaattactttgggcagtatagccattttcatgatattgattcttcctatccatgagcatggaatattcttccatttgtttgtgtcctcatttatttcgttgagcaatggtttgtagttctccttgaagaggtccttcacatcccttgtaagttggattcttaggtattttattctctttgtagcaattgtgaatgggagttcactcatgatttggctctctatttgtctgttattggtgtataggaatgcttgtgatttttgcacattgattttgtatcctgagactttgctgaagttgcttatcagcttaaggagattttgggctgagacaatggggttttctaaatatatagtcatgtcatctgcaaacagggacagtttgacttcctcatttcctaatcaaataccttttatttctttctcttgcctgattgccctggccagaacttccaacactatgttgaataggagtggtgagagacggcatccttgtcttgtgccagttttcaaagggaatgcttccagtttttgcccattcagtatgatattggctgtgggtttgtcataaatagctcttattattttgagatacgttccatcaatacctagcttattctgagtttttagcatgaagggccattgaattttgttgaaggccttttctgcatctgttgagataatcatgtggtttttgtcgttggttctgtttatatgatggattacgtttattgatttgcgtatgttaaccagccttgcatcccagggatgaagctgacttgatcgtgttggataagttttttgatgagctgctggattcgacgttccagtattttatggaggattttcgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaagaatatatattctgttgattttgggtggagggttctgtagatgtctattaggtccacttgttgcagagctgagttcaggtcctggatgtccttgttaaccttctgtctcattgatctgtctaatattgacagcaggaaacatcattatttctttaacttctctttgttatattactgcactggctaggaccggcagtctttcaaggagtggtatagtagacatcccgtcctattcttgtttttaaacggaatctaaagttagccgggcatggtggcgctcacctatagtcccagctactcaggaagctgaggtgggaggattgcttgagcccaggagttcgaggctgtagtgagctatgatcacgccactgtactcacctgggtgtcggagagagaccttgtctctagaaaaaaatgtttttttaaaaaggaacctttccaatatttcttcattaagaataatgtagatttttagtacatgccttttattagggctaaagaagttcctttatattcttagttgctgagcattttaattgtgaatgggttttgaatttaatcaaatgctctttcagaatctgctgagatgatcatttgtttttttccttttatctgttaatgtggtgaatgtcttttaaagatttcctaatgataaactacccttgcatttctcagataaactcagcttagtcattacatattatcttttttatgtactgcccgactgtctgctaatgttttgtttataagatctcagtatgtgcatttatgagtgagactggcccgtagttaattttcctctcttgtatttctctgattttagtttcaaagttatatctacttcacacaatgacttggagagtattccctcttcagttctccgagagattttatataatattggaatgatttgtgtcttgaaagtttggcaggacttgcctgtaaagtatcacagcctagtgttttggtttttagttttaagaaagttttgtttttgttttttaacaactgcttcaatttctttaacattaaaaggccatccaggctttctatttcttgagtgagttttggtaaattacattttcctaaaaaaaaataagttttaaaatattgcagagagcttcttcatagtattctctcatctttttattctctgccatctttgtcattatgcccctgttcatttctaatattgtttatttgtgcctactctttttttcttgatcaaccttgccagaggtttgttcagaaacccactctgggtttggttcattctcttcattatatgtttattttctgtttcattgttttatgacctaatttttattatctcctttttttttaactttctattggttttggctaactttacaaatttgacacatagttcatttatttccagtcttttttttttttttttttttttttgagacagggtcttgctccatcggccaggctggaatgcagtagcataatcatagctcactgcaacctcgaactcctgggctcaagtaatcctcctgtctcagactcctgagttaggactacaggcaaccacactcagctaatttttttaatactttgtagagatagagtcttgctttattgcccaggttggtctcaaactcctggcctctagtgatcttctcgcctcactcagcctccgaaaacactgaggttatagacatgagccaccatgcccagccttcttttcttttctttttttttttttttttttttttttgagatggagtctcgctctgtcgcccaggctggagtgcaatggtgcaacctctgcttccgggttcaagcgattctcctgcctcagcctcccaagtagcggggattacaggtgcccaccaccacgcacagctaatttttatattttagtagagacggggtttcaccatattggccaggctggtctcaaactcctgacctcatgagctgcccacctcagcctcccaaagtgctgggattacaagtggaagccaccatgcctggcccagccttcttttctaatatgtgcctttaagactaaactctccctctaagtactgtcttaatgtatcccaccagttttgacatgacgcatttttataactcagttctaagtatttttatatttctattatgatatttttcattgacctatattatttataattgtctgttacttttcacacttaacaggattttctgtatatctttttgtaatttacttctaacttaattacattgtggtcagagaatgtagtctgtatgacaccatttctttgaggtttgttgagacttgctttatggcatagcactttaatcgtttttataaatggcccacgtgtacttaagatgaatgtttattctttaattgttgcatgcagaggtatctttttgtaatgaagccaggtcagtgtgtacatttctgcacaatttataaataaggaagcaacattgtaaataacactctaagcattggttcttggtcatttctttctagctgaagtattacaagatgctgaaatgccaaccaaaagattaaattatctttaacagaatttgctgttgtgtagatattatcatgtcacaactcttggaaaattgacaaccttcgtatcatatctggtagataacgatagcagccaacactgtcatggtgcttggtatgtgccaagaacagttctaagccttctgcatttattaaatttgtttagttcttaaaacaatcctatgagatgggtactattttcatctccattttacaaatgtgaaaactgaggtatggagagtttcagtaatttacccaagatcttaaagctagtaagcaaggaagctggaatttgaacccaggcagtctggatccagaagccatacttttaaaccactatacataccacctctctcagaaaaatagatttctgcagccatccatcaaaactgtgccttccacaagtagatatatctgttttgatgaggttactacatgagttaaataattctgctgcaaccaaacttgtacctgcctctgaaatattggccctcaatattcaacttagtttttaaaaattacattgatgcctctggattttgttactatgaaagcatatatcatttcatgtttataatgttatataatttcttaggtacacttcatgttggtgatgaaattcgagaaatcaatggcatcagtgtggctaaccaaacagtggaacaactgcaaaaaatgcttgtaagtaaatgaaagtttttcctttcctaaaattgacttttactttgttagcttgtttttaaatatacaaataaggagtattcttctgtaatcagagaatttctggtaccatatttatgtggacttgaacttatataacattcataaaactgacaactagaaaaatgttgaaatacaatagagtttacaaacattttgcctgtctttagcagtgtgggctttaacactctccttttatcctttatctcctgtttcttaccaagcagatgattaaagaaaaccttttcagtgtttgtacatgtgaactagtttctcactgacctcaactctcctgacatcagcagtgtcagaaacctctttcctgttgagctgagtcatagccagctgtcgtggatttctctacagcatagaagggaggaaagccacggtagaccaggccatttttgaccatacatatccaaaatctgtattcaaattaggctttggattttttaaaaaggcaaaatgacagcctttgcctatgttcattgtcatagcaagcagacagaggtgtttggggcctctgatcccttttcccactgcagtgtagtagcacccaggttatgaatacctattaagtatgaaataagcttcacagactcaccaaacatttttttttcttttttttgagacggagttttgctcttgttgcccaggctggagtgcaatggcgtgatctcagctcactgcaacctctgccccccgagttcaagggattctcctgcctcagcctcccaagtagctgggattacaggcatgcgctaccacaccctgctaatgtttgcatttttagtagagacggggtttctccatgttggccaggctggtctcgaactcccgacctcaggtgatccaccagccttggcctcccaaagtaccgggatgacaggtgtgagccaccactcccagcccaaaatttttttttaaaaaaaagccaaaattaataagcaaaaagtggctgggtgcggtggctcatgcctgtaatcccagcactttgggaggccaaggtgggtgaatcacctgaagtcgggagtttgagaccagcctggccaacatggtgaaaccccgtctctactaaaaatacaaacattagcaaggcatggtggcgcgtgcctataatcccagctacccgggaggctgaggcaggagaatcactggaacctggaaggcagagtttgcagtgagccgagatggtgccactgcactgcagcctggatgacagagcgagactctgtctcaaaaaaataaataaataaaaaatttttaaaagtaaaaagcatattctatggggtacaccattataatgtggcatactcaatgtaatttttatgtaattacctagtctattgtctaattcaatgtatattcacttttgaaaggcatgtcacttagaaagttttgtattcacatctataaaaaggtgaccattgaagatctgtgagaccattgctgtatgagcaaaaggcaattggctgctgggcttttcccaggaacttactctactgttaactcgagcagtccctgcttcatgactacatttcattttccggctatgtgctctcagatggcttgtgctaattgcccccatgtgttttgagtggcttcttacatggttttgtgaacaattgtttgtaagaaaacttttctttctttcccaccaccccccctccagagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaaacggagtgtctgagggaaaaaaactaaaggccataattgcagtaatatttccaggaagttcattcacttcccttgttaagaaatcacatagatagttcttctttctaaggatctgagaagtgatctatttctgttgagatacagttgttcatacaattgtgacaggtctctagatggaagttaagtctgcaatgaattgataattgacttcactagagggaaataggcttttgcaaccttttgtaaaactgtttaaatttagaatggtatgtgatctgtaaacaagtaagttttctagagtaatacagccccaaagtttctttcttaaaataggcttatcctgtagaaattatagttcttccaacctatattattcagttttgtgttggttgttaaatgagattcaaaaatctattctttttgtattggaaatataaatgggcataaatgatatcatcctttggtcattgcacgttcagctcgagtgttatttattgaagcttgttctttcatgtgcatcttccgagagtatgtgcatcaatatgaagtacacacttcctaaagtttatttttaagactgacaggtaacttattggatttgtacttaggagaacctgagagagaattgtaatacttctagtctctagtgatggtgtaaatttcataagaaaaatcagaggcttcatattttttaaaagcctattgaagatacatattaaaatgtatagttttgtcaagtatatttttggtgagccatggcaattgaggtgtccgttgtaacgggtcttgagctcctcttggtggctttttatggaacttcaattaatagtatatttcaaaagaaaatgcagaattgcttctgttccaggattcagagtattgaaatttgttacctagaacacaaactttgctgggaaacaaagaatgtcacacttaacattctatgtaaataattttaatattccagagttacagatgtccttatatcatttctcatctgttgaagaaatttagtaaatacaattgacttttgtctttttggctaactaaccagaaggtactgttagttattaatacaacataagtttctctttttttttttaaatggtcgaactagtttggggtggaaccagtatcatagatgtaaattctatgttcttgagtaagaagaacccctcttaccttctttgcctttgaatagtagaaaaaataatgatacttctctcctagctccacctccagcctttttggccctcctgttccctggcagaattcaagcttgtggttggactcttcccagctagggcaatacttcaaaaaaaaaaaaagaaggctctctggccacctgcatctgcatcccccaggtccttggttaaagagtagacccctgcccctcaccctggctctactgacttgagtctctgcgggtggcacctggagatcagtcttgctcactaacatatgagaatgctcttctaagggatctcattacctttaaggctgacaggttctagaaatgctcttaagtcatctggggaaaaaaaatgtcttttaaaaagacatgcacatttctaaggcttaaaagaactctacagaagcaaaaattaaaaagtacttatttccttcctctccttgttcttatcgttaaagttgatttggacactaagggaatggagcctggaaaatattttgagtgtatagaatagtagagagaaagcaagcgatagaggagcctggatataggaagagtggctgtggctcctaggatctttgctggaagtgtaatattgttataggcttgagattattgttttaatcaatctgctaaaatagtcttaaaaaaagagttcttctctgatgtatatctcttttacccttactagtaataatatttattctataatagaaagattctgaggtgattgtaacatgtgaaatcttaggtttgtttctcttcagattgggtcagttagtaactcttgacacaggtactaaaaattattaaatacttttcaaacctaatctttaataaaaattaggcagttgggatcttcagcacgataatttatggtaatgtttgtcatcttatacttgatagggttttaatatcaagtcactcttctgggtctcattaaaagaaagaaaaggtatagaatgttagagataggaaagaattgattaatgaatgacacagtcatcacttaaaatatgtgagccttcgaactgcaaaatttttttcatacttctgtgaaatcatgcaagcaagtcagtatggcacctatacagctcaaacctcaaaggaaatggttgtcagactgtggttgttactgttgatgtaaatatctctgtgtttctgtgctggtgttctgtgttaatgaaccttgtgtcttatttcagagagattccccttccacttccagacagtccccagctaatggtcatagcagcactaacaattctgtttcggtaagaactttagctccacacagcaaagtgtgacaattttgttggtgctcacctgccatgagtgttctagttacatgtgttcagtggaaatagtgtcttctgctgatatacaaggctactacagctacaatgcactttactcctggaaaatctttttcaacatttccttctcattaaaaatccccttcaatagttaaatttgaagaaatatagttcaagactgctttggtcattctaaaaatatttctatgccaccccatttgtatgtatgactttgctcaaacctatgcaaaggatgtaaacggaaatttgtttaaacttctaaatattttttaatttgaaaaagataaatgtaagaattttgcagagtaggcatttgggtattcttgggctttgtagttttctattctgagtgatatcagcaacatgttttagtttccgctatctaagtttacgaattggtgtgccctctgttattgtggtacgtgcacatatttttgtgaattataagccttgcctggatatgaaaagcaaaaagaactggcttcaaactgcacttaagccacgctgttatcacatctttaacacaaagtactttatatttgacttgaacttggagttttaaattttttcagaactatccattttggaatatagaaagaattgtttttaacttatttaaacaaatggaagcacttaacaggtgcagactggcaatattttggttgctaatactgctgtttatgacccagttaaaattattgagagttctaataatgcagcagtattcttctttcctgacttttaatttgccctttgagaatatatcaacttttttatcaggtaaaattgtaaataatttagaaattatctcaaatggaatgatattctaagtatatcgtaagagaaattatgaaagaaaattgtctatgactttattttcaactttaaaataggctaccaaaggaattcattcataacagttaacatttaatacttttaagatgatgaaaagccatatagccattgaatttttcaaaatctaaatggttgcagtgactaagttgaaaagggcaacagctccttttatttattttttttttttaataggctgtttcacttgcagtggcttttgtgttgaagatgctgagttgtttcttaagaacacattttctctctgcttaaacttacctgctttcttcagcttgctgctaaatggcctgggtttgactttttgataactcaacatttctgataaatggaataatgtatattatctctttacaacttaaatctagctcatttttttaaccatattgtaacagaacacacaaattactttgtactcttgaaaaataaatgaaaatttttctcctgggttggctttattctacaggacttgccatcaactacccaaccaaaaggacgacaggtgaatagatatcctctatagaaacttctctaaactgagcagctaatagccaatcctttattaaccctttccatcccataatgtttgcattttggaccataacatttgagcattgagagcttgtaccatttcattttaacacattacacatgactaattctctataaagaatttttcctcacatctttgtagctgtaatggttattgtaatttcaacctgataattttatattaatggttaagaattcagcctttgggggtggctgtgggcctgcctctggcatgcaaaagaattttaaaggttataaaattcttagaattctaagactaactaaaaagttattcttaaaatgctgatgaacatttttaagcaaaaattttctgaagttgaaagctttttcttaaatttgtatttgcatgtgtatttctaaaagccatttgcaatgaaaaataagaaaagaatataaattatcttagcttcacatcctgatatacctgtgttagttcaaacatgaaaagttaagtgctgcctaacactggcaagtaactttcaaattgccagcactttagaggtatagattttaaatgcaaatgcagagacttgtaattttataggctggattgctgaaaataaacagaaaaatcacacagtggttccaaagtcttcaggttggttttacagtgacttaaacattaatattcaattttaatttcaagagatagaatttttatgggatttttatcttgaaatatggtattaaaaataatcagatttagtgttaagatatgtataaattagtacctgatagaattcacccataattttgtcttaagactgtataattgatggaacattgggtatgaattaccttatcttaaagcatttaaaaaataaaataattcataaaatgctgccatataataaacccttgaatgctaatctatttcctaagtaaactcacatatcataaaactcagagccttgaactatgcatgtcttgaagctctgtgctgatttcaagtgttacattgggggaagctagggttcaaattcatttttattctctcagaagagtaaaatacaaacctaaaacctaaattagaaaaaaatgaagctttttttaacttttaaaaaattgtttgagttacacttaactttatcagcaatgtgtagacacactgccagttgtcatataagcattctacagcaagataccaacccagagttcttgctaattttatatcgtgtgctgctttagggttaaaacctatcctgactgctagtatttatggcttaaaggctgccacgcagtcatgacaacgtatccataatgccagcatcaccaatgcaggtttaaaaaagagcgagcatacttttctataattagaggcctattctgttacagtaaaagcataaattaagtctttatttttattaaacaagtatttcaagtgttccttccaaataaaaacagcaaagttttgaagctatactcatcaaagattactagtacattgtttctagcggtagaagttttttgtgtcgtatttccatgcatcgtttttgctttcaccatctgatgtcctgtttgtattgtaactgttggtgtgtggttatgacattagagctaacttctctttcacatcactatggcatcctttcttacgaactcctgttttatagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggtatgtttttatgcgtgttttgctttgcttggttataaaaacaaagccctgaccatccattttccaattttatattattttagagtgtaaaacctgtttgatatattccttcctttacgagccaaacaaaatttaaattagtcatccaagaattctatatcttcagtatctagtgagatcctagttgcagagtcagggcttcattttacacaaaaagaaaggaaggtctggaaagagattggatgagcagccctgagccaagtcatggtctcacagcagagccctccactcctatatgctgttataattgttttagaatggcattaaaaaaatgtacgttctccttgcccttctacatgctttcatgcccatcccattcccaccaccagcaaaaaatgtaggtgcagtgcttcagtgtcactcagagtatttgaagataaaatgtatttcactgttagaaggaggtagtcagaagctttgttctttaccttgccagtcctttaaaaataccttttctgctagaaagtttaagccctaaaagcaggctaaagttaggggttttaggcactgtttttaactgagagaaaaggagtcacagatcactgtatattttgataaaatctatttctgctattattgttaccgtttccttagttgaactgtcttttggaaaatattgatggttttacctttgttggtacttgggcaatataccagattatttctagcacaaaagagataatgtctgagttttgtttcatgtggcaaaaaataacagccattaagcatcctgccagttcctcctaaaatacttgaacccagctaaaagagaccaaagacattgagtccatagaaatttctacctgcttttatctatttttctcactagttaagagatttctcagttaatctcttttgcttgatcgcctctttcagctatcccatgtttccccaaaaaatagtattaaatttagaatgttggagctgatgaggacttcagatgccatcattttatacataaggaaacgtgggcccaaatggagaagcagcagccttccatctggcattgtctttcagtctgatcttcgagaaacagttcaagcataagcaggaggaaagcaatctttaagtcgttgccgtgatgatgccattatattcttactgatatttacattttacagaatgtcttctttaatgttaccatatattatgggcatttattgaaaataattgtgtagattccagacctcttctgcctagtcagatcatctatataaatgtttcaccaatttctagaactctgagtcctctggaggaatcctgagtgatggcagtgcaaaaagcagatttgcttcctatttcctgtaatggtggatgagattatttggataaatcctcctgatgaaaaaaaatgaaaagtgccgcagaaaatatgtttttcaaatgaccttgaaagcactgaatagctgaaaaggtatcaggggccaggcatggtggctcacacctgtaatcctagcactctgggacgccgaggtgggcagatcacttgaggtcaggagttcgaagctagcctgaccaacatggtaaaaccctgtctctacttgaaataaaaaaaaaaaaaaaaattagccaggtgtgatggcaggcacctataatcccagctacttgggaggctgaggcaggagaattgcttgagcccgagaagtggaagttgcagtgagccgtgatcgcgccactgcactctagcctggacgacagagtgagactctgtgtccgggaaataaaaaaaggtactggggagctcagtgaccaattttttttttttttttttttttttttgagacggagtctcgccctgtggcccaggctgcagtgcaatggcatgatctcaggtcactgcaacctctacctcctgggttcaaacaattctcctgcctcagcctcctgagtagctgggattacaggcacccgccaccacatatttttagtagagacagggtttcaccatgttggccaggctggtcgtgaactcctgacctcgtgatccacccactttggcctcccaaagtgctgggattacaggtgtgagccaccacaccaggcctcagtgaccaatttttatgtgaaagcctttaataagaatgataagtggaatatcagagttaccaagtggcccattttgcaaacagggcatttgtcattactgaacacttctgtgccagagaaccaaggttaagatctaaggccagtacaagttggggaatctgttagaagaccctcctcattgttaggagtgcaagaggcagtccccccaggctaaaaggaaacagataagcatacccttatttcccttcaacaccggaggactatagagaaagctgccttgtcactgagcaaagcaaaagatgaggaaattgggaacaaacttccaaattgtggccaccagtccaccttgaatggatttgcacccaggtacacacagcctggggcagccaggggagctgaagccatgtacttgatttgaagtttcccctttctttactaatagtttcagatgtatggtataaacagaaagtctctgaaggcaaacacttttatcctaacccccactaacttcatcctatccgcccgacataaactttttccagggcagtagccagcaagtcaaaattatcaggcacacaaggaaacaagtaagacccaacagaaatgacagatagtagaaacaaacccaaacctactgcatatattggaattaagagacaaagattttaaaaataagcttacgaagttggttcgtttgtttttgagacaaggtattgtgctctcgcccaggctggagtgcaatggcatgatcatggctcactgcagcctcgacctcctggacccaagcaatccacccacctcagccttcccagtagctgggacaacaggcgtgcaccaccacacccagctaatttttttctttttcttttttttttttttgtagagatgaggtctcactatgttgcccaggctgatctccaactcctaggctcaagtgatccttccaccttagcctcccaaagtgctgggattacaagtgtgagctaccacgcctagcccaggtttttaaaaatcaataataagcttgtaaaatatcttcagagagcagaaaaaaaatgttaatgacatagcagattttaaaaagaaccagaggaacatccagggggaaacatgcagtaacaaaattagaatctcagtggtcacacctattagaatggctaacatttttttgaagtttcatcagtgggtaaatagatcaataaattgtgatatagccatacaatggaatgccactcagcaataaaaaggatcaaactattgatatatgcagcagtatggatgaaacacaagatcattatgctgagtgaaagaagccaggcaaaaaagagaacacgctatatgattccatttacataaacttctggaaaatgcaagatgggggtggagggagggaggaattacagaggggcatgaggaaattctggaggtaatgaatatgtttttctttttttggagacggagtctcgccctgtcacccaggctggagtgcagtggcgcaatctcagctcactgcaacctctgcctccccggttcaagtgatcctcctgcctcagcctcccgagtagctgggattacaggcgcctgccaccacgcctggctaattttttgtgtttttagtagagacagggtttcaccaggttggccaggctggtctcaagctcctgacctcaagtgatctgcctgcctcagcctcccaaagtgctaggattacaggtgtgagccaccgcagcacccagccatttttattttttattttttatttttattcttctaaagtcaaggtccctctctgtctcccaggctggagtgccgtggtgcaatcttggctccttgcagcctggaactcctggattcaagcaatccccctatctcagcctcccaagtagctgggattacaggcgcccgccaccacgcccaactaatttttaaattttcgatagagatgagatctcactatgttggccaggctggtctcgaactcctgacctcaggtgatctgcccgcctcaacctcctaaagtgttgggattacctgtgtgagctaccacacctggctaagaatatgtttttcttgattgtagtgatagtttcatgggatgtttacagatatcaaaactgataaatttgtatactttaaatatgttcaatatattgccaaaaaactgaactgttaaagttgcaaaatatatagagggagaaaaggattctaactgagatgataagaaagaggcccactgggcagtgtgtaccccaagacctgaataggactttgggggtataggaagctattcctggcagaagagaaagatcaattttcctttgcttggaaactgaattggcctctgggatgtcagtgggcatccaatactaacaagaaagatttgaaacaattgtatcagccagacccccaaaactttgatcaaatatattgctaccaagtcacattcttcacattttctagatgagaaatcagttttttcggacccaaatgccttactctaggcacatcaatttagcccttcaatatattttagctcccggactctgtcatccctccccttgccttgcctacaagatcctgatctaagccatcaataaattggtaggcatgtgtttgaaatttccttccaggttgaccttaaccctaacacggtttctgtgcacttactgagctaaaagagctaatgtttatttctgcagtgtctggtaaaaatcaatttcattcctctgtcatcacaccacatgagactatgccacaattttttcctgggaacctgtatttttgttttaagcttaagaacatttattataagatactctctacattgtaacataagcttcacaaggtcacacgattttgtctcttaacctgtcaaaaaattcctcaattctgtttgtttccaaagattctatgccttttagttctgactaatagcacatattgacttgcaccaaaagaatccccaaagcaagcctttatcagcctcctctgtatgccacgtgggtaatatatggagatggactttgatactattactgagagttcgcagtattttccaataaatgtctttcccccaaccaaaaataaatacataaaaacttcagtgaacaagagcgagtaagagatatggaagacagcctctttaagaaaatagaaaataatacttcccaaatcattttatgatgtcaacattaccctgataccaaaattcagtaaaggcagttcaagaaaagaaaactacataccagtatctgtcatgaacacagaagtaaaaatcctcagcaaaatattagcaaattgaatccagtaatatattaaaaagataatatattatgagccagtggaatttgtactgggaatgcatagctggttcagcatttgaaaaccaatcagccgatccactagattaacagactgaagaagaaaatccacatagtcatatcaatagatgcagaaaaagcatttggtaaaattcaaaacccaatcagattaaaagtctcataaactatgaattgaggggaacttaacctgataaaggacatgtatagtaaacctacaactaacattactagaaagggaaaaaatttgcagatgatatgattctgtgtgtagaattcaaaggaatctgtagacaattagaattagtagcaaggtttagaaaggttgctgatataaaatcaatatacaagggactgggcgtggtggctcacgcctgtaatcccagcactttgggaggccgaggcaggcggatcatgaggtcaggagatcgagaccatcctgactaacacggtgaaaccccgtctctactaaaaatacaaaaaaattagccgggcctggtggtgggcgcctgtagtcccagctacttgggaggctgaggcaggagaatggcttggacccgggaggtggagcttgcagtgagccaagatcgcgccactgccctccagcctgggcgacagagcaagactccatctcaaaaaaaaaaaaaatcaatatacgaaaatcaattctatttacaagccacaagcagaaaataaaacttttaaagggtaccatacataacaccacttgcaacaccataatattataaagtgttcttgcacacacacaaaacaaaactggatctgattaggcctctaggttttattacctatttgcaggaaatacaaaggacagagagacatactaaagataccacagggacacagtcagaaaaatccagactctacagaaactaaaggacaaactagtttctacaacaaacaaattgtaagaaaagaaaaaggagggagagggaacctatagattttaaagggatttcagaagaaaactgtactcttggatttgttccaaaataatctatgataaggtggtataaataaagccaggcgcagtggctcacacttgtaatcccagcactttgggaggacgagacgggcggatcacctgaggtcaggagttcgagaccagcctggccaacgtggcaaaaccccatctctactaaaaatacaaaaaaaattagctgagcgtggtggcgggtgcctgtaatcacagctacttggaaggccaagacaggagaatcgctggaacccgggaggcggaggttgcagtgagccgagatcgtgccactgcactccagcctgggcaacagagtgagactctgtctcaaaaataaataaataaataataaaaaaataaaataagctatgactaataattgtcaaagcagggttgtagatagctgggtttcattacactatatccttgtatgtgtttgaaagttttagtgttacaaagtgtttcttaaaataccatttacaaagcctttattaaaaaatgaccaggcgtggtgactcatgcctgtaatccctgcactttgggaggccgaggtgggcggatcacttgaggccaggagttcaagaccagcctggccaacatggcaaaaccccgtctctactaaaaggaaaaaaaaatacaaaaattagctgggtgtagtggcgcacacctgtagtcccagctactcaagaggctgaggcatgagaatatgtcaatcctgaaaggtggaggttgcagtgagccaagattgtgccactgcactacagcctgggcaacagagagagactctgtcttaaaaaataaaataacctaggaataaatctaacaaagatgtcaagacatttacagaataaattataaaatttattgagaccgggtacagtggctcatgcctgtaatcccagtacttttggaggccaaggcaggcggatcacttgagcccagaagtttgagactgtcctgggtaacatagcaaggtccagtctctacaaaaatacaaaaattaggccaggctccgtggctcacacctgtaatctcagcactttgggaggctaaggcaggcggatcacctgaggtcaggagtttgagaccagcctggccaacatggcaaatccccatctctactaaaaatataaaaaattagctgggcgtggtggcaggcacccgtaatcccagctacttgggaggctgaggcagggagaatcacttgaacctgggaggacggaggtttcagtgagctgagatcgcaccattacactccagcctgggcaacagagcgacactctgtctcaagaaaaaaaaaatgggtgacatgcacctgtagtccgctacttaggaagctgaggcggaaggatcacttgcacccaggaggtcaagatgacagtgagccaagattgcaccaccgcattccagcctgggtgacagagtaagacttcgtctcggcgggggtggggggggaattatatctcgagacatttaaaaagatataagtaaatggagagacatactgtgtttaaggactggaagactcaatattgcagggatgtctattcttcctagatagatttcatagataagatgcaatcccaacagttttgaaattgacaagctaagtttaaagtctacatggaaatgcacaaggtcgggaatagccaaaatgctcttgaagaacaaggaaggaggtcttgctctaccagataccaagacttattataaagctatagtaaacaagataataaggtatgggtttagagatgctcaaatagaccagaaaggaatagagaacctgaaaacactctcatacgtaaatggacacttgatgtgtgacagaaatagcactgcacagcaatgaggaatggacaggcttttaaataatgtaggacaattgggtatccattaggaagaaaaaaggaattggacccctcctttacaccataagcaaaaatcagttctaggccgggcgcagtggctcacgcctgtaatcccagcattttgggagaccaaggcaggtggatcacacgaagcaggagttcaagaccagcctggccgacatggtgaaaccccatttctactaaaaaaatacaaaaattagccaggcatggtggcacacacctgtaatcccagctactcaggaggctgaggcatgagaattgcttgaacctgggaagcagaggttacagtgagccgagattgcaccactgcactccagcctgggcatcacaaggagaatctgtctcaaaaacaaaaaaaaaacagcagtactagtacattaatacccaaaatgtaaaagacaaaactataaactttgagaaggtaatattggagaatatcttctgggacaaggaaggatttctttttatttttatttattttttatttctctaaagtcagggtctctgtctcccaggctggagtgcagtggtgtagtcttggctcactgcagcctggaactgctggactcaagtcatcctcctgcttcagccttcctagtagctgggactacaggcacgtaacatcacacccaatcacacccagctaatttttttttgtttgttttttgttttttgtttttttttgtagagatagggtcttgttatgttgctcaggctggtctcaaactcctggcctcaagtgagcctccctccttggcctcccaaagtgttgggaaatcccctgctaaggatttcatttttgttttttttttttttttttttttagacaaggtctcgctcggttgcccaggctagagtgcactggcataatctcaaatcactgcaacctccacctctcaggctcaagtaattatcctgtctcagcatccggagtagctgggactacaggcacatgccaccacacccagctactttttgtattttcagtagagatgggatttcgccctgttgcccaggctcgtgtgaactcctgagctcaagtcatccacccgcctcagcctcccagagtgctgggattacaggcgtgagccatcgcacctggctgaggatttcttaagatatcaaaaatacttcccattaaagaaaagactgataaatttgactaaattaaaactaataagttgtgttcatcaattgataccataaagagagcaaaaaggcaaaccacagagtagaagaagatatctgcaacacgtatattaataactaacaaaagcataatatctagactatataaagaatttctacaaatctatgagaaaaagacaactgaacagaggaacggtcaaaagacttgaacagacacttaacgaaagaggaaattcagtagccattaaacatatgaaaaaatgatcagtcttactaatgagtgaaacgtaaactaaaatgtaaattaaaaacacagtggtattccattattcatccaccatgatggctaaagttaaagacagataataccaagtgttgccaaggaaatggaacaataggaatgttcatacactgctggtaggagtgtaaatcagtacaatgtcattgtaaagcaacctgccatttacaatagcaccatatggcattctgatcgtgattttggactcttatatgtgactcacttggggacccttggttggcccccatgagcaaaatcattaggagagcaaagtcttctgtggcaatattctgaaaggcaagtatttgtttagactgaacctgaaagagcaactttttaatatcatctttatgttaccaatgctggatattatagatcaaaattataatttcctgattgtggttataactgtgaatttaatcagagcacactttttatatcttatcttagaatctccatgtagcagtagtgccatttgttaagcatatactgtgtgcctggtactgtactagggacattatttacattttttgttctaaacctttacaatagccatccaaaaggctccaaaagtttaaagacactgcggatagaatattctggctaagatcatgagctctggtgccagaccttccccactctttcacttattagctgtgtgatttggggcaaattgcttaacctttcattctttcaatcccctcatctgtaaaatggtgatgcaattccctgtgttgttagaaagattaaaggagttaatacatgtaaagttcctaggaaagtgtctaacattaagtgctcagtaccagctaacaagtgacaaagccagaattcaaaccaggcctgtgttgaaacattctactgtatctcatggccacatgtttaggcatctaatctgagttgtcagtatatgttcaaggaataccatgccattttaatataagcctatattttaaaaacatttctaggaaattgtcatgaaaaccaaagaatagcctttgtccaaattttttaaaagattaggatgagtatggttatgctgttttatataaattcttcaaatggatgactcttctattttatcaaccagaattataaattcattttattttatttttctttttgtatgtgctaggcgagtagcttgcattgccatggagaagaccaaacaggagcagcaggccagctgtacttggtttggcaagaaaaagaagcagtacaaagataaatatttggcaaagcacaatgcaggtagggaaaagcacaactgttactgaggctgggttaagcatctccaagacctaaaaagatgtaatattttaattcagtcttcagtgttctctatccaaaaaattctaccatatgagatcttcatcaactttcaaaacctttaagaaacccctacctccaattaatatgttgattatttgctagatattttacagagctatactttataggacaaaaatgttattttgaaatagtatcctctggaatgaaaagaatccaacacgttaagtcctcccctgagaaatgaaagcttgagagtttgctgagtagccaggattcttatctatccttggctgggattggtcttgaacagatctcctcccgcctggctcctgcctggcccttgggcgtggccctgagataaacatctgagggtagaggtgtgctcttatcagagaactgtgccacaaatggttctgtggttggtttgagagagtacaaatgacatggacactaacttggttttgtccatttctgtgagtcgtcttcttccctcatggtatttccaagctaccacaagagcaagaatcttatcttggccttccctttatagtatgtatgtttgcccatatggaagtttgtattcaacttaagtcaaaatgttcacttgtcttgttgaaaactggaattaataccaaaaaggcatgatctgttgttgcaatagaatccccagaagattcacagggtgcaacttaagctaaagaaaatgcatggtgatacacaggagtgctaatacaagaagttattttcaataacttcttaatacaactccttttataaggaactttttctgaggaattgaaagtcctgactggcattaggttagttcccaaggtttcagaaataactccaaaaattagaaatgtggcccaaaaaatcaagtgaatctagtcatgcatacccagattgatggcataatgtttctgacaagtatgaaatgcatttttctctgtaaatgttataacgtactctgaattgttcatttctcaatcagagattaaaagtaaacatttcaaactgctgtataatgtggaatgaatgtgagtggccacatgggttaagtttaaatggctcagttaaataaggaatcattcccttcgcattagttacattgtaccacatttttatttccaaaaacagtgtaatttctggttatgtactactacagagcagtagtttcataatggcttttttggttttatgaagggaagaaataaagcagactagttacacaaaatgtagcaactgttaagcaaatgctcaagtatactatttgaagaaatgcactgcagagccaggcacggtggtggtgcctgtaatcccagctacttaggaggctgaggcaggaagattgcttgagcccaggagttcgaggccagcctgggcaacagcaataccctgtctatacaaaataaaaataaactaaatagaaatgcacagcagtatcagcagaatgttgcttcacacaaaacgtcagtggttattaccaagtctccttagttgcccttacttctgtcagcttctaacagtctaacacaatctaataggctcacaaggagatgtgttgacatataaattgagaaatgtatgcatctcaccttgtaatttgtacagcagtgttaaatgatacatagatatagatgggattgaaattaacttacacctagaaaagcaaagaaatggctggttcaggctgtcagtttatcattagatttatgctgtactaatagaggtcatgtaaacatgagtattcagtttgccagtattctttaattcagctctgaggaaagtaagaaattcattgaaaaactagaattctctaaatgctgtcaaagagtcaatttaatcattaatttaagaattttgccagagaatcagcatccgatctggcagccagtgttttcactttttccactctttcaccaccagggtatcactgatcttcttccattgctcccattctctgattcccgttagatggtgcacagtggtcctgcaaacacacctgtaagcttaataggcagctggagataggaccaggaattagcacacctgagtaaccgtgcaatttgggcaaatcacttcgctcctacgggccttgaaatgagggaattaggttagtcaatcaaggagatcttttctaattctaaagatcagtgggtctcaggttctttcatcactgggcctgacaaatggcgatcattcaatgaagccaagtattcttgtactgtctatctcaggctcttgctctctggtagacattgcctatccaggttgaaagctatcacccttgacatagaaggcaggagcctaataggggtagaacagaattgctttttcctctgtcttttgacatttacctcctatcccaaaccattgacctctcttaagttcttgtcaacttagaatgaagaaaggaggggttgagaggacaggggagcctactgccaccacctgtttggtatcatcagtattttcctaaccagcggccgtctgggcatcagaaccttccttgccatgcttaaggggttgttctacatgtcagtgtgtgtcactgtgtataaggccctcctttgaaagaaagtctgagcttcttagatggtccttgcagagccccttaagtgtctttgtagaactttgtgtttaggcctatttgtgattctctagtcaggatatcattgttaggcttccctcacctgcaaaataatcactgtgagctctctttttagtttctctttttgggagaagattcccagcttttttccttgactttctgaaatacactgcctgcaaagcctagcattcctttctgtcaccatctcttcaggtttcttctgtgtcatcaaccaactcttccattttgttcattagaaagtccagaagaaccatttgcttagtattacctttgctttacaagagatcatagggtcaagtatttaatcagctgttctgcttttagctacgatgaaaggtcatcccaatatacagaagtgtccttataaagaattgctctaaaagagtgagaaacaaatactcttgacttccattggtgaggcagttgctttgagaacttagaaatatcatagcctttcataccaaaccagatgggctcatgggccacagatcaaacaatatctcaaaaggatttttctggcttttttagaagttgatggtaaaatacagtactctgttcttctgttactactcagtaaattaaaataagggctgtatgttttgtttcctgcttcaaatctttgagaattcatcatatattgatggcaagatccaaaccttatcaagttctgacattatttgtatttgtggtacaaatgaaggttgggaattttgtcattatctagaactggtgggaatgataatactagaattatttccatttttgtcgttaggaaattctacatagcttgttaaagtggaattctgttcaaactgtgttacctacaactcccatcataaagtgacagcctattcgctgaatttgacccataagtaaattttgtccctctaactcccacacacacagtgtttaagttttaataagtcatcacgtgtgaaagtcaggatatttaacataaaaatttgggtttcagagttcccttagaagaacaaggaatgcagcaataccaggtccactttctcttttagtaactctgggtggttaatatggcctttgaatggacgctcattctccagcacacactgtccgcaccactccctgtttttgcacctggcccacttcattcaaccacattagctacctgacccctgcgggcattcaagtatgtactccttaacccaatgctaccagtgtgcaatgctcttttgaattggaggtctttatagtatttgaagatcttgatagtgtttccagctgagacaaggattcaatgttaatggcttttttatggaaaaaattcaacctggaaagtagttacataaatacttaaaagaagtgtctggaatgttgagtagtttagcagaaaatcagggtaatatgagcaaactatgctagacagtatttctgaatccttgggaatagatttgattatggtgtgtgtagcttttacagcaaatacattttctgtaacatacagaaggtttctagccatgtatacttggtacaaaaagcattgtggtgtggctggaacaactgaactctagaggcattgagattcctcagcccccaggacttccaaaagtcattttagatcaagttactagtgtaaactttttaaaaatgtaggaagtcttcattaatttggtttcttaaatgttagagccccgaaatactctatttacatacacatatttgaacataggggatttctacagtaccattcataggtgtgcttaaattatgcttaataccacaaattagtactattgactttaaaagctattcttttttttctggaatacaagcaactctaaaggaaacaaaaagtagcccataaactcactgccctgttggcattaaaaataataataggctgtgcgcagcggctcatgcctgtaatcccagcaccttgggaggccgaggtgggcagatcacttgaggccaggagttcgagaccagcctggccaacatggcaaaaccccatctctactaaaaatacaaaaattagctgggtgtggtggcacacgcctgtaatcccagctacttgggaggctgaggcaggagaatcacttgaacccgggaggtccgcggaggctgcagtgagccaagatcccaccactgcactccagcctgggtgaaggagcgagaccctgtctcaataataataataataataataataataataataataataaaagtaataggcacacatggttagaaattacacatggtacaggaaggtacaaagtgaaaagcaaaaggcttccacgtctacactctctgaagaggttttcttgtaactattctcgataaaatgtctatgcatatgctagtatataaaatccgctggcttttatataaggatattgtcgaatttctattaaaatgagtttgtttcttaatgtgatttatttgccttgtgtttagaatattgcatgataaagtttattttatacatattatacttttattttactaatatatgaaaagccatatttcaatgacccctgtacatttttcatgctgtctcactcccaatggcctctgtgcatgtaagtaacctgttgaatgactatgcctctgtgtttttggtggttttcttttattaagtcctttttttaatcagcaagcaacttaaaacctttaaaagctcattctttaagtgctttcctaatattatttgtatctcttattttaaaataccctttttttattgtttctcaaccctatgaccgtgtggcaatttcatttagaccagagtaacctcttcatgctgctcatttatggttaagatattgatgtttaacatatctgtttcatttcattttcataacatgtctgtttgtggttttgatggttgacatctaactcattcttatgtgttttttaaaaaaatgacaagtcttaatttggtaggatcacagttagggctctatagagggataggtgtgtgtatataccattcggaaagcttgtgtcatcatcatcatcttgctcttttgtgagatgcttgcttatttttattaaaatatattaaaacatatctgcttgtcaatgcacttcttctgtaagcatactttttcttgatggaaatatcactcagagggcaataggtctaaaaaataatgccatcagcactcctgcttttatttttgcaactctcatcactccattactactgcagtataactaactagccctaccacagagagcctcatgttcattttaattttgtgagtctgccattctgaacacagaaaacatttcttggtttttagctattgctagaggatatgctttaaagactttcaatcaacctttataaatcaagttatcaaaagaaaacaaatgtgcaaaaacccattaatatacactaacctctattttaatatatcgtgtttctttttttatatattgtgataatggtgctttttgtttgtttgtttctgttctattctattcccaagtatcttattttgcattttaagtgattgggcaaatcactaatgttaagaactaaggtgatattcacagtcatttggccatagtgtttctaggagtagaaggttctcttaataaatgattggctaaagtaatgcagatttcggccgggcacgatggctcacacctgtaatcccaacacttcgggaggccaaggccagtgaatcacctgaggtcaggagttcaagaccagcctggccaacatggtgaaaccccatctcaacaaaaatacaaaaattgtctgggcgtaatggcaggtgcctgtaactcaggaagctgaggcaggagaatcgcttgaacctgggaggcagaggttgcagtgagccgagatcgcgccactgcactccagcctgggtggcacagcgagagtccatctcataaataaataaataaataaataataaagcagcccagattcctttattacatcatcaaatcaattttactgaatttattttaacccctctaaaatccagggtttattcaatattctttaaaaaaagaaatgtcagtatgtaactgacagcatttgggtatgaccatacaaaaaatattacaggaaacacagacatacaattttagccctttgtgagaatttccaaatgtgtgtgagaattggaccatgttgaatttcaacaggaatgggcatctgctcaggaaagttttgtacattgcttgaaattgcttttatcatagtgttaagaggcaggtttcagaaaaatatttgttaaagtatttctcctcagtctgtagtgattagagaactccacttttgcaaaggtttctgagctcagactctgcttcatgattctttccatcctgatccaccatacacaggctgcccatgtaatgggcgacaagttttcaggcccaggaaagcatgtaactctccttacatattcaagactttccattgagtggatatctgggttacagtaaagcttgtgagatgctcattgataagcttgtgcaatagttacagaacttgccttagaatctagcatgccaccttcatcaactctgttgaaagaaagaaccatgaagttaaagaccagctgtccatgcatttctcatccatctctagaaatgatctagctggcccctctcctggttaactttagttgcattcatgctatattcatgttggtcactgtctgtagactttttctttttagtattgctgacttcttagaattggaaaaatatgaacagcatgtggtttcaaattaattcatatgatttgttggatactacatgaaaagatatgtagtatcttttagatttggacattttaatgcatgtgttcagcatctttggatgcccctggttctaaagagcattttcatgggcttaaaaatgaaaatttctccctagatgctatatgacttaaattacatgtaagccatatatcataagttggattcatatttttaagacatggttttaatataactgtagttttgccagtaaaattataatttatgtacatgaaatagtcattctacaaatttacctttcttctaaatctttgcgttttagtgtttgatcaattagatcttgtcacatatgaagaagtagtaaaactgccagcattcaagaggaaaacactagtcttattaggtaagtttgattgtgtaagtgagttgcttattctcactttcaaaacattttgtgaacattattaagagttgtcagttttaacattctttttttctaaatgacataggcgcacatggtgttgggagaagacacataaaaaacactctcatcacaaagcacccagaccggtttgcgtaccctattccacgtaagcaatgtctcaatctcttttcattatatttttcctatcacttttttaactctataatttatgtatttttttctgattacataaggtataactgttcattgtaggaaatttgtaaaatcaaaaaaagaacaaggaggaaaatgagttaacagtaatcccaacccctctttccctataataagtgctataaatattttgttgtatacccttctaggcttctctgttgtatacccttctaggcttgtcttagtacagatatgtgtataaagtgtgtgtgtgtgtgtgtgtgtgtgtgtgtgtgtgtgtgtgttttaaataaaattagttttatccattctgtttgtaacaatttttctaacaatatgtcatacacattacctagatgaattattcttcagaaaaataagttttcatagttgtacagtttctgatatgacaatttttttcccttagttaatatttaaattgttgatttcttaccactttttaaacccaatcaatatgctaacagttgtttctgtaaagattttcaaatctgtaagatttttaattctccttattttccgtatcttattcttaacctcttgccctcttcattttctcaattgtaaaatgaagtaattcaggattgcagagaggatttgagatcatgtgtatgaagcacttagcagatggtggataagtagaagctatctaccactatcatttcattattatcatcattattctaaagtttaaaattttaggccaggcgcggtggctcatgcctgtaattccagcactttgggaggctgaggtgggcgaatcacctgaggtcgggagtttgagaccagcctgaccaacatggagaaaccccgtctctactaaaaatacaaaattagctaggcatagtggtgcatgcctgtaatcccagctactcagcaggctgaagcaggagaatcagttgaatccggaggtggaggttgtggtgagccgagatcgtgccattgcactccagcctgggcaacaagagtgaaactccgtctcaaaaaaaaataaataaaattttaaccccagaagctttctagcagctcagggttggaagagctaaaggaaaattattttttaagagcaacaggagaaaatgtgaagattggctccattctatagggccttcacatgccttcctgaagcaatgtcaataccacttacagttatctgtacacctcagagagccaggaggcttcatgagaaaaccttcatcccaaaaccttgtctgatttacacaagaaaagaaatgtatccaatagtgtctcatttggcactactggggttttctagtaaaacactttgaagtgttcttttaattctccttatgtctagatcatgagtacagcaagcttagctaacatttagcttcttcttaaccacgtaacaactgaacttccatgttattaaatggccagttaactagtttggttttaaaacttacctttgatgatgtcaatcatgactagtctttgaaatatttgaccctgtatgtgtatataacatatatctaactactgagatgactgaagatagtacaacatcaatatgttatgtaagttcttggctgggcgcggtggctcacacctataatcccagcactttgggaggccgagatgggtggatcacatgagaccaggagtttgagaccagcctggccaatgtggtgaaaccccatctctactaaaaatacaaaagttagccgggcatggtggcacacacctgtagtcccagctattagggtggctgaggcatgaaaatcgcttggaacccgggagctggaagttgcagtgagctgagatcttgctactgcactccagcctgggcaacagagtgagaccctgtctcaataaataaataaatagtaacgccggttcttcagcttttgatgtgcctagagaaagggcttctcttaaaatgtccacattttgatgaccacgagcactttatgttctaacaaacaggctagcaggaaagggggattccccattagtttaggctcatgtatacagaagagagtagcataaatttgttctttctcaaagaaagaaggaagcaaagaaattgagagagagagggaaaaaaagggaaggaagggagaaaagaaaggggggtagggagagagaatattaaaaccagtgttcctggctcatctagaaaaacatttcctaaagtgtgttttgcaggatactggtcctattagtatccacagaactagagcttattggcatatacttcagttacactcacttaggtgaggggtgggcaagccttttctgtaaaggaccagatagtacacatttgaggctttaaggccatacagtctatcacaagcacttagctctgctgttgtctcatgaaaacaaccataggcaatatgtaaacaaaagcacatggctgtgttccagtaaaactttgtttacaaaaacagacagtaggtggccaggtgcagtggctcacacctgtaatcccagcactttgggagactgaggcgggcagatcacctgaggtcaggagtttgagaccagtctggccaacatggtgaaaccccgtctctgttggaaatacaaaaaatagctgggcatggtggtacacgcctataatcccagctgctcaggaggctgagggcacaagaatctcttgaacccaggaggtggaagttgcagtgagctgagatcgcaccactgcactccagcctgggctacagagtgggactctgtctccaaaataaaaaaataaaaataaaaaaagacagtagaccatgtttggcccataagccagtttgtcacctcctgatttaggtcttccataataattatgggtatgtctggccacagtcattgtgttttcagtgtaacgtgtcttttgctgtatcctaacattctccttttgcaagatgttatagaacatcacttttcaatagaactttctgtgacaatgacagtacttgatgtctgtgcagtccagtacagtggccactaaccatacgtggttattgaatccttgaaatgccactagtgagactgagaaactaaaatttgaattttatttaattttggcttatttaaatttaaccatatgcagttttccatttttttattctccttttttccttctacacaagacccaactgcattaaggcatacagtgagttatattaatcttgggtcatttcacgtcttcctcctgtggtggttcatgaagggataaaatacatctcacctgaacactgaaagtttcaccaaaccagacaattcactggctactatggtgtgatgcacacagataaatatggtttctagaatttagttctgcaaagccactgggggtgagaacaggggatatgagatatacgctaaagaatccacagcttttaggaagagactgggtttgagtaaatctgttgggagtgtagtaagctcatcagctcagccttttaaacctcttgtgccatgcgactttgcagatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggtaatgcccagcctccccgaatgtctgacatcctgcctgcatgccaataagcacagattctgaaatcaaaaatgccatcagaaagtcacaggtcacataataatttcataaaccacagaaaagtatcagtaatggaggcgttgggggttcacagtctagaatgccagctgactaatcgttggactcagtgcacacaccatgtatttaagaagcagagattattctcttaagaggtttattatatgcagaagctcagtaaggttcctgattgtgtctacgcctgccagaaatcctacgatcatctgacctcaggatgaggctctggcactttgttatcacaacagccaccttccctctctgggtacagctcacgctggaccatcagagcctctaccagcacattatgttaatctccagtgagaaactgatcctggggcctgggtctgaaacacagcactagctttatgaaagcaagcatgagtgagcccagatgtcagagacagcagggatggaaacccatggtggctctcagcctctgccatttccttacctgagcacaatgcctgaccctgagcaaaaactaggagagagataaagacttggaagaggactcaaaagagagccagacacagagatgatgaaatggtttctagatatgtcttgcagtaggaattattaaacttgaaaaagagaaagctgaaggctttacatcaaaaatgctgacaagctgttttttcatctctgagtacaaaccaagtagatatgggaggcaaagtatagtaggaaggatttgggagttgtagacatcaaggtgggttataggagaggcttgtgggtgccatgtgactcctgggtctgccatttctaggactgatctgtaccaaatctcctttaacccttagaaatagaaccagtatgctacctgctgaaatagtagaccagcttccctcaagcaggctgtgtttcatcaggaggcttacctggctatcttaggcagggcgaatccctgttcaagggccactgtatgagacttggtcccctaaccatccctaaagcaaggacagaacctatatagccagagtctgtgtgacctgggacctgacagctcagtttctgggctccaggatcctaattcgtggccagtgggttcacccatttccgtttacaacacctgatggggttcttgaacttggaactttggaaaccacaaaaggatctgttcaaggggctagggaggaaagcagcagtagggtgaacactgccgtttacttaacaattaacttggacctatatagaactaaatatatgatgtgtaccacagattgatttttgtttaactactaatccctccttactagggattggaaaaatcttctggccaggggtggctagaggcaaagtctcaatcctggtcctggtcttcgacatcctctccttgggttccacactggtcttcacctgaacgtcgttttctgctggtagtaatgtctctagcagtatgctggctgcagggctcctcagactccctctgcattacctaagtccactttcgagggctttctgccttacctgcctccgctgctgccgccgccaccgccactgctgctgctgccgctgctgctgctgctccacccatagcgtccagctctccctttctccttgcccttgcacagccatgcattgctctgcactgctgagtgggagacacttctctcagcctcctcaggacacccacagcagttacttttacccattgcacttggccccaaagcacctcctcaccccggctgggcactctcctctgctcccctgagtgctggatgagctcacctgcactcttctctcctgcttcctgggtccctgcctctcagaactgtgatctctcagatccacctagccctgagggccggccataggcatcctggctgcctgagtctctttgggccagcggccctggggatagggattgcccaggtcctgctcctcctgttggtctggttgactacactggtcccaggccctcctgcgcaggccagcctcatgccagtcctggtctcacaatgaccattgcataccacagtacagctgagaatgcccgcagtctgcaccgactgggcttcactctcgggcttctctgccctcagcccagtctctcctcagctggacaaggccttcatcctgccttcaggatacccgtgaccatgaacaacttgctttcaggcagagcctcactgctccagggaggctctctccttaggacatttttctccatccccctttcccactccagcttcttagatgacccctctactgtatcttacagacaatttaatccaacaaacttgtattaagcccttattatatgtcaagcacagggtcaggagctaagaatacaattcagaagacaagatggtgaggatgaaattccttcctcattgtacatccaaaactgtccataacagaagggccttgtggcattttttagaatcctctcacttctgccaaactacatgtggaccataggaaaaccacctaacacatgtccagctcttttagtacaggtctaatactttatgccatcttatttcagacaactgaggcccaattgagcacgtctaataatactatatgataagatgttgtggtccaactttaaagctagaggatgatggtaaagacattaaactagaaagaaattaataacctagcttctcataaaatagtaatagattatgttcttatagtgctgtatattttgccaggcgttatgactccttacctaatccttgtaaccctatgagctggagatcagtatctagttttgtagatggagaaaccaaggcttaacataattgtgactcgattaaggctttacagccaattgaaagtgaggtgtgaagttgaactgtgttgatttttaaatttttattcttttacagtaaatccccacttcctttcactgtaccaccctagaagaggtaaccctgggaatccttaagatggttcaccttatccatagtagtacaatgtaaagcctcattttttcttaacattcagaaaaatctgtaattcagtcaaacctaagaaaagctgtagaatttatttctcatgaaaataaagctatggctcagaaaataatctgtgcccctaaagctgaaactgtaatagccccagtgtgtaatcagagcttaatgtgatggttttagattttaactttattctgatgtatccatttgtagcatgaaaaagttaatagtagcagaatatttgtagttttgcttttgcccacagcggaagaggtcatcatcaagaggcagcatacagtcttgttaggaatccatactttaaaacaagagccaggttctgaaccagagactattttgtgaaatcagttatctctcttgagatgggttctggggtcactgcactcttcctaaacccttagatttttgtacaaaatgactcagatgcttgcctctgtgtgccttttaagtttgcaaaccagaatagatatctgcctcttatacacttgggtcaaatgagtttctattccttgaggataataacctgagattaattattggccatagccaagccatagaatcaatttatctccacaaatgttagattaatgttactttgactatctgaatctagcatgctttcagtgatctttctagagcgtgctctttctctccctgtccatatctgtccctgtttctctctctctctctacacacacacacactctctctctctctctgtctctctctctgcctctccccctctctctcactctctgtctctctctctgtccccgtctctctctccgaatcccagagagattcggagagaaatatttgcccatgaacattaaaaaatgtgtgcctcatcctgagtcagaaaggaagagggtttagagttcatctttaagtcacctattaactgcctgagagaggggaatccttgtgagcaattccatttcctgtccctgaagtaactctgaacctcagccaggctaccacagcaccaaaagtggcacccacttgagacccgtaagtagtgcagagtatggcccaaagaccttcaagaacaagcgaggaaatgtgtggtgagtctgctgaaaatatgaggctgactagacaggaaaatctcaatcaggatttgaggcatcttagaatttttgaaagtacaataataaagtatagaaatagaaaaagctacaaaaaggaggagaaagcaaatatgctaaccacagggctactttagttactgtgataaacattaaatttggctctgaacttcctgacaaccagggcaaaaaaaaggaaatcaaggaatataacctgattcgtagacataagaggcatttggcaatgtgaggaacatggccaccattgatggttttatgcagtgagtgcagtctatggatatagaccaagggtgtgaatgcagtgcagagatgggcaatctgcaggaagctaaactaatgttccaagcagtttgttttctgctgttgtaatgtgatagctggaatggaaaacatgataaggactgggtagctggcaggctgggccactgagtgcagaaaaaaaccatttcatgcccagggtgtcattctctacttcatctgtgggttccgttcagcatccaggctgggtggacttccatctagcacttagagtagctttggggatagaagcaaataggattctttcccatctcagttgcccagaagcaggctatgggatgggtatatgtgtgtgaccgggagtaggggtgatgagaaaaccttgtctcagctgaccctgtattcacctgatctatgagcataggaaggaaggaaaaaaggcctaagataatactgacataaaggatatttctaagtgaagatccctgttagcttgcttgagctatatatggactttgtcataatgtttgttcctggcttaagtcttcagccacaaaaggattggcaaagaaattgccagttacctctttcaaaaattaacatatgcaagcttaaagagctttcttaccagaagaatcagagcctaggactttaagagttaaaaaactttgatggataaatacaatgtaccagtctccctcaacccacaagaagatgctgtgtgactaaaattcagaaatataatcctagtgaaagccaaccttgcactaaaaaaagaaagaacctttcatgtcaaatttgtctcttacatgcctgtatacacaaagaggctaagagagtcccttcagccaagagagtagagtgctctgtagatgaacctgccttaaaagacaagataaattctgtgcaaattatatctactatttttacattttaattttttcataagggcagtttatgctgggtgccatattgggcatgagtgagatagctgaacaagacacagtccctcccttcaaggagggtacccgctagtccctggggtcttgggtttcccacgtgatgggtacttcaggagcacatgggagggtctcagagctcacaaaggacttcccaaagaaaagagcatcagtactgagttctgaaggattactcagccaagcaaaagagtgagtggggaaggggaagagaggatgggaggttcaggcagagggagtagtaaatcaaaaggccaggaagccagagagagtctggccctttctggaactgaaagtagttcaggaaggctggtccatggagccaaaggagcagagagaaaggctgaagaggttaagcataggcatgcttgtgagggagagaggtgacattcatgctgaggagtatacattttatcctgaggccaagagggaactgttgaattctgagcaggggagccatgggttttgaatttcagaaagatcattccagtagcagggtagagtatggattggaaagcagcaaaaccagaggcagggcaaccagtctaattactattacaataagctgggcaaaagatggagcaataggaatagcgtgaagcaagcaaatttaaagaccatttagagagcaaaatatgtggggagcaggatagttaaattcttgtgtaagtgacagcaagatatttaccccagcgcatatgaattaatcacatgtcagtcacttgtgaattgggtacctgtatgtgttgggttttgttccttggaagggagtttgtaacctccaagataatcatatcctcctggggaggagctgaaacagtaatcccttagcagaatcaactcccacagcgtctgactgcagcgttgcagtatatctatccaaactagtagctggcatttagaggttttcaatgccttagaagggaactgaaagggatctcagaggcccttctgtcttgagtgcagcattttctcatgggcctatacattgcccacagccacacagtgtctttagcgacaggactaagacacaaagtctagggctcctaactccagccctgggcaaggttcccccttccccaggagtcccagggggcttttctgcagagcaacacacagttacagtggacagatttgctagcaatccttggctagcaatttgaaatttgaaatgtgagggagtggcctccagattagtggtaaaaccagccggcaggtccaagtctccccttaaatgcatttcctgttgattaaaattcaggctaaaactaatagccaggtttaaatgaacattaaccaacataatcagtgttaacttttatgaagaaaaatagattgattcatgagtcataagaaaaatgtccagtttgccaacttttattttctgatggctattgtccatcctttagaaaaaaagtaatataagttatgtataaagttggtaaatttaataataccttgccaaaaatttgagccaagagcttggaattttcagttgtataaaaatttttatagactcatttgaaagttacattagttatttcttcttttaagtcgggattttttttttttttcttaacacaggcactgaaggtcctgagaactgcagagtttgctccttttgttgttttcattgctgcaccaactattactccaggtttaaatgaggtaagaatcaatctgtttttccccaaataagctgtaaggatcaagccttactccccagcacagtcagaagcgtgtcagtctacatttgcagcaaggctgctctgatgaaatgggatgtggaatagaatgctacatgggacagtcttatcagtaagctgacttctaaaatctgaggacaaacaccctcactcccaccaggaccgaggcatcccaggtgtctcacaacctccagggctgccagcctattccctctccggatagggattgtgtggcccctggagtggaacctttgtggaatttctctccaggcccctgaagactaccaaacctagaaatcagctctgtccactgtcaagccagctcaagtcagaaactgccacagacatggtgctcatgagacttggctgctgacttagaaggttttccattgctgagcagatcaaagggtacttaccatgtgtctgctaagtgtagcagtgcctatcttctgtaggttccttagttaaggggagactcttataccaagttatcctgaagaccattgctttcacagcttctagaaatcatcagaggactcttgattgactctgttcagtcaacactgacctaaactcactcaagcttaaaatctaattaaatcatggcttggaaattttccctttgtgtacctttaaggaagattcaggattttgatttacctatgttactcatattttccgtcattatgtttttgtcatttcatctgcaagaggtatattcctttgtaaaattctaccttcccatcttatttaatacataagcatgtttgaaactccacattgtggttagcttttatccttcagttgccatgtatttttcttgaatcatcatctttgctttgtttttgttttgcctgttttcctgcccttttactaattttccatagctgccaaaatggtgcagaaaattgcctgtaagtaccagctaggaggtggtgaaatacagccgtgtttcttttaatagatttagaatgtagacactttgttcccacaaatccttgcttttgctgttagaataaaggcattttgttttcactgagttaaaccctgctcacgtgtgagtcaagcacacagacaagctgttgtcgaggaagagactgacaaatatagcttcgtcttaaaagattcttaagagggagctttatttttctgtaaagagacctacattaaaaatgtgatactttcagccataaattttcttgaatattttcatcagcccagcttgctgagcaaatcataaaccctgctagtggtttttgaagctcaggactatatattcaaatagaatcccgtgtgccagagagtgatgttgtaggaattgttccttttcatcctggtaggaagcactcctgtctttgggtgaatgcacatttgctaaaatggcgttttttgcattgtgttgattatgaagtaaagccacagtgaaaatactatgctttttaagtgcaagccgaactagaaggtgatgattaactggggtcttatctacactgtagtacttaacactaacattcaaagcatgccctgtcctgctttgaaatgccagtaaaagaggacaaaacaggtaggacattcttggttcagagtgccctgagagaaaagattgagttcctgtctgctgtggtgtctgcgcatgcccactgcagtgccaggacagaatcaagcaagtctctttatctcacttctagtcccctttcttgagagctgtacccagagagctgaggcttgcctggacctcccagcagcctcccaggaaaggtctcttgccaataacagaggggctttagagaagaggagaggaggggaggggccctaagccagtactgggtactacggctcctaggtccttgaaggtaccgcatcttttattttctctggagatctgtctctgtcacccagggccccaatttcctggaagaattgctcagtctcttgattttagatttaatacttgtaaaaccctataatgactggcactagtcagacaagtgcttgttcttttgacagcatttattaagcacttactatgtgtaaggcactatgcctaatgctggggcacagcaattacagggcacacaagacaagtttatgccctagctggagacatagccactaatcaaataaagaggtatttcgttatctctatgtatatttaagactcagcccaagagctcacccacctagtgtttggcaggtagggggtggttaatttgactcacaaagttccctagtgtcaaggttgaacttgccctttgggagttcagcatgacaaatatgacttgcgaagatatagaggcagacttctttctggtggctcttaagagacccctgtcttgaaagaactgccactctgtagcagaagctatacttgcatgacaaagctgggaccctaaactccctcctcctgttggatccctcttacaagagttcttaaaatctgtggcaagctgcagcttagggaacatcctttgttgcagcaaacctccctagagttcagtactccctagagttctcttccttctgtttttttcataagagatatgaggacctacgaacagtgacatttgtctagccacttctaatgcagaccaatttggggggattcatcagatgccaggtgctgtttattggggaaacagccttattccagccattatttgtaacactcaaagatcttttgcctctggcatcagctgctattgagtgagggccattatatgtaattgaattcctagaacgtgtggcacctttaagtagaagaggaaaaaatacaacttaatttgtcatccaagggcagggacttgttggtgcaaacacagctgggccctgaggcctggctccagtgagtgtggaggaccaaggggacgggggcaaagagctccagccttgccaccgtagccctctcgccaattgggagagtggcttgaggctagggcggggggcttcctgctggcctgtttgggccaccatagccactgtaacccacacctggcatggccctaccaagcctgactctggggacaggcacagctaggcctgagtgggggtggcatgtttcctgaagagtatctgttttctctggttcgtctgctttgtcatggaccctctgttgcatgttgagcaatcactgtctcctctgtcatggagcggacttggcctcatgctggcatatggcatatcagggtctggccttgactgtttctgacactgggatgaacaaaaatgtgaaaagagaacgaatccaactgatttctctcttctgtttgcttttccctcctctcatgcccacccctacctccatctcatcaccatttaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggg

SEQ ID NO: 5658 - DNA, 402925 bp, human
cgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgtataattacgctggggaaaagcagggaatcagattaatcacagtgctgattgagaattaaatctgcagttcctcatctaattgtccattccttaaatctattttgaatagtttccttttcattcttgtcaaacagtactccaagtgcacaatcctgctaatttgcttgtgaaggaaatgctggcaatctgaagttgatttcctaacacagcgtgtattctgcggctttagaagttgaggagataagatttaagagcaaatttttgcttaataaggatcgctagagctaacattgaaatatcttacctctttttttttttttttttttttttggaagcggtgctttattgtctattttaaggtccacagttgggaaatgaaaccaagaccttaaagcagttggccctatctcttttaagttgtctgcagtactcaatttcaatttgagtgctaatttgtttccttttctttccatattgaggtattacagtgttgcctcacatggtgaaattgtgggtagagcttgctacacactttactcagacccaattgatgtgaggacatgttactccttgccctattgttacatgaccagccagacttaaaaggaaagtatccaaatgtgtcctgttaaagtgcttgtggaagtgttctagaacagcactgtccaaaagatatattatgagccacatttgtaatttaaaattttctagtagccacatttaataaaaacatacaggtgcaattaattttaataaaatattttatttaaccctgtagatccaaacttaacatttcaacatgtaatcaatatgaaaaaatattaatgaaatattttacatcttttatgctaagtctttgaaatcccaatgtgtattttacactaatagcacatctcaattctgacactaagctacatttctgatgaaaatcagaaatacttaatctgtatttaggtttcataaaatttgcgtttgcaaaagtatattcacatacccaagttgttcccaatatacataaaagttttccaataaccgaatcaagtacctttttctaaatttaaattttaattaattaaaattaaatacaattcaaaattcagtttcccagtcggaccagccacgtttcaggtgcccagtagccacatgtgaatagcacagttctagagagaaaaatgcatcaaaaatctccttggtttcctcattcttaggagcacccagtgaagataaattaggtgtttcccaaaagcctccaaatgactgtatgtgtgggtgaatgatgtttgttgcatcttagttatagctgatgtaaatgaactaacaaagtcataattggaaaatgtgagattaaaatgttaattatattgtgaagatgtaaaatagccatctctgaatcagttttggtaactagttctgattccttaaagtctggaagggtgatgatgtgatctctttggatatcaaaaagaaatggtcagaatcacattaacacagtccatattctgctgatttgtaattgatagaatatttttcaggaaacacccctgggagaaaaaaattcatcttttctgactgtttcagagctgcataaagaggggcagcaagctaattttgaggtgataggtactctatggctaccttaactactatgaactgtgaaatctcattcatatcctacaaaatctgacttggtcagtgccaattataaaatgccattatgtgaaataatgaattcaagctagccttattgttaaagaatgtaataatagtgttcctcaatctgagtaaaggttgaaggtttctctagtaaattgtcttagtatatattgatctggaaattgaaattagcttgagattttcttgcagggaccttgacagcatacatttttaacttataatttgttcacctctgaatttgaacagaaagcccttgaagatattcacatgtactgaaaacctttttattgatttctatccaagttctatggaattttgattttcttttttaccaaattagtatcacaagttgtttttcaccactagatcttaataggttttaatttttactaaggtactttaaaatagatttcacttttcaagactaattgactacccactcactcctctacctacgcaaccacctactcactcacccactgtgtacttggccttacttgatggcataaatgaaagttctcgtttaatttagacccttcagtgtgtttttttcccccttggttgagaaagataacttacagagttaatgaggttttgaaatataagatcattatttggaatatgttttctttccagtggttgcagcctttacccttgttaaagctgtctttgagggaacatgtgcccaatttgttacaaatattggaaggatgccgtttccctttttaaaaattaaaactcttttccctgtgtttctcatttttgaaaatcttgcagaaactcctttgagtgactgttggttctataacattttctatgtaactatcttttaaatgactgaaacaaatctccaataataagaccttatcatagtcccaaaacttcttgtcttagcaaatgtagcgattactggaaaggaagggcgttatgcaaatgaggttaatgactaatttttatgtcatgatcatttactgtatcttttacaattataagtaagtgtacaaccggtaatactacatgaaggaaatttaagacaattcatcgaaattaaaacatagaaaaatgcctactttcttggtacagcagtgtgtatgaaagggaataacaaaatacataccatttttaccttgtgttaggtgaatacttgccctgtttagtagcctgtagcttcagactttcctgctctggtaggacatacactaaaattggaatgatgcagcatgacccttgcttaaggatgacgtgcaactttgtgaggcatgctgtatttgcttactcctcgagagcacttttatttaattacagttacttatttatggatctctctagttcactaataaggagcttcctgagggcagggaatgtttcttacacatctttctccattaacacagtgcgtgcaatgtaactgcctttcattagctgtggaatgaattgagtagttttaataaaatctcattaaaaggcaaaaaagcatgtttgtcaacctcagagcaattattgtccgaagagcctgcattagtttaaagtagtggttctccacctggctgcatattagaatcatccggggagcttttaaaaaagatcaacgccagagccctgtgtcaaagcagtgaagtccgagtttctgggactgggtcctggtcactgacatttttttaaagctctctgtgtgattctaatatgcagctataatgaggaatcattggcttaaaacttagattatgtatgtaatattttgggactggcttttcagaggcttacaattcttacaaagtagaataaattctttttggaaggtattgaagctaaatggctaaaacatggattttatcttctatgcacttgtgtttctcagccttattgtgtaaaaatttagttttagcttgtgtttggctttgatttcttgggccttttaagatccacattgatttatgacactcatctaatgctaacatggcgattgtctgacgtttggaacaacacagaacaaggattgcttcaataacagttgatgatggttttccactataatggcttgatttaatatgaagaaatttatcagtttagtatggattgtgtttgtacatacactctattaaaagagtatggttaagttgcttgtatgctttaaattacatacttgtgattccagtaatgctgttagctggagaattgagttaatgcagcctttatgtaaatactggattaataatacgtaaagtatataattcagcatacagaaaaattcagctttactaatttgtactaattactatgactttcacatgtattgattcatgcagtgatttgggtttctagtaccatagggagaatttcgcattgtgttgaaaaaatgtttcccggaaattttaactagactttgtaggtaaactagtttttaatgttaggaaaagatcaagtgtttgcctgaaggaaccgagaattttccagaaatgagtagatattccagaaataccagtgatcgtgaaagcagtgcatgatcacagtgacagccaagtaacaaggtaaaagaagtgatcagcagctaaattgttggtggcccagaaagaatgcaagccatgggagttaagctgtacttctacagaggaaaatccttttgaactcagggtgtggatgctacagatagcaggcctcaatgggagtggggaagcaatattgattcctgatgatcctaggatcatttggagggagaacagagctactccgttgcttttctgcatgtatacaaccttctctagtctcttcctgtctgctttttacagattgctttagggtgtgttgtttgaagttgtcttcataaatacttcctgtggactcccttaatttttatgtccgtaacacgcttctatgtacttgacatacgcagttcagctctctccattttttccttgtatctgcaacagtttcacctgatgaactacgtctcaagtgtccctaaattgtgtacctggatatttcctttaaactgaaaattctgtctccagctgtagttctactcaataaattgaaggagcagatataccttgcttcttgagattattcttgaattattacattttcttaaacgttttcacattttaaatgtggtaggagcactgcatttaaaggaactttgacataaggttgtttaaaaaacttctataacttaaagcttactttataaagggattgacatttatccctctaatgttaggcattttggatgtattatttaatcatacccattttacagagaacactgagattcagagggggtgatcagtaattcgcctaagatcacacagattccaacgcggttccatggttttaaagtctgttcatttcatgctgcattctgctgctaattcaagttgtgaaaatactgtgttggattttcttaaagacacgtcttcattttcagagtttctatactgcaaattttagttgtttgactttctggttaaatttcttatttcttcagtagaggttccatatactattcattctttcatctgtttcttttttatttttgtctttctctttaatgaaacatcagcatttgttaccaaactaactggtaaatctagcaatggaaatatagactcttggccatctgtccaaaatataatttgttttggaactttctctacttcttttactctccaaattttttcttccatttcccttgccccaacagacaggatagttgattaattacccctaacttgccaaaccagaagtaataaggtttcagaggtagatgtttgttggaagtggggtggagtggtttccaaaggatagttattcctttatcctgtgataaaaatacggagattgttctctctgattctgaaaaccgtgtagtgagctgcagccgctgagtctgtgagcttctagctgtttgccagcactgtacaccttaaataatcaagagactgagttaactattgcagagcaggtaccggaccccagccaacaagctgatgggatgtgctgttctcacattttttggttttattttttagttgcaactgacagtgaagattctagaagcaccaaatatggctctggatttatgctgtgggatttaagatgctacagaacttgctctccttcctttctgtcctggagccactatggtattggttgtagagcccaagtcagtatagagtctctgacttctaccctgggaaaatttcatttccgaagctagtttgttttgaagttaatgtttatttccaacattgagatttaataattttgtgttacttttctttattaattagtttttatacagtaaattataaaagtaatgatgcacgtagtaaattttattttctttttttgagatggagtctcgctctgtctcccaggctggagtgcagtggcacgatcttggctcactacaacctccgcctcctgggttcaagtgattctcttgcctcagcctcccaacaagctgggattacaagcatgcaccaccgcgcctggctaatttgtgtgtgcgtgtgtgtgtgtgtgtgtgtgtgtgttttgagacggagtctcactctgtcgcccaggctggagtgcaatggcgcgatctcggcttactgcaagctccgcctcccaggttcacgccattctcctgcctcagcctcccgagtagctgggactacagacgcccggctaatttttttttttttttttgtatttctagtagagatggggtttcaccatgtaagccaggatggtcttgatctcctgacctcgtgatccacccgccttggcctcccaaagtgctgggattacaggcgtgagccaccgcgtccagcctagttttttatttttagtagagacggggtttcaccaggctggtctcgaactcctgacgtcaggtgatccacctgccttggtctcccaaagtgctgggattacaggcgtgagccactgtgcccagccatacaatttaaaatataggtgatacaaagataagtagtgagtctgtctcaattctcctaccatccatatccccattctctagaggtaaccattgttcagtttcttctccatctttctggaagctttttgtttaaaagtgagatatttgtatactatgctgaaatattgatttttcatgaataatagtatatacttgatgatcttgtcatatccatcaatgtatctgtctgtctctatctcctctttagctgctgcccagtattctgtcatatggattgttactttggctttggattgagtgcaagccaattgtaattttacattgcttgaaatgctgagctggaatttgggtgagaggtatggaatggcagtgaagatttgggagtcatctgtgtggaagtaaaactgagtgaacaagttcttgggggttgactgctctagggctcgtggtttggagtataactcatagagttagaagaatcaggataatgggctgcacagaagtttaaaagaggggggaggatcaataatgtaaaatgccaatatactctgaggactaagaacacatgtggctataacagagaaacaatttaaagcacttatcaaaatgaatattatgtttaatagtcaattcatgatgtgtctgaaaagctaggtctggcttcttttctgtggatactagtaattttatactatctctctgtaaatctatctcagaaccaacatatttagggtaaaaacaaagtagatttctttttcactctaattgtgttttgcagatttctgatgactggcttttaggtaaaatcatttggttttcctaagattatgtccttttcattcccgagcttgtgcatgactgtcaattaaatggaagcctttcatgaagtgacaaagtaagttttagatactttacatttactttaagttcttggtatgtgtcaaaccactgttattgtcttatatctttctactataggaaactgaattctttctagcctcaaggatttttgtccacgttggatgaatgtagtactgtcctcctctttcacatttcttctcccatcacctcctaactaaatttgttcattggctatttttggttgtccacatccattcacaataagaaacgattgcttcgttgtacataagccagttttttggtatctaagtgcgtgctatttcacttcagcttcttgtattctatttattactgggctgttgtacattgttttttctcccaatctttgtgatttcttttaatatactttctttcctttttgctttgtaatcattgttttgagtatttgaatcatttgcaggtaagaatgtggattgttctgtctctcatgtagtttaataatatccaaaatatactatgttcagtctgtatttcaggcttttaacacttaagttagagtattttggtatatttaaatctaggatagaagtacactgtattaccattcaactacatgcagattttaatgttttcttaaattaaaggatgatgatattcattcagttacagaggtctctctctctagtccttccatggtgtgcagattaccattatactactgctatttcatagattctaatttgtgtttttagaaaacatcatcaattcttggccttctttcttacccttggtatgtgatttcccctaaaggtatggaatgcggttgctctgtggcttgttaggcagcccccttctgatctggtaacctttgggcacagtgtggctattttctccttatttataaaaggaatgatagctgcttcacaaaccatttgtgtggattagtgaattgtaaagtgcagcataagtattttttatttctagaatgtctctgagatactcaaattacttttggcagttatgtacgtaagtttcaacaatttccaaatgtgcacattctcagtgctaaacacaggctctattacataaataatatggtgaaatgaacattcttttctaccatgtgtgtaaaattgttagtggtgctaacttttattcattgttcatttatgtattcatttctagctatgaggtcctgggcaagttagttagcctctctgaccctcagtttctttatctgtaaaatgtggttaatggtatatactttgtaaggttgttgtgaggattgaatagcatgatctatgtgaaatgtctaaaggttgttattttaattgccattgtcattattattattttttaaattttattattattatactttaagttttagggtacatgtgcacaacgtgcaggtttgttacaaatgtatacatgtgccatgttggtgtgctgcacccattaactcgtcatttagcattaggtattgctattcaccaaacacttgagttctctggcctcagggagctcaaatgagttattcacacactcatgcacatatcctctgcgtaacttggtaaccaacagacacacatagtaaaatatttggtcagcagttgttgaatgagtgagtacattaactgagaaatccagagactgtgtgaccacctagtaggagaaggaagttggggaaatcattacagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaaagcgctgcgattacaggcatgaaccactgcacccagcctaagaaatatattgaagagtcctttctgtctttttaaaaactgtccaggccgggtgcagtggcttatgcccgtaatcccagcacgttggaaggctgaggtgggtggctcacttgaggtcaggagtttgagaccagcctgactaacgtggtgaagccccgtctctactaaaaatacaaatattagctgggcatggtggtgcgtgcctgtaatcccagctacttgggaggctgaggcaggagaattgcttgaacccaggaggcggaggttgcagcgagccaagattgcaccactgtagtccagctggggcaacaagagcaaaactctgtctcaaaaaaaaaaaaaaaaaaaaaaaacagaaaacaaacaaaaaaactgtccagtgagctgtaatcactgcactccaacccaggcaacagagcaagacactgtcttaaaaaaattcttttaaaaatgtcattgctctcattgttcaactcccacttatgagtaagaacatgcagtgtttggttttctgttcctgtgttagtttgctgagaatgatggtttccagcttcatccatgagaacatataggcacagggaggggaacatcacacaccggggcctgttgggggttggggggcaaggggagggataacattaggagaaatacctaatgtagatgatgggttgatgggtgcagcaaaccaccatggcacatgtatacctatgtaacaaacctgtacgttctgcacatgtatcccagaacttaaagtataataaaaaaagttaaaaaaaaactgtcattgcctcttatgtacatagaaaatacagtattgagttacagattttcataatttgtttccaagtctgttctagattataattccgtagtgttgtgaaaaactcccaagattgttaaaagaaggaattttgtatcacacttcttatgtttgcatttagacaattgacagattaattaattgttcataatgtgaaatttcaagactgaaaaaaggaaaatcccagaatatatatttcagaaacacccatatataggatttatgaatattgtagtgttcctttatgtaacttcccaaaattttattacaacagcaatttctacatcttaacagtgagcaaaatgaggtggaaagattctgaagttgtagtctctgacactactgggcactgaatctaaataacctaaaaccacagaacagtatttcatcttctagttcttattacattgtcaggtgtaagaatgatcatgttgaaattgagtggttggtctgtttagatcacttctatggaaatactgcttagattggtttcagaaatccttggacagtattatttatattgcattatttaggttagaaatttttgctgacttccatctgagttattagttcaaaagcagaatcatcagcctttatatggaatctctgctggtgctcatcttaggcttagtatcttcttaactgggtttttgttagcagtatagtgtggcattaaatttgagactatctttttaataaattttttaaaaattttgtcagttgtagaataattagatacttgtaaaacaagcaagaagctgttttcactgaggactttctttaattacatttcatataaatttaagagaactgttactagaatattaaaatcacaggttaaagtgagaatgtatttcacataatcaacatacataacatttttaacagcatgctaaagatggaaaaaacctttaccaaccatacatattataggcaaagctttaaaaaaaacaaaacattttgctcttatggatgtgaaagtaatctgtgtaaatatgtatttaaatgaaaatatctattcattatcattgcagaaggagtgtgggtatctggagagggagcattctaaacttgctgctctactttttggattatctacattaatatttctcccattgctgagtatttctgttatactgctggatcatcatacttccataatctgtgacccacttgctctaatggtagagtgggctttaaactgccatctgattaaagttcaggtttcttagttagacttgcctgggtggcttcagaattaggcccacaaatatgaatatggacttgaagatcttactagaacaatattttccccgataaagacacatccataaacatggtcctaaaaagatatgtgtaagttggatttgaaaaatgcaatttaagagttactaggaaaaagggattttaaggaaacattttaagtaatttgtgtgatatcaccagttggtttttcttcagtttcttcatcttgtaaaagaaggatagtaatggctatattatctacctcatgagattctcatgcacataaaattacataattcttaagtcttaaactaccttacgtatattattatttcaattttattgaaataaaacactttttttttttgtgatggagtctcactctgtcacccaggctggagtgcaatggtgtgatctctgctcactgcaacctccgcctcctgggttcaagcaattctcctgcctcagcctcccgagtagctgggactacacatgtgcaccaccacgcccggcttagtcttgtatttttagtagagacagggttttgccatgttggccaggctgatctcaaactcctgagctcaggtgatctgcctgcctcggcctcccaaagtgctgggattacaggcatgagccactgtgcctggcccaaactaaaacacttctaatggacttgtactttggctgggcacggtggctcacacctgtaatccctgcactttgggaggccaaggtgggtggatcatttgaggccaggagttcaagaccagcccaggcaacatggtgaaacctcgtctctactaaaaatgtcataaaattagccggccatggtggcgtgtgcctgtaataccagctacttgggaggctgaggcgggagaatagtttgaacccgggaggcatagtttgcagtgagccgagatcatgccattgcactccagcctgggcgatagagcgagactaagaaaaaaaaaaacaaaacaagaacatgggctttgttgacttttctttgattttgtaagaatcatttacctttgtctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaatcttcatttttcccaattcttactgcctttttacttcctcaagagaaaacccaccttgtgactgccaagtttagggattcatgtgagctgtttggaatgtttgtttgtttgtttgtttgacagagtcttgttctgtcgcccaggctggagtgcagtggcacaatctcagctcactgcaacctctgcctctcaggttcaagcaattctccctgcttcagcatcctgagtagctgggattacaggccaccacgcctggctaatttttctaatttttgtattttttagcagagacggggtttcaccatgttggccaggctgatcttgaactcctgacctcaggtgatctgcctccttcagcctcccaaagtgctgggactgtttagtgtgttctaagccaggggtccccaacccttgggccgctgaccagtaccggttcatgacctgttagaaaccaggccgcacaacaggaggtgagcagcaggccagccagcattactgcctgagctctgcctcctgtaagatcagtggcagcattagattctcatagaagcacaaaccctattgtgaactgcacatgcgcgggaactaggttgcatgttccttatgagaatctaatgcctgatgatctgagatggaacagtctcatcccgaaccccctacccccaccccggtccccatcgtccatggaaaaattgtcttccacaaaaccggtccctgatgccaaaaaggttaggtaccactgttctaagccattgaaatagtgccatcccttctggaaaattgttacccttgtcctggagtgctgtagtcactggtatttcaccaggatgttagggtatttcaccaggatgttagtgagcacatagatattgaatatttcgggcaatcttagaatgtttactgggagagttttaaaagttagccttcccacatccctccaagaatagctgtttctctttgtagctggaatgtcatgttgtactcttgattctcctttgtacctgttcttagccattaaggtgattggtggtcaacttcgtataaaatacaactcaattttaccattgttcttattgatgcacatgaatgtttctctttatgcatatcactgagggaagtatagtagcctttgaaagaaaggccttcttgtagtctcccctggctctggtagcaaggtcaggcaaaagtgttgtttttgcagttgtgactccatggttgtgtttttctttacataactgatgttttaagtcaggaaatatgactttgccaaatgatactgagctatattactggtgagtttgtttggttcctgatttatttcagtaaatctgggttgaatagtttagtagtagatgctggggaagatacaggaaatagtgagtttgagactagaaatgattgagttagacatttaatttaggctttcccaatcaacttacttcataccttttgccctgcttactcatcccagaggtgaggaacaatgagaagaggggtcaggcaaaggccatccctcagaatgtggttacttaggtctgtcgccaaaggcaacctatctactggaaaatttgagctttactgtcttctgcagtatagtgttggaaatgcagtattttaaaaactaaattgttatttatagcagtgaataaaatgtgaactctttaaaaaaagagcagtgttactgtcccagctagcacaatagccacccacatgaatcatctgaacaacctcctcatttctgttttatctacctgaaataggggtcagcggtaggtgatgatgaaagcttgggaaatcatgccatgcattaggcaggagaaatgctgtggtgactctttctgtgttgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatattgtagccactagccagatgtggctatttcaagttaattaaaattaaaatttaaaattcactgaacagacatttctccaaaaaagatttataaatgaccaataaatacacggaaaggtgctcaacatcaagtcattatggaagtgcaaatcaagaccaaatgaaataccacttcatgtgcactaggatggttagaatcaaaaagacaataacaagggttggcagggatgtggagaaattggatctctcgtacgttggtgggaatgtagaatgttgcagccaccttgaaaaacacactggcagttcctcaaaaagttaaatatagagtttccatacagcccaacaattccattcctaggtatgtgcccaagagaattaaaaatgtatatttacacagaaacttatacatgaacattcatagcagcatttcataatagccaaaaggtgaaaacaaccccagtgtccattaatggatgaatggataaacaaaatgtggtagttgcacacaatggaatatcattcaactataaaataaattaagataaagacgcatgtgtatgttcatcacagcactattcataatagcaaaggcatgtaattgacctagatgcctgtcaacagtggactggttaaagaaaatgtggtacatatatactgtgggatactatgcagccataaaaaagaataagattatatcctttgcagtaacatagatggagctggaggccattattctgagtgaagtaacacaggaagagaaaaccaaataccacatgttcttacttataagtaagagataaacattgagcccacacagacacaaagaagggaacagtagacactggggcctacttgagggtggagcattaggatcgaaaaattgtaggatactatgctgattacctgggtgacaaaattatctgtacaccaaacccctgtgatatgcaatttacccatgtaatatgtatcccctgaacctaaaataaaagttggaaagaggaaaaaaaaagatcactttgggaagaattgatagcttaaattattgtgtcatccaatgtatgaacaaggtatatctctattatttgggtattgtttaatttctctcagcagtgttttgtagttttaaaagtacaagtcttgtacatcttttgtcacattcttaaatatttcatatattatgctgtggtaaatctgtttttcatttgaatttctgattgattgttgttagtatatagaaatgtaattgattttttgtatgttactcttatgtcctgcaactttgctagattcacttattctagtagaatgatgtatattgcattggatagtctacatagatgatcatatcatctgtgtataaagacttcctttccccaaaaaaagaaataaagtacagatacatggtgcaacatgcattaacttcaaaaacattatgctgagtaaaagatgccaaacacaaaagaccacatattgtatgatttcatttttaagaaatggcctcagtaggtaaatctgttgatatagacactagattagtatttactagggactgggaggaggagagtgtgggcagtgactactaataggtatggggtttcattctgaggttatgaaaattttaatggaatttaggtagttcttagtgatcaaggcacaactttgtgaatatactaaaaaccaccagattgtatacttaaaaagggtgaattttatggtatgaattatatctcaataaatgttatttttaaaaattcagttccttagttactttagccacatttcagttgctcagtagctacatgtggctagtgactgcatggtagacagtgcagatttagaacgtttccatcatcacagaaagttctgttagacagcactgatctaagagtctcaatctgagaccaaaaaataaaggaagaaaaaccagtctaaaaaacacagggagtggagaacagattatgttctgaagaaatgttactttggggtaattttaccctttgttgccctttgactgttctactaggagtcctcaacatgattttcattttattctcaaaacaaatgcctgtggtaggtactgttatactcatgttttataattgaattatatgagttttaagatatttgtgtagtaagggtagagcaaaatttctaacctaggtacataatctctgttacattgtttacctctgtttatggtatttgattttcttaccaaccatccttcactcccactttgttgctagcccactagagctattttcagtaccctaaatgcacagttctttttgtgccatagcagatgctagccctccttcctccttctgccgtctcccaacactagtatgtgcatgtgcacacatttactggccccacttacctgaaagtgtggtgcacatctctcttcctttgtgaagctatctgataccacagttttaggggctactctctcacctggttaaggttacataatgtcgcaagatataagcaagaatgctgacaggattcttgttgtgacactatgacacattgagcccaattcatagctgctgtgttggtgactctaacagggaagtggtcttctagtccaggcccttggctcccatttatacattatctcctttccattcacagccttctttaatccccacccacactgctacagtacctgactgaactttgcctttctttgcctcttcatatgtttttctgcttaagctttttgaacctgatgagatactgccatgtttttatatttttctgctcataaaacccttaatggtaaaaagatacctgattgaattctgaagtgctttcatggctttgcctgattctgaggtcatattttctaactttatgctaacatcagtttactctctggttttatatggagcatgtactcctgtagcttctgaagaaaggtttaatgggaagcaaattttgagactacatgtagtaggctaaatcatggcccaccaaagatgtacacatcctaattactagaacctgtgagtatgttactttacatggtaaaaggatctttgcagatcttattaaatttaggattttgagatgggggattatcccagaatatttggatggacccagtttaatcacaagggtccttataagaggaaggcaggagggtcaaagtaagtaaaaggagacacgacaatggaatcaaccagagtttggagtgatgcactttgaagatggaggaagagggccacaaaccggggaatgcaggcagcttcaagaacatggaaaagcttctcccctgaagccaacatcttgatttgagatttctgacctctgatcagaactgtaagagaataaatttgtgttgtttaaagccactaagtttgtggtagtttattacaacagtagtaggaaattatgaatacaccatgtataaaaatgtcattatgccctttaacttgattgatagtttatgtagacctaatatatatgtacacatactagtctccatggctccatgctgcagtggacccaggacccaggcccaccatccatggactcaggttccaaacccaccccagcagacttggcctccagactcaccctggcggatccgggctccaggatcatccctggttgtctcagactccaggcctgcccctgcagacccagtcttcaggcctaccttcgtgatcccaggcaccaagcctgcgtccttgaatccaggtgccaggctcattctagcaccaggctagtcccttaagactcaggctcaaggcccagtgcagcaccagattgagctttatggacccaggattcacactggcccctgtgaatacaggctttaggcctgccctgcatgcccagctgacaggcttgacaggcttacctgagtggaccctggcactaggctgttccccatgcacaccaggattgagatccaccctagcaaactcaagccgtaggcctgtcctaatggacccaagtttcaggatagcccacctgaaaactccagcagcaagcccccctgccagacagccctccggaatttctggacaggctgactggtaaaaggcttttcctgccaaagccagtctgtgaagactgcaagtgcctacttcttcttctttttttttttttttctgagacagggtctcactctgttgcccaggctggagtatagtggagtgatcacagctcactgcagccttgacctctcaggctcaagcaataccactgcctcagccaatcctactgcctcagcctcctgagtagctgggaccacaggcaagtgccaacaggcctggctaatatttgtattttttgtagagacaaggtttcttcaagttgcccaagctggtcctcaagcaacccacccgccttggcctctgaagtgctgggattacaggcgtgaaccaccatgcccagccaagtgcctgctttgtaaaatgtgcagacactaatgcaaaactgcaaggatcaccgataatcagggaaacatgacatcaccagaggaacaaaatgaagcaccggtaaccagtcataaagaaatggacatctatgaattgactgataaagaattcaaggccaggtgcagtgtctcgcatctctaatcccaccactttgggaggccaaggtgggtggatcacttgaggtcaggagtttgagaccagcctggccaacatggtgaaacctcatctctactaaaaatacaaaaattagccaggtgtcatggcatgcgcctgtaatcccagctactcgggaggctgaggcaggagaattgcttgaacctgggaggcagaggtcacagtgagccgaggtcatgccactgcactccagcctggctgacagagcaagactccatctcaaaaaaaaaaaaaaaaaaaaaaaagatttcaaaataatcaaataatcatcttaaaagaagttcagtgagttaaaagagaatatagatggacaacaaaatcaggaaaataatacacaaacaatatgagaagttcaacaaggaaacctcaaaaaaaaaaaaaaaaagaaccaaacagaaattctagagctgaagaacacagtgtctgaactgaaaaattccacagaaagcttcaatagtagacttgaagtagaagaaaaaattagtgagctcaaagatggtcatttgaaactacccagttagaggaagaaaaagacaactaaatgaaaaagagtgaagacagcctatgggagttatgaggtaccatcaaacaaagcaataaatgcatatgagatttccagatgaagcagagaaagaaaaaggggaagacagcttaaagaaataatgacagaaaatgtcccaaatctggagacatgaatgaacatccagatccatgaagtccaaagaacctccaactagattaaagagatcttcactgagacactttataatcaaattctcaaaagtcaaagataatttcaaaagcatcaagagaaaagcaaaccatcacctacaaggaaacctctataagactatcagtggatttctcagcagaaactttccaggccaggagagaatgggatgatatattcaaagcgctgaaagaaaaaaaaaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataatactagcagattttaataccccactttcaacaatgcacagaaaatcaataaggaaatagcagatttgtactacactgtaggccaaatggatctaagagtcatctgcagaatatcttatccaacagtagcagaatacgatgttcttttcaagtgtgcatggaccagtctctaggatagatgatatgttaggctacaaaacaagtcttaacaaatttaagaagattgaaatcataccaagtgtttttttctgaccacagtggtatgaaactagaaatcaaaagaaaacggaaaattcctaaatatgtggaaagtagacaacacactcctgaacaaccagtggatcaaagaagaaattgtaaggaaaataaaatcttgaggcaaatgaaaatggaaacacaacataccaaaacttatgggatgccatgaaagcagttcgaagagagaagcttataatgataaatagcaatacatgaagaaaaaagaaagatctcaaatagacaacctaactttacaccttgaggaactagaaaaagaacaaactaagctcgaggccaaaaaaggaaggaaataataaagatcaatgcagaaataaatgaaatagagactagaaaaacaatagaagttatcaacagaactgagttggttttttgaaaagtaaaatcaacaaatctttagctagactgagaaaaagagaagactcaaaattataaataaaagagacattgcaacttaaagagatacaaaggtttataagagactactataaacaattatataccaacaaatttgatagcctagaagaaattgacaaattactaaaaatacagcctatcaagactggatcatgaagaaatagaaaatctgaacagacctataatgagaaaggagattgacttagtaatcaaaaacctcccccaaaagaaactcccagaacctatggcatcagtggcaaattctgtcaaacctgtaaagaggaattaatgccagtccattttaaactcttccaaaaaattgaagagggaatacttccaaactcattttatgaagccagcattaccctgatgctaaagctagacaaggacagtacaagaaaagaaaattacagaaaatacaagaaaaaaattcctgatggatatagatgccaaagtcctcaacaaaatactagcaagccgaattcaactgcatattaaaatcatgcatgcttggtacaacagatatatctgaagagactcttttctctatggttggtttcttcttgatcatcactacctcttagtgtacaggaagctcaaaatattactgtgtgaccttaacaaaataaatttacttctctggtctttaggtttttttcaatgggaaaatgggaaggttggctccattagtttctaaagtccctttgagctctgaaatgagtaattttataatttctaagtgtttaattcatcaactacatgactttaccttttttcttcattacctgtcaaattcacttaaaaactattatcacacttcatttgctttttaataaatttctgacagcatgaatgggagaaaaaaagggactatacagcatgatcaaagaagatttatccctggaatgcaaggatggttcaacatatacaaattgataaatcacattaacagaataaagtacaaaaaccatatgatcatctcaatagatgcagaaaatatgtttgacaaaattcaaaatcttttcatgataaaactctcaagaaattaggtgtagaaagaacataccttaacacaataaaggctgtatatgacaggcccacagctaacatcaacactcaatactgaaaagctgaaagccttttttctaagattaggaagacaaggatatccactctcaccacttatagtcgggataatatgggaagtctgtcctagccagagtacacaagaaaaatgcatccaaatcagaaaggaagaaataaaattttcggtttgcagatgacttaaaattatatatcaaaaactcttaaaactccaccaaaaaaacctgttaaaactaataagcaaattcactaaagtggcagatacagagtcaacctacaaaaattaatagtgggggaggagggagtagggatggttaatggtcaccaaaatatagttagatagaatgaataaaatctagtgtttgatagcacaacagggtgattacagtcaacaataatttattgtacatttgaaaataactagaagagtataattggaatatttgtaacacacagaaatgataagtgcttgaggtaatggatatcccatttaccctgatgtgattattgtgcctctatcaaaatatctcacataccctataaatctctacacctacgtacccataaaaattaaaaattaaaaacaatagcatttgtatgcactagcaatgaactgagaaagaaatcaagaaagtctgatctacaatagaatcaaaaatatataattcatttctaagaggtttttttgttctctcttcttgtatatagcttcaagattttgtttcttatatgctatgtctaatgtcctccaagagaaagagagggaaatggaattataattaacattgtcttttccctatattatctgttttctcttattttcttttttcctgttttttagctttggtacttgtctgtctttcatgttagaggtgtttctcaagcatcttcagctgtttgttgctattaaggaaaagtttattggaaactgtgttcatgactgtggcttgttcagtgatggacctcatgtggtgtgattgagggaaacctggctatttatggggagcctatcagttcttttttcttaagccagtcagcttttctaaataggatttctaaattgaatcttttgtgggagggagtttgggagtaataagctcatgtctagggctggatccttaatcattggctgcaaagacttatttaacccttgttttcagtaaggcatcccatttttgttctcagttatggctggtgttcctgagttcaggggctctgattcaacctctccagagagtaacttaagccctctgctatgtggagaaaaggcagttgccagatgctctggttggagtgagagtatgtgaaaatcttacttctcttttttaaacaatttttcagcatccccccaccacttgctttaaaaaaaaggattattttcttcaaatgtgcccataagctgcaattcctgagcttttaccttctgttcttccagggcactcaggagtgaactggcttacttgcctcaatttagattcccccactgcaggtacttggcacaaagaagaaagatacaatcaagtcagttacctcttttccaaatgcttttcattttaaattttgtgggcctatctcctttgctgtcatcatctccccacgctcttcatcttgttggtttatatcttttctaattcttcagtcttttgatttgtagagggagttagataaatgcttgtatctgatcagttatgtttaaacaaaagcgcctccctcccttgacaccttctctttttcttggacttctgtttcttagactgtttccaccattagaataagagcttgtcaagggcaggaaccagggtatttaatagctccagcatttgtataatgcctggagtatagtaggattattaaataaatgaacatacctttattttcaattatagatttctctgacttgagaaataatttcaaataaaacagtgaagtctctcttacagataagttcggaagctctcctctttcctcgattcttgcttatttttatccacagtgcgtctcgtgaaggaaaagaatggatcattctttcttgatttcctcgttggtaaagtatttggctttaagagctattcaaatgaatgtgcaaagtaagagtaagttgggtgtatttctagcactaagttgttgaggttctagaaaggtagttttgtgccttctagataccatgtctgcctttcctaatgagcctggtatgtatactattctgcctagcataactaggagcaataggatagagaagtgggatataccatttcaaagattcactgatgctgcttagaaacaaaaatctaaatgaaaaccaatgtacataaattagataattcacatataccattagaaattccacttaaagtcagtactgctagaaaccttgtcattaccttgctttaaatgctaagcgctttctgattaattctttttcagtttatttacctgggaggtattcgatctaagcaccagcatccctgcccccacttttatctattaatatttacaggtttttccctctttgaagctccctattgaattctgaatgactttgaacttggaattgctctgggtctgcttttcacctcctttctctacctcccaccccaaccttcactaatttgcttttttttttttttttttttttaatatttgggtggtttcttcttgcattctcttttttctatatgctccatgacagcctggactacatttctgttactcactgctgcatccagtgcttagcacatgctgggccttaagtcactgtttattgaaaagaataaatggattactcgttgaaatttttttaattatgaataacaaaaattagtaatctaactatatattatcaatcttttgctgtcttatcttacaggttttctttctggttttcatactggatagtctctattgacctagcttcaagtttgctgatttttttctactgtcaacttaaacttgctgttgagtccttctagtgaattttttgtcaattatagtacttttcaactcctcagtttctattttttttaagaattctttttctttattgatgttctctatttggtaagtcattatcctcatactttaaaaaacttctttaagtatagtttcctttaattctttgaatatatttataatagctaatttaaagtctttactaagtctaacagctgagccccctcaggaagtttctattggctgctttttttcttctgtatgggccatcttttcctgtttctttgaatgtctcataatttttctgttgttgataactgaacattttagataatatattgtagcaactctggattctgatccactcaggtagtggttattgtttttacttttgtttttccattgcttaatgacttgcctggactaattctacagaggctgtctttgctgaaatgtgtggccactgaagtttgtgctaggattttttgttttgttttaaattcttgtttttatttttaagcctggcttcctagggttttccccttggtcatccaatggttggccacaagttttccttaaacactttgagccaataagccttccatcttttgctgaaggaatctctgtgtgggttggggcatacgttgaaagttcaggcagtttaaaagtctgccttggctttcactttctgcttgtgtagggcctcacagtcagccaggagcagtagataattgggaatctttctggtctctcttgaacatgcatacatgcacagagccctccaaatggatacaaccttccagaacccccaagtatgtcagagctttaagctttctatggctgtctcattccccacatctaccttttacatgttggctagtgtcttgcttacctcaaccagtattgcagacttaagcagctgtgattgtttctaatgattgctattgtttttgacagtgcccctggccatggggctttctcttggagctccatatcaagtcagcttccttcagtggaactgtccacaaagctacaaggccagcgaattgtggtagaagcggacccaaattaaaatgtcacagaccctgctggtcttacctaggatcattagtagctgaggtcctcactccgccattccagaagtcctgccccccacctctgccttaggttttcaatgtgtttttatagctgtttatagttttgtggcttttcatttagtataaatattttctcatgttcttgataactcattataactaatttctactggctctcatcatttgaatgtctcataattgatttggtaatttcccctgttgttggacttcagataatcactggtgtaatttgcctttcccaacaggctctaacctgaatgaggcctgggactgctttgtttactacttcatcctcagtgcctgacacagtaattcttgttaaataaaggtcaccccacaattttttaaatgttataaataacactttgaggtggatcgtactgccaaaactgtattcagatttcagattttttttaagaatggagtttcagaaatggaattgcttggtcaaaggatataggcatttctaaacctcttgacataggttgccagattgatttcttaaaaagtcctatcaaaatagaaccttttggccgggtatggtggctcacacctgtaatctcagcacttcgggaggctgaggcaggtggatcacttgagatcaagagttcgagaccatcctggccaacatggcaaaaccctgtctctactaaaaatacaaaaaatttagctgggtgtggtgacgcgtgcctgtagtcccagctatgcgggaggctgaggcaggagaaccacttgaaccccagaggcagaggttgcagagagccaagaccacgccactgcactccagcctaggtgacagccagactctgtctcgaaaagaaaaaaaagagaacctgttttttcagcagcatccttatctgttgcattgtatatttggcgacatcagatgtgctagttgctcaagttttattgaccttattggccaaaaaaaaaaaaaaaaaaattctcgttgaactattttgtgtctttttttgagacagggtctcagtctgtcacccaggctggagtgcagtggtgcaatcacagctcactgcagcctcaacctcctgggctcaaatgatcctcccatctcagcttctcaagtaactgggactacaggtatgtgccagcagacccagctaattttttgtttgtttgttttagagatggggtctcaccatgttgcccagcctggtcttgaactcctgggctcaagcagtcctcccaccttggcctcccaaagtgctgggattacaggcatgagccaccatgcccagctattttgtgtctcttcgataaccaatgaaagtattagttttcctcatactttttaaaaaaaattctttctataaattggccatttgtttttcccccattttgctcttagttgcctaatgtttttcttgctaatttatgtaaactttatatatcaaagatatttatctattattgtcttttatatatttttaaaatttttcattttgttcctgatgagtttggatgtgcagaaactaaaaatcatacagaagaagcctctttgttcgatatgattggatattacaactggtctgctaaagagggaggagtataaaaaaagtctacagatatctcttcaatattttaacttgaagacaaaatatacattaagtagctaatcctttgatattgtgtgacccttttctttgaataagtctaattgattcgaaacctgctctatatttcttttatatatctcatccaaaatgcatcatcaacgatgtccagttttgatttatttaaaatggggtaatgacttaatgagctgtaatctgagtgcaaaatccttttggatattttatagatccttgctccccccgcccccccacccagtcttttgcagttttgtcacccacatttaattcagtatctcctttatctggtctttgaagccagttcttctcttttgtagtcacattcaattgctgtaacatatatgtaacatataattaagaattataggccggatgcagtgcctaacacttgtaatcccagtactttgggaggccgaggtgggcagatcgcttgaggtcaggagttcgagaccagcttgaccaacatggcaaaattccatctctactaaaaattaaaaaaaaatagctgggtgtggtggcacgcacctgtaataccagctacttgggaggctgaggcatgagagtcacttgaacctgggaggcagaggttgcagtgagccaaggttgcatcactgcactccagcctgagtgacagactgagactgtctcaaaaaaaaaaaaaaagaaattatagtaacacctacacaaccaacataaagaggtacacatttaggaacaaatacaaatagctcttggtatgtagacaacttaatttgtggggttcatgggctcatatgtactacacagtaccctgtcagcattgagcagtcagcatgcagcaggcattcattaggtttctacagagggaatggagaatggatcagtctgtgaaatttgttaagtggggtcaattaagagtgcttctaccatggtcaaaatctaatcagtctttttctttgttgtgattgtttccatgcttagaaagtccttcccttcttgagagttatgtgaaaattcacctacatttttctgtctttcttttgattcatacatttaactctttagttcatctgaaatttattttgttttttagtaagaagtaaggatgtaagcatctaaatagattttccaccttcaaataatgtgctgttttttttttccccagcatagccagtgcattcttcaaaggcaaagatcaaaaatgtaatttctagttttcaacaattagaataggggttgaatgggtctgggtcttgggagtggaaggtcagtatggtccttggggttggggaagggcaggcagagcatagagtggaatttaaaacacacacacacatacacacacacacacacacacacgcatgcacattcacatgataaggagaaaaagataactgagaaattggataataacagagctagtaggaagaggatatagtacaatgaaccctctttagaatgcaggccctttccaaaatgaaaatttgaagggtacttgggctctatttgatgaattatagtgaggtaaagtagtttattaagcatttgaataaacctaaatagttaataagctattgtttattaataaaaggtatgccaacaaggaagtaattatgcaaagttctacagagctgtcaaacttgaaagcatgtttttccccaccgattttgccagtctctactgggaaattatttatgatcattccctcagtcttttgaataagtcaacttctctcagtgcaatcattgctttttcctgggccatagcattaggtcaattagtgaaatattaggcataatactctttaaggctatgaatggccttgaagtactgtatgaaaaatatgagattaatattaagaagctgctatgaagcaaatgttaccagtggaaaattttattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatcaaaaaataaaaaaaaaaagatgttggcatggatttggtgaaaagggaacactcttacactgttggtgggaatgtaaattagtacaaccactatggaaaacagtatggtgattccttaacatctaaatagattttccaccctcagataacgtgcctttttttttttttccaggatagcaactgcattcttcaaagggacagatgaaaaatgtcatttctagttctcaacaattggaatagaggttgaatgggtctgggtcttgggagaggaaggtcagaactaaaagtagatctaccgtttgatccagcagtcccactactaggtatctacccaaaggaaaagaagtcattatacgaaaaagatacttgcacacacgtttatagcagcacaatttgcaattgcaaaaatatggaactagcccaaatgcccatcaatcaatgagtggataaagaaaatgtggggtgtgtttgcgtatatatacacacacacatatatatacatacatatatacatatacatgtatatatacatatatatacacatacatgtatatatacatatatacacatacatatacatatatatgtatatatatacatatattcacatacatatacatatatacgtatatatatacatatattcacatacatatacatatatacacacacatatatacacatatatatacatacatatatatataatggaatactactcagccataaaaaggaatgaaataatggcatttgcagcaaccttgatggaattggagactgctattctaagtgaagtaactcaggaatggaaaaccaaacattgtatgttctcataagtgggagctaaggtatgagaatgcaaaggcataagaatgatatattggactttggggactcaagggaaagtgtgggagggggtgaggaataaaacacattgggtacagtgtacactgcttgggtgatgggtgcatcaaaatctcagaaataaaaaaaaaataaatgaatcaccaaccaccaaccaaccaatatgggagatttgtttcagctggagggccttagtttcttaaagtagttttcttctcttgctctggaaagtactaattccaaggcctcttttctcctcccagttgtaggatattggggattcttactagaaagcgtaggcagagcacatgcagccagtgtccccaagttttttagaccatctggagctacctgtggctgctatgtagcctaaaacttcagaaggccttatgatctattggcagatggctaaactgggatccttgtgtcagggttttcttttatgttatttttaaattccagaatagaagagaaaatgaaatggagaaagaagacattgaaggttgtggtgttttctgtgaagttcaagaagtattgacatttctcagaagagtatgactatagatgatattgttactgtttggggttttttgttggtcatggtggtagtgatggatttttttttttaagagtcacgtttcttcacctagaattagctgaggaaaagtggcatctgtattgatggttttaatagatatgattttattggtggtgccttcagagtagtggcttagagtaattagaaagacatcattgctttgtataggtcttaaaaagattgttaaacttttaattcaatgttggctgagcctgctgtgcctgatacattaaaagaaaaaagtcttatgatttactgaaaagagtaaaatggtcctgatttcagttactcccttctactcatgcacactgtgttgcttactgccctttttaaatccaaggtgattcttcaacctcatacattgttttaacatttcactctatgtctaggacatgtctagaatatttaagtgcctttttcttggaaataatagagatgtatcatacccagttttatttgcttaggtagcagataaagacttcagaaatactcaatatttgagtatttgggttggaatttgacactgtgtgtgtgtgtgtgtgtgtgtgtgtgtgtgtgtgtgtgtgtgtggactcaactagcctaaaagaaagataaatgcctcttagaagctagaggggaaaaacctatgaaaacttagtttgggatgtacctatgatgaagaatttgccctctgatttctcttccatgtggctgattttgaaggttgtatagtattttgtttttatgttttgatacagctgttaattcttgaccattttcctcagaaattggcatttccagattggcaaaatctagtatcattgtaggtagctctttacagataaatttgtacgggagagtatgcaatatattttgaaacttctgtttttgtgtgtacaaatctctaaatcagcccagatggtggccattatggattagtaatagcaagaaagaaagctgttaatatcacagcttctaacatatgtctcctgattgtgggtatatatgcctggtgtcaaagataacgctacagcatacctattacggcttttaaaaagttactaaggcatttctatctgtatcagccaactagaaggatggattagacaacatgatatatgtagtgcttttatctctggcaggtagctaagtctttgaaagaagatatatcttctcatctggccagaatgttttgattttaacttgaaatttcctaacaagagttcttatgtgtttattattgcatgttcttatgtgtttatttttaaaactatcctttagcatttaggcacattaatttatagcacctgtagagcaatcagttgcaatatctgcatatatgccttttattttctgtaattgagatctgtattatatttatataatcagtgtgtaagttactctaaaagttatctagtcaagcttgactttaaagatgtctttgtaacttgttctacattgttactgtttccttcagaaagttaagtttccaagcttctttaagttacattctagacgttccgaggggttccaaagtgttgaaaaggaaattgaagtaagctttggaatatgttaataagcttcaactggaaacatgtatggtagcagctgttttaaaggccgctgatagtgagatgttaattgagtactttttaaaatatattacccaaccttctctaagctctgaagcttcaattacatttatcctaggcactaagacttgaatccaaaggggttacttcactgctcttcttgaggttgggggtcctatgttattcactattgtaacagcaacagattataatgattggtaggcaaccaaatgcttgctgatttaattaaacttgcctagttatttttaccttattgtaaattttggtctatagagctgaagagatttctccccttttctttgaattaagaaaaagccacatatgtgtggtaaactccccttcaccataatgaaactactttttcttcattctttgtaaaatattaacccagtagagtaaaaactgaattcttccatgaatggtggtatttcttctatctggcaaattaaagcaatggagaccattagggtataaccctgaactttttgtgctccctccaccctggtccgttatttctttggtataaaatcagaagaatgaaatcttagtagagttctcgtaccactacacaagacaaggtaaccatgctcttgaaatagatttaattttagatgttgagtgttcctaatgggtggcaaattatttatgctaattgtgaggaataaattacttatagatttattaataatttacacatagtaacttaaggttcaaagtttgttaacacttattttatatatgacattcacatcaactgtatgaggtaactagatttttctttttccatctcataaatgaaaaaaacaggttttttgtgaaaatgcaacttgcccaaagttgtagaattagatttttataaacagatctgagttacttaatatgtgtagaaatctttacttgacaaattttcgacattgtaaggtttgtaattttatctcagaatcctagaattctagagctgagagaaacttaagttgatacaaatggaaaataggttctttattgagtgccaggttaatatcaattgtagctgttgagacttggagttgagacatttttattgacttatttccagtttattggcagagagtgccctaattgattaaccatgcctgaagtagacatggggcaacatatagatgacaaatatgtggcagtcagactcagtaacttgatatagcattttgaaagtacctaatatagctttttacagattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaattaacagcgggaactgcggccactgattgggaagcctaaatacaatgagggtaattggatcccaggatggcaaggaccagtagcacttaattgccaaaggaagggcaggtatggttactgaaatggacagcagagtcaaagcaacaattagaatgaactgactagtacagggtgatttcttttgctccaagcaggcccctggctgttctctggagattctttattgtccattcttctccatggccctatctgaaatgctctttggggagcacatttttcttggggactacacagctttcatagctaacatattactgttgagggtttggagccatgaattattttagagatttaatagctattggctgctgcagggcagttttggggtttccatgacaatatcgtttcgtcaaaaaatgtcgatatttttcttcttgtttttagtaagctccacgggggagaagccacatctagacatagtttcttagcctgaaaattcttctacttactggcctctgtgctctgcccttttctttcagcttttgagttaatagccagctgcctcgaggtaggcaacacccttaatctgatttttgctggctagttttctttcctgtcctgaagggaactcttaaaacagcttggggttgtggtttcatctcctgctaagacagccacttctctgagttactgcttataatcacctcagtttgagagtacaggagctgttgatgtttatagtcctccaaagcttcaaattatgtgactttcagtcgatttaaattgaaggctgcaggcacagaatggctggctcaagttctatttggtctctcctaggactgggctcaaaagctgcaagaggaaaccatcatacatccatatcccgaaaatgtcctacatttccataaactgtagcctcatttggcatatggtattaccaaatgttttgccactacctaacaagagtaaccagctttaagagtcactgtgaattggttagagactgatgggattagttaagactaattttccttaaagtcttttcttttccttgatataggtatattccaagtgttgatgggcagcttggggtttatttactttttagacttataaattgggagaaattaggactaagggaaatgattttttctaaggacatgaacatttataaaagacaaggaaaaagtatgacggaagaaatatgtggatgtaattgccaagaaaggagttcatcagtgatgggtaaatggtcaagaaaaaatggacagtgtgatctctgtgtgatcctgttaatatatattgtgccagccattttcctatttcagccaccaagtgatgcagtttacccagggtctgggttccagtcctcattgagaggaaccatggttaagaagaaagtgaacttacaaccaggagtttatatgttctcccacatttacccttcggatggtatctaatcattttctcctctaaatgaaatgtattacattctcttgtggctgatttctctagtacttatcttatatattcttaaacttacctttatgtaaatgtgctcaatcaattttagtaagacttaaacttcctgagctctaccttttaacagcatcctagactgagagttagtctcaaaagtcaagttctacaaaagaatcctttatgctgtttaacttaatatgttgtagtgttgtgacttctctacctttcagtgtttcttgattaggattcttcaaggtatttcttttgtttttaatcttaaaaaaattaacatgtcaaataagagaataaatagtacctggcctttattagaatcttattttccataatgttttaaatattttcatatcctatgagatatgaagggaagagttatcaaacaataaacttttgaacaccaactatcagccttttactacaccatgaggcttaataatagtaaatagtagttggtttttattgagtgcttattaaataccaggcacagtggtaaacattttatcttatatatattcattttatcctgacaacaatcccaagagataggtggtgttatcttcgctttatggatatatgtaaaccaaggctcagagagttgtaagccacttgcccagggttaccaggctattgagtggtaaagctaggagtctaaggaagttcaactccaaagtccgaactgtgtagctaccttgctataattgtagatggtccctgccatttgggaacttggtttaacagaggaagtaaacacggaaataataaattgaatgatttccctttcttagtttggccatagttgttatgatcatttcataataatcatttctataaatgtaagttggcacatatgaagcacctttggtatgatgtcagaatatcatttttgaagtagtgaactaaaatggcatatcaagtgacccaaaatgtcatgaagctttttggaaacattcactctacgaaatttattgaacaattattatggtccagggtcttctgggcccagagggtacagttgtgaataatatagaagctgtcctttctgtcatggaacttgcaagttagagagggagagacaggttaaataattctacaaacaattgtttaaaattcaatggtggtgagtgctgtgaaggaagccatggaagtgctgcaacagtataaaaagggaactgaacctacttcaagagtaagaatcaagggagtgattcaccttgagtagagctgtctttcaaactccataacatactttaatattttatcagtgagtcttgtaattcttgatcgttattctttctactagtatactgcagtcttgtgctttgtgagcaccaaggggaagagagcttaacttggtctgaggggaaatgaaaacaattcttagatacttaagctaaatcttgaagggacagtagagaggaattagaccaggggaagtatattctaggcagaggaaacagtttgtacaaagtttacacaaaggcattgggggcagatgagaacataatcctttaaagataattatggttagtatagctggatgcggtgtgtgtctagatggtattgagagatgaggctggaaagatagatagaaaatgtgaaatatttatgtaaccaaatctggtttctgtagagttggtctattaacttttccccatatttcagaggatctaagagatatgagattttcttttctcccccatattttaattgttagcattgttaaataaagtgtaaggattggcctaaatagatgtatagtgagatatcttatagttttaaaatgtatgtaatgcagtaattttaagggttgcagtcagatacccaaagcaaggcaattaattagtgaaatacatttggatctcctggctagactgaggcttgagtgttgtagaaatacatattactgcatgtgtataagattgggtctgcctgaagagaaggtttaagtgtggtgttccaggtatattccaatggtgaggcagaatattttgttaatgatcaaaggagaaataagagatcaagtgggaggaaattattaacagtgaaagcaacatgggcagtttgatgtagagcactgagaactatgtaggagacacatggcttgcatctgagctggcctctaccactgaccataggcaagtctctgggtattttggaatctgaatccaaacttcctattgaagtataacatggcatacagaagagtatataaattataagtatgtagcttgatgagcttttacaaactgaacacattcctgtaacagcacccaagtcaagaaactagaatgttaccagaagccctctttgtgctacctgtacttccatttgtttaatctttaaaataggggtaataatgtcttcttcacttttagaagtgctgagaaaatgacaacttgagaagtgccttgatctctctcagtgttgttatacaagtgaaatgagatgctaggaagtaggaccagcttccaaaattgtagaagtacatagagcttacttatagtattattagtaaacctattaaattggggatgcataaggagataactctgaaaaccacaaagcaaaggacaaaacagttgtctaaaatgaatcataaggatgcatgggcatagtatatgtgatgtcttttgttcttataaggtgtcattcttgggattcaggagagcaacttgtgtatttttacctgttcaaaaaatgtgaaactattctcattatttgaggatgctggagaaatggtagcttcctgaaataaaagtaagttctgttttaaaaatagccataagtcttgaattcaccaaatatttctgtttgggtttcaggaggtctgatgctgagtctctttttgttaatctgaatgcttacgaatacttttagaatgggaagtcctccttcatgttcttaatgccattagctaaattgatttttttcaaagtaacaaagtcatcataaatgaaattacatacattagtccccacttatccaaggttttgctttccatggtttgttacgtgtggtcaacagtagttcataaatattacagtagttcaaaaataaagtattttgagaggggggagccacatttttgtaacttattatagtatattgttgtaattattctattttattattagttgttagtctcttactgcacctaatttataaaataaactttgtcataggtatgtatgtatgtatcagaaaaatcatagtatatatgggatttggtgctatccacagtttcaggcatccactgggggtcttggcatgtatcccacgtggataagggtaggggactgctgtactcttgtagtactttttgaaaaagtttcaattttgtttagtgtaataacagattgatgcataccatttcttacacgacactagctgtagtcaccacaataatctgcatttttctatcaggcctatttgctttccaattctccatcatctccctgtacaggtatcttattagatccccttaagatctattctgtcctttacctgtatacagtgaactaagacttttaatttctataaggtaagatcattttattagcatatttttgtctttgatatataaaattatctctgctgagctcaaaagtttagtaaattttttgattgataatttaagaaagtctttaacataggcagtacagttataagggatagacaaatagagcagctttatttataataaacatttggctcttttgcaggatttccagattttaagatacactgaacccagtttatagccttttatccctcacgcccccgacctttccctcccaccagtccccaaagtccattgtatcattcttagaaacattctaagaacttcatgttacagttctgaaaactgttacatttacacttgttgtatttctgaagactttgttacatgtgagttacaggtgaatgaatttgagggaaaaactgacaaaactcagcttgaaaaggaacccacagtgatttctctacaagggtattttttgaatttgtgaataatttattggcagcttgctttgcaaaaaatacacaaaaacctatggaaataaaattttaaaaaaaaagtcaggaaagactgcaaaaaccatgaccttgcacaaaggccattgcaaccgtatacaaaaaaaagaacacttctgttgaggacatctgcccagccttggactggcatcacccttattattgatccttgaagccaaggacaatgacctaaaaacaattatgtaatcttcctcattttatctttgaaaacctttgtcttcctttacttccctaaatacacacatagtttactgtggcacacatattttcattgcaatgccctattcccaaataaataccattttctgtttttttttttttaagaatattttgtgctattatgtgattgatgttggttagtgctattagtgaagaagttggtgctttaaaattgaagcaccagagtctacttatttcgcttaaaacacgtgctaatttttaaaacatatcttcacacctcatgaaaataagaggcattgtgtttaaaatgtatttttttttgtttctttcccattaaaaatttaattgtggtaaaattatataacataaaatttgccattttcaccatttataggtgtacaatttagcggcattcattgcatttacaatgttgtgtagccatcaccactatgtctatacctttgtgctatattaccctacgtagatattatgggaagaaggaaaaattcttcccataatatctacaatggtatagaattgttaaatgatttcttaagatagttttattattttagatctggattaagaaaatcctttggtaaatgttatagttggatctgattggccagaattcaaaccagcaagtaccttattcaatagctgcttttgtaggcacaggtattccagtaccacagggtaatgagtatttcaaacaaaagagggttagagatatgtctaatgtttattgccataccctcaccctctgggctttgatctttctggtggtcttaagttactactatagatttcttccttgctcataatatctatttggcaatgggactgaaatctggtaacttctattgggaacaaaccattcctctccactgtggaaatggctgttgtctcataagtattctccctcctgctcccgactgttaatactaaatctttgggtaaataaagttactcatctgtacaaagagattggagaccagtctaattcccctatttgaaggaagccccagagagttggaactaatagttaagtgatgcatttagaattagaacacacctgttccaatctccaatcagggaagttgattgtcttgtggtggttgaagaaacagagagggacggggtcagcagaaaaacctatgaataaacctccagtgccttatggtttttcctgaagtcagaatttagagcttgacaaaatgaaagtatttatctagttctaacccactctattaaaaatgaggaaactggcgcagagtgactgtaacttaaaaatatataaccagttagttgcaaagctagaactggacacccgtatgtcttgacttttgccctagtgccaaatatatgagagtgtgactctggccctgcctctaatagtttatttgcctacaagatatttagtggaattgtcagtgccacattactgtagaattatttcaaaagaaatatttttgatattctggttttgtatccccttctaaccaattaggaacaagatatttttagtgccagttaatagtgcagtctttcagcagaaaggaatctaaatcaatatgcagtgttaaattcactttaataaatgtgaaaattgtttttaaagtaaccattgattataaagagagatgctttctatacattttggtgggtacatatacagtatttttctcatataagtgaatacttactatatactattttttaaaagcctaaagtcctacagaacataaacatataaggcaactgaaatctgtacaccttctcaatatataaaataagtgaatatttgcttctaatgaaagagataaagattagataacttcaacaggggaccttggcatatgtctgataatagatatgagacagggatagcatattgattaaaaaagtcatggactttggatctggaatttttaggacccggattctcactgaaccagttacttgatctggggctatagccaagttatttaacttctctgaaactcgatttccttatctgtaaaatggggataaatatgctaccttagagagttatgagaattaagtgagttaataccagtacctcttagaaaaatgactggcatatagtaagtactcaatagctgtaataataataataatataccaatacatactaatactaataaagtatctgttactaataattttatcattgctactgttgctcttgttggaagattatggtaaaggtgacatgtgaacagataatccttttatgcttctatggtaagtataggactttttacctgtggatgcttttgactacttggatttaaatacaaatattttaatcataattaaacaactattaatgaaattttttgttaagaaaatatttcccagtccagatggttccactaagccagctccttgatcagttttctgtaccatgcagttaaactattttttccattttcatgtttatgttcctgaaagtatattcattgggattacttttttctgtttaaatactaaaaccaggctttttaaagtatcaaattgtattaatcatggtttccactattttaagtcttcttttgtactggtattgaagtacattttttttttcttcatcattatacactaatgtactaaccaatatagcttttttaaagaagcattgttacacctccctgattatgcttcatttaaaatgcagtcccctacagtcctctccaccaatccccacccccaacctttatattgttcttaacatcactttcttcaataactctggagtgagggagcataaacagtaggttatgggtgaaagtgaaatggccccatagtgctgtttctgatgactagaagagtagcatggctgagtcttgcagtacaccaagatgttctgcatgagaggataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgctaactggactgatcactacaactgtctttattttctgatgattataatgcattttatctactagagttgaggttttagctgagtgatcactttcaaaaagaatgattagtcttgatcaatagtgtattacctatagatgagacttttagcataatgcaatttccttagctggtgttgagatccatttcatctgttcaggaaatgaaagcaggagatatatagtactttggattgtttgtattgcagattagctaaatatttgtgggaaatcagaggtctaaaacatgcttaaaattctagtctgatatctggataaagaaaatgcagtacatatacaccatagaatactatgcagccataaaaaggaacaagatcatgtcatttgcagggtcatgggtggaagccattatcctcagcaaactaatacacgaacagaagaccaaacactgcatgttcttacatataagtgggagctaaacaatgagaacatatgcacatggaggggaacaacacacactcgggcctgtagcaggggagggagagcattaggaaaagtagctaatgcatgctggacttaatacctaggtgatgggttgataggtgcaacaaaccaccatggcacacgtttacctatgtagctaacctgcacgtcctacacatgtaccccagaacttaaaatttttaaaaaaaaatctagtctgttatatggtagtaacagactattagattggtgcaaaagcaattgtggtttttgccattaaaagtaatagcaaaaactggctgggcatggtggctcacgcctgtaatcccagcaattttggaggccaaggtgggcagattgtctgagctcaggagttcgaaaccagcctgggcaacatgctgaaaccccgtctctactaaaatacaaaaaattagctgggcgtggtggtgtgcgcctatagacccagccactcaggaggctgaggcaggaagaattgcttgaacccaggaggcggaggttgcagtgagccgagatcgtgccactgcactccagccttggcaacagagcgagactctgtctccaaaaaaaaaaaaaaaaaaaaaggaacaacaaaaactgcaattacttttgcactaacctaatacaatctcattaagcacagtaactctgcattgtgtattgtagaagcaccagaattttcttacaaatgaaatgataatggctttttgatgtgttccctagaaagaattgtggtccatcatcttttcagtagatatactttttgttatttagtgctttaggtgttatttgctaatattacagccaaaataaaataggaatgtgcagtggaactcatttcttctctgttatagctggctctttgaaagttgtttgaggaaactctaattacctacagccctgcaatgaattgcacaacagatgtactgttttaaagtcttgattcttgcatgcatttttcaccttttacttcagttttagtctttgatttggaacacttaatgttaagcagtataaatgtgtctttctaggtgacataattggattctctctctctctctcttttttttttttttttttttttttgtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgaaattttgcattttaggtaatattcaaatgacatcatttcagtccttttgtttgttattacttctgacaaaagcacttttctgtaagcttttcatttattttactcttcagctatgaagtatttgattatatgaggacacaggaagaaataaggagtagcccatggccccagctaatgtgttagacatcttatacaggattagtgctagattagttccatgaggtgatttgaactgtcaaggtcatcaaaaacaaggtaagtctgagaaactgtcacagccaagaggagctgaaggagaatgatgactaaatgtaatctggtatgctggatgggatcctggagcagaaaaagggcatttaggtaaaaactaaggaaatccaaataaagaatggacttgagttaatgctgatgtatcaatattggtccattaattattacaagtgtaccattctaatggaagatgttagtaataggggaactggattcagggtatatggaagtctctgtactatctttgtaatttttttgataatccaaaactattctgaaaaataaagtttattcttttaaaagaacagcatcataagaggtgatctttctgtttagatgacctcttggtagtaaggtataagataactgtttaataaaagcacaaggagcataggtaggggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatactttcctggacttttgtagtgctattgttttagtttgttctatttctttttaaggttaccttctgtttatggcaagtgatactgtttcctgttaatgaaagtggtataataaaaaaaaattacctaagtaaagagagtcaacttaaaggagatttcctgaagaaagagattcagattatgagaagaaattggtatgagagagattctccattgctggcttgaagatggaaagggttgtggcacaaactgagtggcccctggctgatagccaacaaggaaatggaccttcagtcctacagctgccaacaacttgaatgaggttggaagtggattcttccctacaacctgtagataagagcccagcccaagtaacttcttgatttcagcattgtgagaccctacgcaaacaacctagctgagacacctggactcctgacctacagaaactgttagataataaatgtgtgttttaagccggtaaatttgtagtgatttgttgtgcaacagtaaaaaactaatacagcctataggctttgttcttactgctcttcaaacagagaccatgccctcctccaccaccaccaccagttcccctaacactgtgtctcagttcttttagtggttacccttaaaatagcaacatgtattatatacttaccaagtataatattagtcagtctcattagccttatctcagccaatgcaaggatcttaggacattttaactttattccttcctgatttacatgttaatgtctatcatatattttaattctttctgtacttgaaaactcagcaagacattattattacttacatagtcagtttacttaggttcattcacatatttatgttttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggtacatcatcattctgttgtcttctgatttctattgtccactgtcaaactgtcacttctttggagatactctgtccttttattacctctggttattttcaggtttttgctttgtctttatttttctgtagtgtgtctaggtataaatttcttttgtttatcctgccatgattcagtggaatcttgaatttgtagatagacacatctgatgaaaattctataaaaagatcctatgaaaaattctcagccatttcctcatagattttctctaactcattctctctttcctctcctgctgggaccccagttgacatacattaaatcttctcattattttatctaagtttcttaccctaattctgtgtttttcacctttttgtttttctccatggtgtattctggatcatttattttgacctatatttctcttcattaattttattcagctttcagttcctctgaaacccatccattgagttttaaattttggcttttttttttttttttttttttttgagacagagtcttacttcatcacccaggctggaatgcagtggcgtgatctcggctcactgcaacctctgcctcccgggttcaagcaattcctgtacctcagcctcctgagtaactgggagtacaggcgcgcgccactgcacccagctaatttttatattttcagtagaggcatggattcaccatgttggccaggctggtctcgaactcctgacttcaagttatcaacctaccttggcctcccagatcgctgggattgcaggcgtgagtcactgctcccagcctgtattttttgtttgtttcaatacctcatgtattttgtcttttatttttgctaattctaagatacggtatcttttcttgagagcatctgcctaccaggtttaggggataggacagctcatggccaggactgctttaatccaactttaagatttaaaattccatggaccaccagataaaagagagccaggctccaagtccatgcgaggccaggtttgttttgggttcacctccaccctaggcgtagcctttcagaacaaaacagaataaggtggaggttggtttatcaaatggactgtaggtattcactcactcattcattcctatgaggccctatgagtcctatggggcagttgcttcccaggggtggagaattaccctccaggcaaaagtagttttatgtgattgaactcactactgtgagttccctttttctcctagatcatcaactggcaaaatttaagtaccttataagatatttgatactttcaaaaaatgatggagaggggaaggttttattttgtttttcagtaggaaggctagtgtaggttatctatttcatgatcattggaagcagaactttctctggcttcttccttgtttctttgttttggtagtgaaagggtacccttttggtatggcagacatgatactttttaggggagaagtaatgaagaagtacttgtacaatagcagatgagccccagaagaagtctcctgttgttcgtatgcgccagacacaaccctttatgccttgttatttcctgtactgctgagaaccctctaaagtagctattatctccatttcacagtataaataaagtagccccagagagattgaataactggcctctcattatagttagtaatgagtaatgggcacatccaggatgcagccccaggtcttttgagctatcaagcccttgctctgtttatgttgtggtggctttgattcaaagaggaaaaagttaaagtctatcaggggctaaagtgcattctctcaaggggactttcccataattatggggtgtttgcagctggagtgtctgtacgtccaggttgcctgggcttgccaaaaggaagttgtaagttcattgtaaaatattaatgtgcagggattcttggttaatagaataaattattttttctttaaaaagttcaatggtctctcagtggagctgcctaaaaaaattcatgttaaaacatcttgttcttttacatgatctcaagccatctgtttgcatctatgatagatattcttcatgcttcattccctatttcttccctactggttgatataaagtaaaggattccattaaaggacagggcatagtaattgcatatgtcttgatttttaatgaattgataaacagtcattggccaaaatgtttctaattttatgatctcatcctgtgtctatttactggtttaaatttgtgctcaaaattgtcagtcttcagtccagcattaattaggaaccatgaagttttctttgtcatctgagtcttaattgagtttatatacctctaacttcacaaaaaggtgatcatgtggataatataagtagtttatttccatttaatgatattttctggtggtaagctattatagtgattgagtgtcatatttcatcttgccagatcatacaaactgaaatttttaagcaaactattaaaacatccaaaccaacaaaaagcttgaatgaattctgagctaatcattgtcacagctgattttgtaaacctttaggttgaaaagctttctgaattttaggagctatgtttggttcagttctctgctattacaaaatactattttgtaaaatgcctcaagtttataaggcctattttaaatcattaaagtatttaagaacagatgttattacatggtaaaagttaaaaagtctgctttctgagtcttagttatggtatcactggaaggattttgaattagcaatcaatgtctctagtaaaacaattatttttgaagatgtgtttaaaaaatagttaacatgttatatgattttacagcttttgtttacctttcagtaattggcattgacaaattaacatttttatttgtattagataagtgaaaatctcccccaaggtatcagagagctatagcttcaaattaacttaaatgtaactatgctaatgtaagtgtctggaagatggcacccatgtttgtgcatcctaaaatggatttatctatttgtccatccagtagcatttactgggtcttcattagcacagtgtcaggcacagttctatatgttagagactcaggatggataagagaaaattcctgccttcagagaactagtttagtcaactggtaggtcctttattaagagctgaccttcagttatgcataaccgtgtttgtgtagaatactgtaacccctaactttcctatttgtgtaatatggaaggccaagtgatgaaattgttattaaaaacaccaattcccaaacagtgtgccatgattttaatatgctaaatagactgtggcaatgttagatttcctttttgactcaggaagactgtgagggtgagtgagtgagtgagtgaggatgtatatgtgtgtgcatgaggagacaacagagcagaacccctagtctagtatgctttggttagttggtattcatcaaaccccaaaagattgagaaacatcgttgtttgagaccctaaaattctaaggtagagtgaggaatcatggaagactacattatggacctgatgagtttaatgcctgccatttttaactgagtatgttgatcataaaagaactgtagcttgtactctcattttaaatagactggactccttctgtaatagggattgtcaacaacaacaataaaaagaatggactcctaatgctagccagaataaaataggttgaaaatgcacagatttccatttccagaacaaaaaggcgtagacttacttttcactgccccttccttcctctataaatataactaaatgtcctggaaattattcaactgacagcaataaagggattctgaaagttgggaagaaagcagagtagcttggaacctcaggactagaagtttgaggacaatgagtataagttcactgggttttcttttaatctcccattttctcctagactgggtgctggagagacctacaacccagaatcaccagtgggcaaagaaagcagaacaaaaagcctgctttctctggctagaagaccaggaaagggaaagcccaacaaagacctaagtgggagtgctcatccccactgtttcacagtgggtcccggtgggcactctgatctgtccccattatggccccagttgctgcgggagcagcaaagcccctggccctcccacccactgctctacaactggggccatgacgggtggtttgttctgccaactacggtgaagaccagaccatttcagcccctgtggtctgctctgtagacagcagcagcaacagcaaagcccaggctatactgcctctgctcccaactggccccagcaggtggtctcttctgtagggagcagtaagcagctgcagccgcagcgaagccatgtgtcttcctgccctccacctcatggcttaaggagacccaggccccagtaggtgaccccctccccctcaaggtttcccagcaatagcaagtggccctgggaagtaccttttatccctgcagatggcatcagcagggattgagtgggagtcccaacatcaccagaagaatgaagcacaccaaaatagcattgtgagggctcagaaaactaaactgtcattggaactgaagcccacaaaagtagtctagaacctacacactaaacctaagcagggtgaccaccctgctaaaatagaagatcctgtcatcaagtcttctaacaataagcaaaacatccagggtacaattgaaaaccacttgtcatagcaagcaccacaaaatatctaggatacaatatgaatgaaaaaagacatcaactgatgccaatacccagttgaatcagatatgggaatttgataaggtttttaattcagctgtcatgcaatttatccaacagtcagttgcaaattttcttgaaacaaatgaaaagatagaagatctcaggaaagtagagccaagagcatttcctaatgaactggaatgtcagagaaaaaaaaagggtcaagaatggtgccataatttttggctaagctatcagaaggaaatacggagttgccttcaactgagatagcaagaggagagattagaaagctcagttcactcagatgttttgggggatctgattgccctttctcttgtcttccatgctctcttgtgtgccttattgattagcaggagtcattacggagactgagaggttggtccatccatgggaaactcgttaaaagtgagcattactaacttgcatactcacatgcagggagtttggtttcttacctaacttgaaaaattccccaagtgtttagatgtttgattttactatgtcgcctaaacagttacatccactatactcttattttcaaattttttcccctaaagcaattattttccagatcatctactttatgtctttagacctagaaactgattactacaattatgattcaaaacctattttctgctgccctgcactgagctgagtaattgggtgtaaatggttatttcgtttgcatgctttgcctttgtgttaagtgttttttggttaaaagaccagaggttgcattattgcctgctgaatatgcttatattaacaattgtaaaaaagtaaattacttttgggagtattaatgaataggcacttaaattgcatagttaaatcttttccatcctttactaagcaaacaattggattaccccccataagaatttaattgacaatttccatgccacatttgggtagggaatatttcttacagacaaaagttgtttgaaatcagaaggttcttagccatttcaatttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaagaggagtgttcctgtttagggcagaccctgctaggccttcctgtttgttatctccacaagatattgtaccttaagagcttgcctttagcactttttctttttcctttctgggcttcttacagtctttctatggggatgtttccagcagccccttggggaggggtttggggatatattcatgttttctggggctctgtcctctgtatcctgaagtgctgtcattagcagcaatggcttcaattacctctcattcactcatgctacctagggagtatagaggttaagaatttagatttcaaagttccatatgtttaggctccagtcctagctctaacatccactaactgtttgaccacagacaacctcttagcctcagtttcctaatctataaaatgaggctgatattatattagctatgatgacaaataaattatgataaataacaagaatctatgtaaacttcttagcagcatgcttgctgctgacatgttatattataaatgacagttgttgatgtcttcattatcatgacccgttccttgaactttatactcctatctatatgccctctataaatctctgcctggatattccatggaaaccaatattttccaaacatagccatgtgcttcgtttctttctcagccttctatcagttctttctcttgtaattcctttctcatttggtggtatcattcacccagtaactgttgccagaaatttgtaagttttcttacaactcaaccccaaccaccatctagctaatcattcactgtgttatcttgtgaatttattttcttaagtatctctctgtcgcctttactttatcacctcttgcttgggctaatgcaataacttcctgagtggctcccacccactccacaacgtctctcactctctgtcatagtgatctttggtccccttttccttttccagccacttctcaccctccagtttttcatgctagcagtaccaaatagcttgaagtgcccagcacacacttttttttttttttttttttttttctgagacagagccttgctctgttgcccaggctggagtgcagtggcatgatctctgctcactgcaacctccgccttctgggttcaagcagttcccctgccttagcctcccaagtagccgggattacaggcatgcaccaccatgcctggctaatttttgtatttttagtagagacagggtttcaccatgttggccaggctggtctcgaactcctggcctcaagtaatctgcccgccttggcctctcaaagtgctggagttacaggcatgagccactgcaccctgccagggcccaaaacaccatgccctgtgttttgacttggctgtaggccattgcacaggctattacttacctctggaatcctctcctttccctgcttagcccaacaaactcctattcattgtttcaagccctccaggatgtccgtgtgtcatagaggccttctctcagtaccatgctatccacagatttttaaaactcatagtgttatactatttctatactttataactttacactaacattatatataacgtatgtatacatacataatgtatatatgtatgtgtataatgtatatatacatatgtatacatacatatatagtatatatagtatatatacatataatgtatatatactatatattatatattatactatatatactgtatgtatattatactatatattatatgtatatattgtatgtatatatacatatatacaatatatacattatatatacatatatacatgtaatatatatacattatatatgtgtatatatacatgtaatatatatacattatatatgtgtatatatacacgcacacacatatgtcaacagcagcctactagattggaagttccctgaggacaagaattgctttattaatctttttcttgtttattctttatattctttgtcttattttcattggggaaatgaggtaaataagataaaatgtgcaaatgtcaatagaatttttaaaatcttagtgctttaatatttatttttgatttagctaagattgcctaaagtgtgtaaccaagtcagaattctcacttttgtaaggtttatcttcatatgttttcttgcttgtttctttccatgcatgtctaatctccttcttcacatttcttatgttataaaaatcttttttcttctctattaatagttcttgatatatcctccatcaagtgtgagctaacaaagacctagaatcgatgtccctctacattggctctaaccccagcccttctcacacacgcatgcacacgcacacacgcacacaaacacacacacacaccaatcaaattttccagaacctttgctttgagcagaaattgccttatgtgactggcagtcctctcataaaagtagtaaatgatgagtgtattatagttagactcagaccagaagatggtgtgctacatgaaatctaaagtgaagtctactaaacttcactgaagtatcaaggtgtgacagaggtactaattatgtcaatataagtactgagttagtaaatgctagtcttaactctgaattgttcagctttgacaggtgagctagatttgttccattagcttattggagattcattgctagctgtttcaaataaacctcccccttctattttcaaggaatgatctgaatcatactcctttgtcaagtctttaattgttaacatttaggcaacagttcctgagacttttattttaataattttccactccgtgtgtgttttttgcggtagcaatgagtaggaaaacttttttttctttggtttaatcactgtacctaaagcaactcagcttggtgaatgtatgtaagcatatgtgttggagctggggatgggtaccagaagtgttaaaaagtgtcaggacagcatctctgttcccttactgctatcacattgattaccgcgataatcattgtcacagctgattttgtaaacctttaggttgaaaagctttcacaaagctatcacaaagcacaggaagacaaggaaaggatttattgatgaaattatatgcataagctcttctttagtggcaatgactacactaaatagtgttgaaatagggaacagaccatcgttatctttaatcggtagagtttttatataaatttatatatgtctataattttcaagattttattcttactgctaatgttgtcatttatagttattttattttagctttgtttcctttttgcctacccaccatctatgtccctcaattcttaacgtcagaactgtataaaaagtagtaggaagacacagatttagaaaatgggtagagaaatatctagaagcaccatgatttctcaaaattttatgtacttacataaaattgcgttacttaataaatgtatcaatggcttattcatttctagtttgtcatttttcttatatcattcaccagatattttttgagggcctaatgtgtactgggtactcattaagtttatattttaatatgaatacacacacataaatataacattacatattataagtatatatgaaataatataaatacatgtatgtgtgtatatatgtgaatacacacagtttattctcattattcatggtagttgtgttctataaagttaccatgaatgctgaatgaaccaatactgaaccattgctcctaggggaagtacaaggttgggttccttcaaacctctggtcacaacattttcatcaaccgatcaatacataaccttgttttatgtgtgcttctgtttaaagatactgcatgtaatatatactgttgattcattaacattgaactcacagccaacattgttataactcatgcctgaaggaagcttccctaactcacgtattttccccataaggcacatcacagccttcttgtgcttaggaacactagacagtcccttcagcactatgcttggtgaccatattaaacagcaaaatcaccaagaaaaagcgcaaaatgcaaaaaaatgctctaaatagactttgaaaagatgacttgttgatggcatgagagctgaaacaagaaggcagagcatcatcttgtttgccctcagctggcatcatgcacattgggtgattcaaatttttcaccattacatgcgtgcctgtaaacgactgaaagtgccatgactgttgatttgggggttataagtgaattttaccaagtaggcgaatttacagacatgcactctgcaatgtaatgaggatcagctgtatatcaactttgtgtgtgtgtgttgtgtatatatgtgtgtaaaaatttgttcttggccttcactttccccatctttgtcttttcttttttaaatcattcacggttttcctacgtatcttgtggtacattgcacaattcattataaatgtaatggggcttctaggcctgttgttatggacagaaatttcattgcgtttattaaaggtttcctgagacatgatgtgtttttgtttatagacctctcatagggtgaaaatttaacatgtaactccaaagtttatatgtagcaactcaaagtattattttaaatttattacaattagatataaaattacaactgacaattcatattgactttattatgtttgagatgcagtgtttttttgaagtgccttcaaaagccctttgtgctcctccccaatcacaaccccctccccctcaaaccactatcctgccttttatattaatctttttaaattctctttatagctttaccccctatgtttgtatctctaaggagtatattgtttaatcttttagaactgagtagcaaacacaaacttagctgggtaaagaaaggacaatattactactattgtatgaagacttaggagaagagaagctgaacaagctcttgttcatagtctggcttcagatgttctgagagtggttaggagcccattctgggaagtcggttggcaaggtcatgcacaaataaatcccgagacaaggggctcttcacaggcaggacatttccgctgtagtgcaggatagggggaggtactgagcacccagcaggaatttggtggggggcactggctgccctgcatttcctgctcttcagctccctgatgcctgcctcccattctcaggaataggtcaaagcaggcactgctgtagggtgaaattaagagtcctctgctagtctaggcagcagagaaggacagaaatctcctcagccaattgtcaggaaaagaaaaacagaagaatctggatgcagctcacctacctattctgttttcaggttaaaaaggtggcccgtggcagtggaaaactgatggctctcagtctggattggttgtcctctgtgcctgaggcacagctgtcagcctgagatttcccttccttgcattcctggggattcccttcatctctcttctgtgttggatctcctatttgctgtctccaggcatgctttttattggtctattcttgttttagcaaacacgtcctacaataatttcttcagaaagtgtgcatggcaagtaatttattgaccttttttgtctgaaaatgtccttatggttaatgatggtctggctggatgttgaattcaagattagaaatcattttccttcatgattatgatggtgttgctctattgtcttctagcgttggcattgagagatccaaagctattctgggtgaattgtgtcatccttcctcgctgcacatctttacccccacttctggaaacctgacaatctccttgtccacagtgattttaaatttcacagcagtgtgtgtatggacatgggtcatttattttgctgagtacttggtgggtccttttaatttgagctccttatgatttaaattctgggaagttttcttggattattcccttaatttcttccccttcattttctttgttatttatgctctgcttttcccaaattatcggccaacgcttctattgataaatttctctgtgtgtttttcaagggctcttttgttttctgaaagttctggtttttgtttcacaattgtgatatctttctgaggatattaatggtaatttgaagtcttattgtgtagtgtgtttcctctaagttgctctttttgtttgtttttggttctatcttccaaattagagactcttcagatgtcttaggagccttggttgttgtatacttatgattagaaatagagcaatgattctcaactgggggcaatttgaaccttccgtaccccaggaggatatttggcaatatctggaggactttttggtggttaaagctgcagggggtgctatgctactagtatctagtaagtagaggctagggatgttgctgaacatcctacaatgcataggacatccctgcacaacaaaaaattatctagctcaaaatgttaatagtgctgatattggaaaccctataatagagggcctcaaagctgattaagagagctccgaaggtgcaggtggaacgtgttgactttgggttttgctggaggatgatctagttgagtagtttggagaacctcttcattatctttaggtcttttcttctgagctagtcagatattcaatagaaaagtctttcatctcctgccttaagggtaaagatctggcttccaatattccccctgttagtcaaaaagggactcgggctgtctgcgttcagtgtatatgtgaccacataatacccttgcttttcatataatacccacttcctcaacagccttgtgtttccagttgtgagaccctacagtttggttttttttttttttttttgagacggagtcttgctctgtcacccaggctggagtgcagtggtgcgatcttggctcactgcaagttccgcctcccgggttcataccattctcctgcctcagcctcctgagtagctgggactacaggcgcccgccaccaagcccagctactttttttcagagaccctatgttttatttactctttccagataattaacctgttgggatgagggagcggcagttatccatggtatggagtacaggagaccacctagggctctaactgcttctctaacacatttcattcaaaccttgttactttaactctaccctctcttcacttccagttccagagttatctggaacccattcatgagtttcttggggattctacagtatagatgggtttggttctgaactttccttattatctctttgcagttcagcttttccaggtctgccaagtcaattaccactctccatctgctttcttggattccaaatttaattattactattatctcctctcttgtactcccaatcctttttaaaaacccctttggtatcattgtagtggagtttggatagggaaataaattagatacattgtgctcaatctatcccatgatcctggaaaccaacatgctgtattctagcataatttcatttaattctagtcttattttggtatatttacctttgttatcagaattatttcctagacttaggttttcttcacataaatgaaaactagaggatattagtctgtgtctgcatagggacataattgaattcttttcaaaaccttaggggatattgtagtgatatattcacttctaacatattctggtttaatttacctttttgcttaaaaacatagactgctgtaagcagccatctgcctcaagtagaaccttgttttaccatcccaatcaatattcagaatttgtaaagagttgaataaagaatatatatttcattaaatctgaaatgctgtcaattatctttttccatttttaatacggtcataattagtggaaatatgagaaagatagttgtttatgatgacggcttataactatctctaccagtattttcccccacataaatattcaagaattgactgtaccttagatttaaaattttaagggtgatttcaaacatcaataaaatgtacaggccagactgaaacctatacctcctgaatttttgctgttccctaaactgtcatccaagcataagtaataagtgtaatatagtaggtgtgttacactactttatcactcctccctttttaagatgggaaaccaagccaaattttaaattttttatcagtttctgctgagtttccagttaatgggttaaatcgcaaaaacctcaaaacgtattttagtatctttttagggtgttaaatttggtttaccattgttaaccccctggatgtcattgacggacagacccttaaaatgctttacttgtaacctgtcttcaggtcttcagtagttcatagatataattattttctttgcctcgtactataaaattaaagaattggggatttgatttgatttttattcacagatttttaaaagtttgtgttttgttgtctaagtattctcttttctccctagctctattaattttattgttactaaaagaaaaggggggagaagatatgctttcttcctcacctttgttcaagcaggaaaaagtaaagaattgactcgattgaccatgaacaatcaaccccacatacagatgttgggaagtttccaaaaagatacagtgaattgaagcagactattcaaatgtatcataaatagagtcccaagggtttatgtgtggacaaaaaccaattacatgaagcatttcctgaaattgcttgctattgtcaggataagtaatcagaagtaagacatccaggttgagaatgaaaacgtttgtccctcagtttgtaatattgtcttctcacagaggaaaatctttgaacagttttgagggattatcaaaaggatcctctttctgtagagttttgaaagatatattattaccatttcttttcctcccaggttagcttttttaggttgcttgaaaagagagatttgaagctgtggtatagttgatgtcctcatgatgtcatcttggataaatgtttaagtctaagattaaatttagtagttcgtcctgtagttgaaagaagaaaaactttaaggccagcagtatcacaagtgtagtactgtaaatgaagaacttttctctatctgctaattgagcacatgcatctaggtgtactgtttgtacctgtaataagcgaatgaaggtggtttttttgtttgtttgccttctccccaggagggggaaaatacacgcatgtatacatgtacacatgtatttaatgaccaccatattaaccttcaaataaaccaatcacattgctattgcattctgtattttatagtcaattcacacacacacaaatctatatttggattatcttaactgagttcagatatttcttttataactggtaaccacagggaaccgtgtgtgtgtgtgtgtgtgtgtgtgtgtgtgtgtgtgtgtgtgtgtgtgcgcgcgcccgcgcgcgcgcgcatgttccctggaccagggtatgggcatctttaaatcatctcagctgattcaactgtgaggtctgggtcagcaaatagctagaccagtggctgtgctcatagaaattacttcctttcctctagtaatttcaaacaattctaatttgaagtttgaggaaaattaaggatttctctgtgatttcaggtgaaactggagagggttggagaccaaaccacgcaggcctttctctttgtaaagtgtttgttcaagtcttttgcccagattttattggagtgtgttttttttcttattgtatttacaagttacttatatattttggttcttgacttggactgtatattgcaaatactttctctctctctggtgttttaaacagggatatcatatcagattttcattttttaaatatcattacaagaatgaatgggagaaacaagtttttcagtggttctagtagaagatggtaggatgtgggacatggagagaagaggacaggttcaagagatatttgagataaactcagtaggatttgttagtgatgattaggtaaatggtgggtaagatgagagggaagtgtcaagaatggcttgggtttctggttcataagaataccaccattactatggacttcacttattttgtttaagatgttgataatctatatagaattgtacagtcattatttgccttgagcataagactactatttagaatttttaaaaaattactgcaaattgcaaatttattggtcatttttatggttttggtaatcttttaaaattatctcatgaattatagaaaaatatgttggaagttatattacttaaattttattttgaaaactgtgttcaatttggagtctaaagtagaatggcaaacattatctatattatatagataatgaaacagtaagacattaatgggaaataggaacttaagagaatcaatgaattaaaattgactttttgttttataggggtcccttcagtgttgtacgacgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattgttataaataattaaaataaatattaatagcttctttttcaacccaaaattatcaataccagagttttgacttatctcattgttgtaccaaattctaaatctccccaggctaaagacattctttcgggaaacaattacttaccttctcattggctgaggttgtttattgacagatttcttcagccagatctcttgagctacagactcagaatgccaagctgaacctgtctcttgtcacttggtcagggagtcaaattccaaatttacaaaaggggaaagtacttagtatatagttcatatacctggtattaagtcctgtcttcatttaatataatatatgggagtctgttgctgaagttatagctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccctagccttatgggacctatgttttaatagtctccaaccattgtttataacatggtttttattaggaaaacaatgtgtaataaattcgaagtaaatcatttacaaattaattttttttgagatggggtctctctcttgcccaggccagagtgcagtggtgcaatcatggctcattgcagcctcgacctccttgggctcaggttatcctcccacctcagccgcctgaatagctgggactacaggcatgcgccaccacacacagctaattttttgtattttttgtagagatgaggttttgccatattgttcaggctgatctcaaactcctgagctcaagtgatctacccacctcggcctcccaaagtgttgggattacaggcatgagcctccactcccagcccacaaatttacttttgaaatgaaatgtgttgatttgttgcagaccacctgtacgttttaatattttaaattctcattgctctaatgaagatgagatattataattggtgaggctaaagatgagacatttcataacagatgagatatttttgaatatctgttctctacttttgccatcaaaatcataatttttattttatagggcttcttaacttgcaggttgccgactattcaataatcccttgaaatagtaagcagaattatgtttatttttttagagagtccatagctcttattagattcctaaaaaggcatattattcctaaatgatttagaatttctcctttcacatgtatgaaaaaatgaaattcatgcttatgaacatgagatgaataagaagtttctactaaatcaaaactggatgaatttatattaggatatgacttctgattgggggattttttatacttacatatacagcttccattaatgaatttcctagattattatcttgaacttttaattaatatactttttgtctcttactctactgagccactaatttagagtttttgtcttaaaaatagatatcaaaattaattcagacaaattataataaggaaactaaaggaaagtaagatgtatagaattggaaactaaattatcaaagttctgagttcttgataggactcaattctttatggtttattataaaagtccaaaattaactgtttttatttgggagtattataaattgtgttctagaaagagtatattttgggctccagtttgcttagtcttcaagaatgtctcattctaaagtcccagatagtaggtgatatcagtgaaattgaagaagtaaggaccttgacagttctcacttttcatttaaaaaaaagagaaaactgacagaaatgtcagaatcaactttttcagggctctggaaattgaccaaaggcttacagctatccaggaataatttattcaagaaaactgactgattcttagtaacaacagtgaacttcatagcattgtataataatttgtcccattcacatccccctttcttccagttctgtagtaaccttgaaaacaaacagttcacaatcacgatgaaaaccagcaacttgacagccatcaaaggaggctgaatggggatggagctcctctaaggccgcattcccataatattgtcatttttttacttgtctggtagttccctggaagacttgtcttagtacatttgtgtttctataaaggaatacctgagagtgggtaatttatgaagaaaagaggtttatttggctcatggttctacaggctgtacaagaagcatgacaccagcatctgcttctggtgagggcttcaggaaacttccagtcctggtggaaggggaaggggaaccagtgtgtacagagatcacctggcaagagaggaagcaagagagagatgggaggtactaggttgtttttaacaaccagttctcatgataactaacagagtgagaactcacttgttactgccaggatggcaccaaggcattcatgagggatccacccccctgactcagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggggataccatcaagcataccaacatatgcataatgagaatttcaaaaggaatggagagaaaggagtagaaagaatatttgaagaaataatagtccaaaacttcttaaatttgatgaaaacataaatctacacaaccaataagttcagcaaactccaagtaggataaatgcaaaaacaaaccataatcaagttgtcaaaagctacagacaaggggagtatcttgaaaatagcaagggagaactgaatcatcacatacaagggatctataaaaatattaacagcagatttctttcaaaaaccaaggatactgaaaggcaacaggataacattcaaagtgctgaaagaaaaataatatctaccaagaattctttatccagcaaaaccatacttcaaacatgtaggataaatgaagatattgtcagataaagaaaaacggatagaatttgtcactagcttccttgtcctacaaggaatactaaacgtagttatttatgctaaaaggaaaacttatttttttaatttttaatgtttatgggtacatagtaggtatatatatttataggtcacatgaaatattttgatacaggcatgcaatcacatcaggataaatgaggtattcatcacttcaaacatttaacctttgtgttacaaacaatccagttatattctttcagttattttaaaatgtacaattaaattattaaattatttttgactgtagtcatcctgttgtgctagcaaatactaggtcttattcattctttctattttttgtacccattaaccatccctactttccccaacccctactagccccccgcccccccaactaccctttccagcctctggtaaccactcttctacctgtatcctcctgacttcaattattttaatatttagctcctacaaataagttaaaacatgcaatgtttgtcttcttgtgcctggctcatctcatttaacataatgacctccagtcctatccatgttgttgcaaatgacaggatctcattcttccttatgactgaatagtaccccattgtgtatatgtaccacattttctttatctattcatctgttgatggacacttaggttgattccaagtcttggctattgtgaatagtgctgcagtaaacatgggagtgcagatacctcttcaatattctgatttcctttcttttgggtatatacctaggagtgggattgctggattgtatgatggctctatttttagttttttgaggaacctccaaactgttctccatagtagttgtactaatttacattctcaccaacagcgtacgagggttaccttttctctacatccttgccagcatttgtcactgcctaacttttagataaaagccattctaagcatagtaaaaggaagtgtagtaaaaggaatgacaagaaatcaaagtagaacaccataaaatatctatttaacacaaaaggaggcagtattggaggaatacaggaaaaaaaagacagatagaaaaccagtagtaaaattagaaacataaattgtaccttgtcagtaataatattaaatataaatgaattaaacactccaattacaaggcagagattggcaacatggatgaaaaacaggtgagatggtatctcatgtcgttttttgctgtctggaagagacatacttcagatttaaaaaatacatataagttgaaagtaaatgagtagaaaatgatatactatgcaaatagtaaccaaaagagctctgaagtggctattactaatatcagatgaaatagactttaataattaaatcagaaatttaatagtcaaacaaattgttactaaagaaggacattttataacaatagcagcattaatccatcaagaagatttagcaattataaacacatatgcacctaagaacaaagctccaaaatacatgaaacagaaaaaggcagaattggagggagaaatagagaattcagcaataataattggagacttcaatacctgacttaataatggattcaacaactaaacagaagatcattaaagaaagagaaggtagatttgggcaacactagaaaccaactagacctaacagacatctgtagaacactccactcaacaacaggagactatacattcttttcaagtacacatagaacattatctaggatagactgtgcattagcccatcaaatatgtctccatcaattttaaaatatctgaaatcatacaaagtatcttctctggccacaatggaatggaatcagaaatcaataacggaagcaaatttgggaaattcacaaagatgtggaaattaacatagtagccagtgggtcaaagaagaaattacaagaatactttaaaaatactctgagatgaatgaaaacaaaaatataacttaccaatatttatgagatgcagcaaaagcagtgattagggggaagtttattattgtaaatgcctatattgaaaagtaagaaagagctcaaatcaataatttaacctttcactttaagaaactggaaaagaaaactaaacttgacaggcagaaataaggaagtaataaggattataggagacatagagactagaaaaacaatggaagaagtcaataaaaccaaaagttgtttctttgaaaaggtaaaaataaaattgagtaggctttaaactgaccaataaaaagagacaactcaaagtaataaaatccataataaaggaagggacattactactgaccttataaaaatgaaaaggattataagagaatatgctgaaaaattgtatgccacttaattagatagcctagattaaatgagctaattcctagaaagaggcaaactaccaaaactgactcaagaagaaatagaagatctaagtaaacctgtaataagaaatagactgatatgtactcaaaattttcccataaagaaaagcccaggcccagatagcttaatggtgaattctactacatgtttatagaattcatataattccttcacacatatttctgaaaaataagagagggaacacttctcaactttttgtataaggcctgcaataccctgataccaaaaccagacaaagatattgtaagaaaggaccaatatcccttatgaatgtaaacacacacattctcaagaaaatactatcaaactgagtttagcaatttaaaaaatgttctgtagttcttcagaaagttaaatctaaggttatatgacccagccattttactcctagacatatgcctaagagaaatgaaacatatatccagataaaatcttgtatatgaatgttcatagcagcattattcataatagctggaagatagaacccaaatgtctaccaactgatgaatttataaactaaatatggtatatccatacaatggaatgattttttcaaccataaaaaggaatgacatactgatataagctacaacatgaatgaatcttgaatatattgtgctaagtgaaagaagcaagtcacacgagattacatatgttctattcatgtgaaatttccagaataggcaaatctatcagaaggaagtaaattagtggttgcccagggtatggagaaagatgagatggggagtgtctggtaatgggtatgggatttcttttcgaagtgattaaatgttcaaaatttgaacacagtaatggttgcatgactgtgaatatactaaaatccattaaattgtatactttgtggacaaattgtatgataagttaattgtacctgaataaggattttttaagtaccacgagtaagtagaattataacagaaattcaagcttgtttaaacatttaaaaatcaacgtcatacaccttattaatagaaaaatgaacaacagtccacatgatcatctcagcagacaaaaagcatttaacaaaattcaaccccctttcatgataaaaacactcaacaacctacaaatagaagggaatttctttaaccttttaaaagacatctaggaaaaaccaaagtctaactttatatttaatgttgtaagataatgctttcctccgaagatcaggaataagataagagtatctgttctcaacatgtttattcaacattgtactggaaattttagccaaggcagttatgcaagaaatagaaataaaagcatccagattgaaaaggaagacttaaaatgccctctattggcatataacattatcatgtatatatgaaaatccaaagaaattcacaaaaagacttagatgtaataagtgagcttagcaaggttgcaggatacaagataaatatacaaaaaccaattgtatttgtatacacaagcagtgaaaaatctaaaaatgaagttaagaaagcaattccatttaccacagcatcaaaaagaataaaatacttaggaagatatttaaccaaggaagtgcaaggctaataaatggaaaactatattgttgagaaaaattaaggaagtcctaagtaaatggtaagatctctcgtgtttgcctactagaagacttaatattaaagtgaaaatatttcccaaattgatctatagattcagtgctatctctatcaaaatccctactggcgctttttgcaaaaattgacaaactaatctaaaaatttacatggaaaagcaaggtaccccgagtagccttaacaatcctgaaaaacaatggacaaagttggagtactcacatttttcaacttcagaattttttttttttttttcctggagacagagtttcactcttgtcacccaggctggagtgcaatctcggctcactgcaaccttcgcctcctgggttcaagtgattcttgtgcctcagcctcccaagtatctgggattacaggtgtgtgccaccacacctggctattttttttgtattattagtagagatggggtttcaccatgttggccaggctggtcttaaactcctgacctcagatgatctgcccacctcgcctcccagggtgctgagattatagccatgagccactgcgcctggcccagaattttctataaagctacattaatacacatagtgtaaccctggcataaggatagacatatagattgatgaaattgaattaacaatccagtagtaaatccatatatttacagtcaaataattttcaactgtggtgccaagacagttcaatggagaaagaatagtttcttcaaaacagtggtattgggacaactggaggctgacatgcaaaagtttgaaggtggacctctaccctacaccatatacaaaaattaactcaaagtagatcaaagatctaaatgtatgagttaacaccatgcaattttaaaagaaaacataggcataaatctttgtgaccttggattaagtagtggtttcttcattattacacctaaagcacaagcaaccaaagaaaaaaatagataatgggattcatcataatttaaaatttttatgcttcagtagacactatcaagaaagtaaaaagaggctaggcgtggtggctcatgcccataagctcagtactttggaaggccaaggcatgcagatcacttgaggtcgagttcaagaccagcctggccaacatggcaaaaccctgtctctactaaaaatacaaaaattagccaggggtggtggtgcatgcctgtaatccaagcttcccagctactcaggaggctgagacatgagaatttcctgaactcaagaggcagaggttgcagtgagccaagatcatgccactgcagtccagcctgggtgacagagcgagactgtcccccccacccaaaaaaaaaaaaaaaacaaaaaggaaaaagataatacacagcattgggggaactatttgcaaatcatatatttgataatctagtatctcagatatacaaagaactcttgaaaatcaacaataaacaaaaacagataacctgattaaaatgataatggatttgaatagacatttcttcaaataatatttacaaatggtcaataaacacatgaaaagatattcagtgtcattggcttttaggaaaatggaaatccaaaccataatgagataccacttcacacctactaaaatggctgtagtaaaaaaacaaaacaaaaaacaacagcatgtgttggcaaggatttggagaatttggaaccatcataaattgctattgggaatacaaaatgatgtaaccgctgttgaaaagcttggcagttcctcaaaagttgaacttagagcaccctatgacctagcaattctcatcctaggtatatacccaaaagcattgaaaacatatgtacacacgaaaactggtacatgaatagtcattgcagcattatttgtagcaggcaaatgtggaaacaaaccaaatggtcatcaactgatgaatgggtaaacaaaacgaatattacatacaatagaagatttattgttcaaccttaaaaaggaattaaaggtatgcaaaactggttcaacatttgaaaatcaattaatgtaatccatcacgtcaacaagctaaagaagaaaaattatttgatcatattagtagatggagaaaaggcagttgacaaaatctaacaccctcaacttgataaagaagtctacaaaaaaaaccctacagctaacatcttacttaatggtgagaaactgatgtttttcccctaaaattgggaatgaggccaggatgttcctgttccctactcctgttcaacatcctaccagaaacccttgctaatgcaataagacatgataaggaaatgaaagctatacagattggggggaaagaagtaaacctgtctttgttctgagatgacatgattgtctatgtagaaagtcccaaagaatcaacaacaacaacaaactcctggaacaaataagggattatagcaggttgcaggttacaaggttaacatataaaagtctatcgctttcttacatgccagcaatgtgcaagtggaatttgaaatttaaaatataacacattatattaacaccaaaaaattgaactgcttatgtataagcataacaaaatatatacaagatacatacaaaggaaatttctaaactttgatgaaagaaatcaaaaaagatctaaataaatagatactccacgtttgtggataagaagactcaatgttgttaagaatcagttcttaccaacttgatctgtagattcagtgcaatcccaagcataatttcaggaagttactttgtggatattgacaaattgatctaaagtttatatggaaaggcaaaagattcagaatagacaccatattattgaagaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaaaaaaaagactcctagaactagtgagtgcgtttgtcaaggatatgagataaacatacgaaaaatcagttatttctctatactcgcaaagaacacctggaaaccacagttaaaaacatagtaccatttgcagttgcttaaaataaaatgaaatgcttaggtataaatcccacaaaacatatacaaaccttgtatggtgaaaactacagaactctgatgaaagaagttaaagatctaaataaatgaagagatgtactctgttcagggattggaagactcaacatagtaaatatataatttctccccaaatctatctctagatttgacccaatttcaattaaaatcctaggaagattttttatggatatagaaggcttatcctaaaatatttctggaaaggaaaaagaataagaatagctaaaacaattttgaaaaactatgataaagtgggaggaatcattctacccactatatagatttatatagctataggaattaatatagagtagtactggcagagagatagacacgtagcttgatggaacagattagattacccataagtacccccacacaagtacagccaaatagtttttgagaaagattcaaactcaattcaatgaagaaagagtaatttttttctacaaatggtggtggagcaattggacatccataggccaaaaatgaacctcaatttaaacctcatgccctataaaaaattaactcaaaatagatcatagatttaaatataaaacataaagctacatagcttttttttttgagacagagtctcgctctgtcgcccaggctggagttcagtggcgcgatcttggctcactggaacctcccatcccgggttcaagtgattcttgtgcctcagcctcctgagtagctagctgggactacaggcacacaccaccatgcccggctaattatttgcatttttagtagagacggggtttcaccatgttggccaggctggtctcaaactcctgacctcaggtgatccacctgccttggcctcccaaagtgctgggattactggcatgagccaccatgcccagccaagatacatacttttgaaagaaaatgtaccctaatatcattaggacatggagggagatgaagaattcttagacatgacactaaatgcacaattcgtagatgaaaaaagaaaaacaaaaaacctcaacagtaaaaaataaaacaaatagtccaattggatagtggttaaaagacatgaacatttttcccaaaaagggttatacaggttctaaacaattacatgaaaatatgttcaacatcattatccattagggaaatgcaaattaaagccacaataagatatcgctccacacttaatagaacagctacaataaaaaggtgaggccaggggcagtggttcaaacctgtaattccaccactttcacaggctgaagcgggaggattgcttgagcccaggagttcaagaccagtctgtgcaacatagggagaccctgtctcttaaaaaaaataagtaacaatatgacaataccatattctggcaaggatgcagagaactggatctttcatatatctggtgtgaatataaagtggtacagtcactccagaaaagagttaggcagcttctttaaaatactaaaacatacatttgccatacaacccagcaagtgtactcctgggaaatgtacatcctaaggaaatgaaaacttatgttcacagtaagacctgtaatcaagtttttatagcagctatactcgtcatagctaaaatttggaaagtaccaaaatatcctacaatgggttaatggttaaacgaattgtgatacatctataccatggaatcctactgagcaataaaaatgaaaaatctactgatgcatgcaactacttggatagatctcaagaaattctacttcgttaaaaaaatctcttaattgtcgtgtactgtatgatttcctttatataagtttcaaagtgataaaattatagaactggagaacagattagtgattgtcaggtgtgggacactgcaaagtttaggtgaggattgtgagatgggtgagtgggtgtgactagaaagggttagcacttggggtttttgtgggggattattatgtagcagttctgtatctctgttttggtggtgactacttgaatttacacatggcgataaaattgaatagctgtgcacatagacacatgagtgcatgtaaaactattgaaatcgaaataaagtctgttggttgtatcaatagtcagtttcctggttttgatattgtactactgttatatgctactatgggggaaaatgggttaaaggtacacaaaatctctgtactacttttgcaactttctgttaatgtacaattattttaaaattttaaaaaattgtaaggtttcccttatgaactgtatgctcttccatgaaagagataattagcccacaaatatttaggagtataggtaaaagcattttaactacaggttttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaatgagagtcaattttaaatacgtctgtttcttaatgattaattttgctgtattatgacaagcatttctggataactatttacaatgagatacaaatattacaaatgtaaagtttatacttgtcttgctaatcagatcctgctattctgtgaaaaactgctgatgaatctctaaacctaagacaatttatagtgattatgcttgagatcaactgcatgggaaaagaaaacttacttctttcatcttgttttttgccttttaaaaaatagtgtagattacctacttctgaaagtatgtggctatttgttaactaaaatgactcatacttgttcaatataattctaggtgtaaacatggcttgatattacatgtaacatgttggccataatccccaatatcaacgttttatttgtaaatgtctcttaacctgaatttctcatcttatatgacttcagtatgtagatgaggaggctcatgtttatataatagagctctcaaagttcattggctcatatattcaatttttcttagtatcatcttaatgttacattcgggaaatatagcaatatgaaaaaaatgtgagatgagtttctctactcattttttattctgaaataaagcagcttttaaaaaatgtttttccaggccaggtacagtggccaggcatggtggctcatgcctgtaatcccagcactttgggaggccaaggtgagtggatcacctgaggtcaggtgttcaagaccagcctggccaacatggtgaaaccctgtctttactaaaaatatttatttttaatgtttttcctctactataagtggaatttgtgtttcacaagttaaaaatgatttttatcattgttttctctttttctatacaaatagctacctattttctttcaaatctgcattttgctagcttttacattatgtgacgtagagaattccttaggaagctgtgggaatagaaaatagataaagacaggaatttggtgggttgacataacccttgatatatgggctacagtagctggaaaattcagtctgtacactaggtacaagatgaattttggagtatacttgctaattaaaatttgagtctgaagaattagatgggggtgttcttagatgtattgaataagttactgttatcccatctatatgaataacctttggaaataacctaagaagtgtcttttgttaagtttgctctgtaagaaatttgtattacacaattaaataatacatgtcagatagaaaatataataaattctaacttagcagacagtttattcaaaagaattatcgcaagggggagaaactattgcaatagggagtggggtctattttaatagaacactctcaccataagatctatgagtatctcaagggttaggcaaaaaatatttttcttttatgggaggaataaacaagactagaaagaacttggtgggaggaagtgggaaggcctgggggaaggagagaagcgtaaccagtttgattaacaggcaacttcaaattgggtacaagagctcctaattgttcacaaaaacttctatacaatatcaatcacgaatagttttaagggaaccacttttcaaattcttacttctatatatactcttcgtaaagttgatatgcttaagaaaatgtctgtaatggacatagaagttctcctttcttatatcccctttcacaaatttttcttctctcattttactattgtccttcctcctacccatccagaatcttaattgtggtgcgttacaagatctgttgtaatatgtatcaaaatctccagggcgccaaacaaaaggacagtttgaaaattggcatcagtgttgagaaagtgaatgactctgaaagaccaataacatactttttcaagttagatctattcttgctttgctttcaacaaaattgatggatgaccttatcaatttgtaagttgatggattattaagagtaatttttgtggctcactcctgtaatcccaacacttggggaggcagaggtgggcagatcacctgagcctaagagttcaagaccaccctgggcacaacatggcaaaaccccatctctacaaaaaatacaaaaaattagctgggcatggtggcatgtgcctgtagtcccaactacctgggaggctgaggtgggaggatcgcctgagcccaggaagtcgaggctgcagtgagctgtgattgtgccactgcactccagcctgggcgacagagtaagatcctgcctcaaaaaaaagcataatttttattaagtcattataattcatggtgtataactcaaaaagagattgctttaacagaactccatctattcccgtatacttggtttttttcaaataggtttattgagatataattcacacaccataaaacactcctttaagttgtataattcagtggattttagtatattcagagttgtgcaactgtcattgctacctattttcagaacattttcatctcccccaaaagaaaccctataccttttcatagacacccactattttcccccctcccagcctctggcaattaccagtctactttctatttctatggatttgccttttttggacattttgtataaatggaaccatagaatatgtgttgcatctggcttctttcgccttacatattttcaaggttcatccatgtagtagcaggtatcagtactttattccttcttatgactgaatagtattccattgtgtagatatatatcgattcattagttgatgtacatttgggttgtatcagttttttagctgttatatataatcttgatatgaatattcatgtgtagttaagcctcgttattcaaggattctttatttaaaaattcacctacttgataatatttataacccccaaactcatactcttggcgtcacgcacagacaggtgcaaagtgacaacaagtttgaatcattcaacatgcacattcccagctaaggtcggacaacgcaacactcttctatcttgttgtttgggctctcataccataaatgagttcccttttctatgtctacttaattccatattttttcacatttttgtgttttttgctggtgattttgcttcttaaagtggccccaaagcatagtgttgagtgctgtctagtattcctaagtgtgagaaggctgtgatgtgccttacagagaaaataaatgtattagacaagtgtcattcaggcatgagttatagggctgttggccatgggttcagtgttaataaatcaacaatatatatgaaataacatgtctttaaactgaaatacacatgtgataaggttatatattgatctgtggacaaatatggtgcaaccagagattcacagtaacctgtattttccctaaggaacagtgtttctgtgtttcctcagtcagtgtttgtgttgactttatagaatataagtactgcaaataatgaagatcgactgtatatggtttcatgtaaacatacgttttcagttctcttgggtgtatacccaggaatagaattgctaggtcatatgataacattgcttgttttgtgaacaaggtttctcagcgttcacatctataaaagtgaaaataggaatagaatttgtgttgagccctgtcttattctaccacatgcaagaaaatgagatccttgttggactggtgtggaactggccccatgacacacaggaatgtcaccttttgtgacacttccatagacataacttccaaggacccctgaagagacatgcccaagtggaagaaatcaccacattcaggaaagtccaaagctgttcaattgtaattttcctagagtagattgttttctttgttattataccagctttccaccatctgtctcactttcctctttcccagttcctagatggccgctttatgggattgaatctagagagtttaagccttacatagaaagttgatgagcctacaagtgggttaaagcttagtgtttttttttttaggtttcgtgttttttaaaaaagcattttcatatgaactgttgcttttttatttatttatttatttatttattttgagacggagtcttactctgtcacccaagctggagtgcagtggcacgatctcagctcgctgcaacctatgtctcctgggttcaagcgattctcctgcctcagcctcccaagtagctgggattacaggcgtgcaccacaatgcccagctaatttttttgtatttttagtagagacagggtttcaccatcttggccaagctggtcttgaactcctgacctcaggtgatcagcccgcctcggcctcccaaagtgctgggattacaggcatgagccaccacgcccagctgaactgttgctttataatatctcaattgtttacttcttcaatagcatgaataatttactatataattaaaagattttagtgatagtacatcaaaaagagtagtatctgcaaacagaagcagttttgtgcttgtttgtagtaaagactctatctataactgagtcagtaagcatattctcctttttaattactgccatgtactaatcaaacactatttaaaatgccaggcatgttgctaggtgctgttcatatctgttgtcttatcttcagagaaaccctgcaaaaaaatactttatctacattttgcaactgaagattaaagaagttaaataacttttggattgatgcacaggaagtggtagagccaggtgaatccaagttggtctgtcttttggactgcaaaagctgtatttttcccacatctgaagctgttagccctcaccctttatatcctagtgcccagctactttatgtgtcctgcacccctaaacccaaaagcggtatgtgtgtgaagtgaaggtagagagttttgtttttctggatttgttttttcacagctttactctgaccacctagaaccatgcctggcacaatataggtaatacttattgagtgaatgaaggaatgccacgtaagttttgtgaatttactgaggagtctcgggatggtgcaataagagaacagtgtgacagttgataaacaaaggaaggtttctgctttttggcaaagattacatctgtaaaaggtaaataggctgagtaacactttcatggtcaggactacaaagctgggctataaaaacacattattctaatccatgtttatctatcacttcttttgtttttttttttttttttttggcagagtctcgctctgtcgcccaggctggagtgcagtggcgcgatctcggctcactgcaagctccgcctcctgggttcacgccatactcctgcctcagcctcctgagtagctgggactacaggcacccgccaccacgcccggctaattttttgtatttttagtagagacggggtttcaccgagttagccaggatggtctcgatctactgacttcatgatccgcccaccttggcctcccaaagtgctgggattacaggcgtgagccaccgcacccggccatctatcacttcttacctggctggcacgctagtttatccaaactactttattgtacacgcttgttgtacagcttgctattaatataatgaggtcatataattagttatggtagtagatggtgacccttctcaaactatgaggaagatgtttaggtatcctcaaagtaaattctgcagtgatcccagagacagattaggaagtctcagagatggacaaaagacttgaaaggtatttcagaggctgggcacagtggctcatatctttaattccaacactttgggaggccgaggcaggaggatcatttgcgtccaggagttcaagaccagcctgggcaacatagtgagacccgatctctacaaaaaataaaaaaattagccaggcatggtgatgtgtgcctgtagtcctagctgcttgggagggtaaggtgggaggattgcttgagcctgggaggctgaggctgcagtgagccgtgattgcaccactgcactcagcctgggcaacagagtgagaccctgtctcaaaacaaaacaaaaaaaaagatatttcagaaaaaaaatgtatccacatgagcagtaaacaaggcacaactccattagtcatcagagaaatgcaaattaaaaccagataccactgcattcctaacaggatggctaaaaaatgaaaatgacagttgtaaagtggcagtgagaatgaagagccaccagaactcttactgctaatagggatgcaaattagtttaaccactttgataaactgtttgggaatatctaccaaagctgacatatatatatatatatatatatatatatatatatatatatatatatatatatatatatatcttgtgacctagcatttgcatccctgggtatatacccaacagcaatgtcttaacatatgttcacccccacccccccaaaaaaaaaaaaaacaaaaacatgtacaagaattcttttagcagaattcttcataatagccctaaattagaaacaacccaaatgtccaacagtggcggaatgacataaataaataccactgtattcatacagtggagcacaacaaagcaatgagaatggatggaactttgttacacaaaaaacacagatgaatctcacaagcataatgataagtgaaagaagccgggcttaaaaaactaccaactctatgattccatttatataaagtacaaaaacagtgtaactaatatatgaagtttgaggtcaaagtagtggttaccggtgggggaaggtagtgaatgggaggggacatgatgggagctacggaggtgctggtcatgttctgtttcttgatctggatgctggttgagttcactgaaaattcatcaagctgtacatttatgatatttgtaggaaggataggtatacattgtccgaagggaaagagtggagcagttttattttgtcagctcatgtggtctggcataaagatctgtctgggctatttaaatatttatattttgcataatggggatctgacttgttcacaaaagtattcattcagtcttggggagaaaagggtgatgacatacctgttctgtgccaaatgctaagtactgggatatgtaaaaatagaaagaaaacatagatatctttaaatctaataatccagacataagattctcttcctcagtagtaaatgctaaagagacagagtgactccatgtacaggtgaatctgctttgttatccttattggttactttaaaaataatgacagaaggcattggtgcaaaatgtatctaaagttacaacgtaagtgccatttctaaagcgtttgggagaaaattccactagtctatttgaactggccttgtgttgtctgtggtgtttggctttctcttgggtagcttaaatttcctccccatcagtatagtagattttatctattttgtttactcttcagaaataactgccaggggatttttaagactactgattgaggaatgattgccaaattacccatttttaagtgtaaagtcagtaagcaatgccaggtttctgaggagcttcaccaatttgtctctataatgtgtagtatttttttaacagttttaatatatgaatgaaaatactaccaagtttctcctggatccccacttttgttcattcagtgattttttttactgagctttggaaatgaaccttttgtctttttagtatgatcctctcccctcatgtcgtttgaaaatacccatctcttgcacgagactaagaacaatgctgtcctgttgagttcttataaaatccaaagaaaatttaagtactaagtggatgatagttaaagggtttacagcttttcttacagatccatcaaagtgggaaaatcatgagaagagttggagtcagacatgccagacattccaaatctgtcctgtacaatgtgaccttaagtagttccataaacctcagctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaagtaaatgcattacattgtatttttaaaacattttttgccttaataaactgctagcatttcagttaagaggagttaataacagtttcaccaatgcacattgaaaacgatgggttccattaaatagtcaataattattaaaattaagccaagaataatgaaagggatacaattacactaaagtgatatttatgtcttataaagatttctcttaaatgaaaattgacaattattagactagccatacacaaaatctggtattttaaaactaatcttggctgggcgtggtggctcacacctgtaatcccagcactttgggaagtcgaggtgggcagatcacttgaggtcaggagttcgagaccagcccggccaaccaacatggtgaagccctgtctttaccaacaaatacaaaacttagccaggcatggtggcatggacctgtagtcccagctactcaggaggctaaggtgtgagaattgcttgaacccaggaggcagaattgcagtgagccaagatggcaccactgcactccagcctgggcagcagagtgagaccctgtctcaaaaacaaaacaaaacaaaacaaaaaactaaaccaagggccaaagcagtatggtgacagggaaatattttatattttcccttagagacttcagagtgctgactcaccccttccacctaccatgtgaggacgcagtgataacacaccattgattaatgtctaagaatatattgaggaaaatactctatcaggctaacagggaaactggcacagttttgtttccactatattttattggttagagaagtcacagagccacctggttggaaggagaaaggatgtagatcccacctctggatgggagagatgacaaaaaaatttctggccatctttaatctgccacatcaattaattttaaacttaaactttgttgccttaatgtttgagtgagattgtagtagttgatgctactccattccgaggcagtactaaaatcctaccagaggatccaatgtcctcattaagtcccaattcaggatacatatgacagcagtgaataatttgtcactgtgaataggagactaaaataaggacataccatgttgcacaattacagactatttgaaatccagtctggcactgtttgttaaaacagaattttaatatttttgtaatcaaaagatagggaaattatttcaggcaggctgtttttataatttcgttttggcattcttctcttaagaatgaataataatataaggaaacaggtagtgattgccttttgaactataaagtgcttttcatttttagtaagaggttttatgtctataaaattatctgaaaagacaggtcatctgctaaccagtggtagagtatccactgcaaggctcaggactcctgaaacacatcataaaattgtcatgtaaggaaattcttggagctgagtgcagagctagtttgatttcatcataataggcagatattgatggattaactttgagtatttcatgaaataaaacatactttgctgtttttggtttataatacattttaaaacgtttgagtctgaaacaaaaattgtgaagctgatatttgtctttcctttcattctatatgtgaccagtttaatttttgtgattcggggcaatcaaagtatttgctgggtatctagagtgaatattttatcactttagataatctaatctaaaagcccagtaataacagttttggttatttttttcacaggtggggtagtatatcaaacagggtccagttaggagacagaaaccaaacagtaatttaatgtgtttcttttgactttttaaaaatttttgttggtacagagtaggagtatatatttatggggtacgtgagatgttttgatataggcatgcaatgtgtattaatcacatcctgtaaaatggggtatctgttccctcaagcatttatcctttatgttacaaaaaacccaaaaatactcttgcagttatttttaagtgtaccattaaattattatctgctgtagtcaccctgttgtaatatcgaatactaggtctttttcaatagtaatttaatttgaacatgcaaagtttagtataaggaattattgccaaggggttggggtaattggctagtaaaagttagagaactgtgaaaaatacaggcataaggaacagctgctattccaacggctgagatagaatgctcaaggaagaggtttggccttcctcctggcagcactaagatctgaaccttgttgaagaaaatatggccatgactcaccggatcacagtgaggttcactgagacaccatgctagtgggactcattggaaatctgccctctggagtccaggggaagccatccttagggacagaactctgaacatgcagcaagctcactgaggggctgctggaggaagccagtaacaaggagagtaccttgccagcagcgctctgctgtaaaggcacctgaagggggttccaagagaagctgcacatggaaagatgcatgctgctggccactgtgcactgcagataaactgcacacactgcaggagcctgatgagaaaaacactggaactgggacaacagaaccctttctcctccagtgcccctccagtgcccttagtggacaaagcttaatgttgtgccagttggaaaaatattcacagtcaatctccagtagtgcagagcaggcaatgaagtgtggatttggagctgacagacaatagattgataagtggcatgaggagtggagagattgtgtatatgacagtgagtatagttttgatgacatgtatcaagcaacctcattcattatacttggcaatgattttatttcattttgcttttttttccccctcctttaaggagattcattcaatacaacttagtggtatagggcttaaggaaggaaatgcccacgtttttgcttcatatgactagttggatagtggtgctacttattttattcaaatggatactatcaaagggtcagggagaataaatgagtttttgacatcttgcatctcagtaacttttgaaatataaatgttgatcagttaaatattttagtctaaaatttaggaccacaatctgaacaaaagagaaaagatttgaaaatcttcatcgttttggtaatagacgaaacttcggaaatacctgtgattgcttaaagaaagtatattaagaggccacaatgaaaaaaaatgatcatgaggaaccatttttggtcatgaaaaatggtcatgaggaatgatcctgacgaacacctaaatttaaagaaaggatggaaagagacagaggaaaccaggagggggaaagagaagtacaagaattattatcagagaatgctgtcatagacgctgagatcaaaaagattttctgtgttgtcaaatgctataaagaagccaaatgagggaacaactgtaatgtctatggaatttggcaacatggaaaccagtgtgaactttggccagagcaatttcggtattgcactggggacaaaaacaagattgtagtaggcagaggaaggaatggggagtgaggaagcagggaaaataaatataggataattttcaaatggctagactgagaagaggagagagaaacagtcatagatgcaggggcatgtggaggcaggggtagcgattaaaatgggaaggattccagtatctttttttttttttccttttttgccagaagagagagctaagaggaaagaaaagggtgcactgatggactgagatcttcgataggcagcaggtggagggtgggcccctcttccatcaagaccaaaagaaagtcaaggtactgatagagctaggcctgcaggcaggagaaggaaccagaggatgtccctcagctgatggcctgattttcagcaggtgggaggcagagccacctgctgagagtaggcatggtggtagagagtagagagataagagagttagtaatagcaggttaagagagataagagacattgctaggctgcctcaaggcccctccccccacccccgctgaggctaaatgcaaggaatttgtagcagcgcttatcaacatgcagatatgatttctctcagcaacactaagtagcctacaattgaggaaaggaaaattgtatgggtagattgtgctagagtgagaagtattacacacagcagacatgatggacaaaggaatcaagagagatgaaagtaatagtaatagcaagagaaaagaccatggagctggatggggaggaagattttagaggtgcatcaaacatattctagttggtcagtctcctcaccagtcacaatagttttcacgacatcaccgtaagagggacaatagtatggtaagtaagaaaaggaagttaatttcaggagacttgggttcaaataatgatcctgccatttatttattttgaccttgtgaaagttacctaacttctaagcaagcctgcatttttctttctttcttttttctttttttttttttttttttttttttgagacggagtctcactctgtcgcccaggctggagtgcagtggcgccatctccactcactgcaacctccgcctcccaggttcaagcgattctcctgcctcagcctcccaagtagctgggactacaggtgcacaccaccacgcccagctaatcttttgtgttttagtagagacggggtttcaccatgttgcccagtctggtcttgaactcttgagctcaggcagtccgcccgcctcggcctcccaaagtgctaggattatagatgtgagccaccacgcctggccacctgaatttttacacatagtaaatgctcaacaaatatttaatatgaagtgatatttcaagaaataagaaggtgcaatacaacacattagagatgccattctggcacaaagaaacaagtcagtgcctgctctaattttaatttaatgttacaatagccagttttgattagaatattttgcttcaccacatggtgctcaaggtactgtggctgcataacaaattaccccaaaacttagtgtcataaagcaactatttaatatactcacagcttctggggctctgcagtttagacagggcaaatctggggtgtgagtcagaagactcgagggctagggcaggaatcttctaaaggctcactaactcacatctggccattgatgctggctgttgactgagagactttacctgggaactttggcttacacttcatgtgacttctctctgtgaaaaggcttcctcatagcatggcagctgagttccaagggcaaatattgagagagacatccttttgctcagaataatggtattgagattcatccccatgtctgttgtattagtactttttaaattggttagtaatgttccatttcatgcatatagcaaagtttttaaatccattttcttgttcttagaaatatatgttgtttccactttggggctgagtaaagccgctttgaatgtttgaatgtaaatcttttgagttggacatattgtcacttctctcacataaatgcaagagtgcagttgctaggtcattaagaaactgccaaactattttccatagtggttgcactattttatgttattaccagtaatgtatgagagttacagcttttccacatccttgccaatacttggtattgccatcctttttaattttagccattctggtgggtatgtcatgatatttcttgtggttttcatttgcatttaccttatgactaaaaatgttgcacttattggccattcatatatctttgttgaagtatatcttcagatcttacaccgatgtctatttttcattgaggtgtgtgtcttttgtattaagttgtaggagttctttgtatattctggatacacttccttggtcaaatatacatattgcaaatatgttttcccagtttgtaactttcccttttatattcttaatggaatctttaaaagagtagaagtttttcattttgatgaagtccagtttacagtttttttccttcatggttcctgatttttgtgacctaagaaaatttcacctacgtcaaatttgtgaaaattttctttatattttcttgtataattgtagttttggctacgtttatgatgcactttagcataagagttgtatatcgtatgaagtgtaagggttgagattcatgggtagccattcgctccagcactatttgttgaaataaccctattgagttattttagcacctttatcaaaaataatgtgttggtctattttctgcactttctattctgatctgtatgtctatccttatatcagattcacactgtctagattattctatattaagtcttaaaatccagtagccaaaatcctacaattaggattttgtgtttaggctattctagctacttaaattttcataaacaatttagagtaaatttgtgaatttctgcaatgaagcatgagattttgattggtgttacttttaatctatatattaatttggggagaatggaaatcttaaccatattgagtcctccaatccatgaacactactccatttatgtagatttttttacattctcccagaaaatatctttgtagttttaagagtagatattttattcatatttcattacatttattgttagggcctcatgtttttgatgctatggtgaatagtattatgttaaaatttttaatttaatgattattgatagtatatagaaatacagttgattcttgtatattgatctcatatttggcaaccttgctaaatttacttattctagtggcttaaaaaaatccttaagattttctatttgaacaattgtgttattttatttctgtccattctgtatcccttttatttctttttcttacctttatgccctagctaggacattcaattcagtgatcttatattgatctcatatttggcaaccttgctaatttcacttattctagtggctttaaaaaaaatccttaagattttctatttgaacaattgtgttattttatttctttccattctgtatgacttttgtttcttcttaccttgatgccctagctaggacatacaattcaataatcttagggagcaaaccagtctcttaccattaggtattgtctgcaggtttttcttaaatgccctttattagattcaagaatttgttttatcgtcctaatttgttgaatttttattatggataagtgttgaatttcttagaatgctttttttctgagttgagtttttgtatagttctcctttattctgttacttacattgattgaattttgaatgctaaagtaaccttgcattcctgggataaaccctacttggtcatggtttattaaattttttatatacccatgtggtaaaaatactaatattttacaagatttttgcatcagtggttatgatggttattgctttctagttttctttttaaagtttctactggcttaggtatcagtagagtcaggtttactggtctcatataattagctcattattttctcaaaatgtttgtattggattgctattactttttcttagtgtattgtggaattcaccagtgtcactatctcctgggcttgggattttctttgtggggttattttaaattatacatgtaatttctgtaataaatttagggctattcagattttctattttttcttgtgatagtacttgtaatttgagtatttcaaggaatttgtcagtttcattttatttgttggatatattggtatatctttattatatttcttataattttcttgtctgacatatctgtactgatgtctcccctttcattgctgatattgataacttttgtcttctctcattttccttgatcattaaaatctttccaatggaatctttcaaagagcagaagttcttaatattgacaaactccagtttatcatttttagctagaggtttattattttcattgatcatacattgaacaagcttttggtatcattaactttattgtttgttcattttctgggtaatttctatcactgttttaataaagtccaatttgtcgacgtattgttttatgaattgtacttttggtgctccttctaagaaatctttgcctaatccaaggttggaaagcttttctccttttttttaatagaaatttaatagttttaggttttacatttaggtctttggtccattttgagttaatttttagatattttctgaagtctggatacaagttgtctttttttttggtcttgtcttttttttccatatatatagttgttccagcatcatttgttgaaaagattatcttttctccattgaatttccccttgcaattttgttaaaatttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtcttacaaaactcagaacacattgagctctctagtccaaaaattcagaatgctccaaaacctgaaactttttgagtgcctatatgacatcacaactggaatattccatagctaatacctaaatccaaaacacttctggtcccaaggactttggataagagatattcaacctgtagttctaatagcttttttgtagactctctctgattttctccatggatgattatatgtcagttatgtcatcttgaatacaatcagcattaattacatcttcctttccaatctggattcctcttgtttggttttctggccttattgcactgactggctagatgtctcctccagtataatgttgaatagaagtcatgacagcaaatgttttcttattccttagagaaaaaacattagattgtttaccattaagtattaatattagctgtaggtttttgtggatgacctttttgaggttgaagaagtttctttctattccaagtttgctgagaattttcagtaggaatggatgttggattttgtcaaatgctttttctgcatttattgagatgacctttttagtttattgacatcatgaattatattgattaattttgtagtgatcaaccaacctgtattctaaaaactgcatattggcctctagttttcttttgttataatagtctttaactggttttgatatcaaggtaatgctgagctcatagagtgaattagaaagtgttccttttcaattttgggggaaaggtttgtgtagatgtggtattatttcttcatgtttggtagagttcatcttggcctgaagttttctttgaaggacgatttttaactaaaaattctattttttatagttataggaatattcagtttatttcgtcttaagtgaggtttggttgtttctttcatgaaatttgtctgttttacctaagtgggtaaatttattggcatggagttgtttgtaacattcattattcttagtatatctgtaaaacctttagtgatgttacctttctttatccttaacattattagttcatgtgttttctctctttttttttttctgagcagcctggctagaggtttatcaattcattgatctatttcaagaacccattttttgtttcatttatgttttctgttgatttactttttcctattctatttatttcaactttggtctttatgttttcctttcatgggcttattttgctttaattttctcatcttctagtttattaagttggagactaagatcaagttagttaatagtattgttcaacttttctatatcctcattcattttctgcctacttgttttatcaattataattttggatttgtctgttcatatacttttatcacttttgtcttttatgtattttgaagttctgttattagatacttatacatttaggattattatgtcctcttgatgagttgactgtgttattatcatgaactgatcttttttctttgttcttcctttatgcagtgtatccttttttctgaattaaaaaattttgtttttttagctgggcacagtggctcatgcctttaatcccagcagtttgggaggacgaggtgggtggatcacttgagctcaagactagcctgggcaacatggcaaaaccctgtctctacaaaaatacaaaaataagccaggcatggtggtgtgtacctgtaatcccagctacctgggaagttgaggtgggaggatcatttgagtgtgggaggcggaggttgcagtgagccgagattacaccactgcactccatactgggcaacagtgccagatcctgtctcaaaaaaaaactttgtttttatcactggttttatgcaatttgttgataatctgccttagtgcctttttttatttgtattttaatttgcttgagattctttgagcttcttatatctatgggcttatagtttacataacatttgaaaattttttgggctttatttctttagggtatttttcttctccatttgtctcttctctcctttgaagggctccagttacatgtatgttagacccctttatattgtcccacatgtcattaagcttctgtattttaattttatacttttcatgcattgtctaatctgtttagttcatccagtgactttttcatttgagataatatatttttttaattctagaagctccattttgttcctatttatttttttgtatttcttttctcattatgtccatgctttcttttaaatctttgagcatattcataagctattttgaaattcctgccttgtaatgcctacatagctatcatttataggtctatttgtattgactagtttttcttttggttatattttacaatttgctgctttcttcattagactatatctagaatagccattattttagtgccaaatttagctccactacttaggtgtgaattatccttagcatttcagtgaggtctctctactgtgtctggttagaactgcagtatctccctgctctttttgaccagcctcatggagtttcaagttatgcaaggacaaattattattaaagtattgttgggactttttttatacctcagtcccttcttttcagtaccctctcctgaacattccatctccctcatcctccccaaaccataatctctgttttctctactcagtgacactgcatgcactgctttgcttcccctccctgtgctgcatactggaaattgcttccaggaagaagccaggctctcatttggtactcattccattcatttccctttccataggaatcacaatcttttactgcctattgtctcagtgcctgataatatttgtttcatacatcttattcaattttctagttcagtgggtaaagaaagtcctattccaattaaatttgcatgattagaagctctttttttcccttcaaaatctttatttgcatttctttttttttattattatactttaagttctagggtacatgtgcacaacgtgcaggtttgtaacatatgtatacatgtgccatgttggtgtgctgcacccattaactcgtcatttacattaggtatatctcctaatgctatccctcccccctccctccacccaacgacaggccccggtgtgtgatgttccccaccctgtgtccaagtgttttcattgttgaattcccacctatgagagaacatgcagtgtttggttttttgtccttgcgatagtttgctgagaatgatggtttccagcttcatccatgtccctacaaaggacatgaactcatcattttttatggctgcatagtattccatggtgtatatgtgtcacattttcttaatccagtctatcatggatggacatttgggttggttccaagtctttgctattgtgaatagtgccgcaataaacatacttgtgcatgtgtctttatagcagcatgatgtttaatcctttaggtatatacccagtaatgggatggttgggtcaaatggtatttctagttctagatccttgaggaatcgccacactgacttccacaatggttgaactagtttacactcccaccaacagtgtaaaagtgttcctatttctccacatcctctccagcacctgttgtttgctgacattttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatccttcacccactttttgatggggttgtttgtttttttcttgtaaatttgtttgagttatttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcatttgttgccatggcttttggtgttttggacatgaagtccttgcccatgcctatgtcctgaatggtattgcctaggttttcttctagggtttttatggttttaggtctaatatttaagtctttaatccaccttgaattaatttttatataaggtgtaaggaagggatccagtttcagctttctacatatggctagccagttttcccagcaccatttattaaatagggaatactttccctatttcttgtttttgtcaggtttgtcaaagatcagatggttgtagatgtgtggtattatttctgagggctctgttctgttccattggtctatatctctgttttggtgccagtaccttgctgttttggttactgtagccttgtattatagcttgaagtcaggtagtgtgatgcctccagctttgttctttttgcttaggtttgacttggcaatacgggctcttttttggttccatatgaactttaaagtagttttttccaatttcgtgaagaaagtcattggtagcttgatggggatgccattgaatctataaattaccttgggcagtatggccattttcacgatattgattcttcctatccatgagcatggaatgttcttccatttgtttgtgtcctcttttatttccttgagcagtggtttgtagttctccttgaagaggtccttcacatcctttgtaagttggattcctaggtattttattctctttgaagtaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctaaacatacaatcatgtcatctgcaaacagggacaatttgacttcctcttttcctaattggttaccctttatttctttctcctgcctgattaccctggccagaacttccaacactatgttgaataggtgtggtgagagagggcatccctgtcttgtgccagttttcacagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgatggattacatttattgatttggatatgttgaaccagccttgcatcccagggatgaagcccacttgatcatggtggataagctttttgatgtgctgctggattcggtttgccagcattttattgaggatttttgcatcgatgttcatcagggatattggtctagaattcccttttttttgttgtgcctctgccagcctttggtatcaggatgatgctggcctcataaaatgagttaggaaggatttcctctttttctattgattggaatagtttcagaagaaatggtaccagttcctccttgtacctctggtagaattcggctgtgaatctgtcgggtcctggactttttttggttggtaggctattaattattgcctcaatttcagagcctgttattggtctattcagggattcaacttcttcctggtttagtcttgggagggtgtatgtgtccaggaatttatccatttcttctagattctctagtttatttgcatagaggtgtttatagtattctctgatggtagtttgtatttctgtgggattggtggtgatatcccctttatcattttttattgcgtctatttgattcttctctcttttcttctttattagtcttgctagcagtgtatcaattttgttgatcttttcaaaaaaccagctcctggattcattgattttttgaagggttttttatgtctctatttcctttagttctgctctgatcttagttattttttgccttctgctagcttttgaatgtgtttgctcttacttctctagttcttttaattgtgatattagggtgtcaattttagatctctcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtcattcaggagcaggttgttcagtttccgtgtagttgagcggttttgagtgagtttcttaatcctgaattctagtttgattgcactgtggtctgagagacagtttgttataatttctgttcttttacatttgctgagaagtggtttacttccccttccaactatgtggtcagttttggaataaatgcaatgtggtgctgagaagaatgtatattctgttgatttggggtggagagttctgtagatgtctactaggtccgcttggtgcagagctgagttcaattcctggatatccttgttaactttctgtctcgtttatctgtctaatgttgacagtggggtgttaaagtctcccattattattgtgtgggagtctaagtctctttgtaggtctctaaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgtgtctcctgaatacagcacactgatgggtcttgactctttatccaatttgccagtctgtgtcttttaattggagcgtttagcccatttacatttaaggttaatattgttatgaatgaatgatcctgtcattatgatgttagctggttattttgcttgttagttgctgcaatttcttcctagcatcgatggtctttacaatttggcatgtttttgcagtggctggtatcagtttttcctttctatatttagtgcttccttcaggagctcttgtagggcaggcctggtggtgacaaaatctctcagcatttgcttgtctgcaaaggattttatttctctttcacttatgaagcttagtttggctggatatgaaattccgggttgaaaattcttttctttaagaatgttgaatattggcccccactctcttctggcttgtagagtttctgctgagagatctgctgctagtctgatgggcttccctttgtgggtaacctgacctttctctctggctgcccttagcattttttccttcaactttggtgaatctgacagttatgtatcttggagttgctcttcgcgaggagtatctttgtggtggtctctgtatttcctgaatttgaatgttggcctgccttgctaggttggggaagttctcctggataatatcctgcagagtgttttccaacttggttccactctccccatcactttcaggtacaccaatcagacgtagatttggtcttttcacatagtcccatatttcttgaaggctttgttcgtttctttttactcttttttctctaaacttctcttctcgcttcatttcattcatttgatcttcagtcactgataccctttcttccagttgatcaaatcggctactgaagcttgtgcatttgtcacgtagttctcgtgccatgattttcagctccatcaggtcatttaaggacttttctacattagttattctagttagccattcgtctcatcttttttcaaggtttttagcttctttgcgatgggttcaaacttcctcctttagctcagagaagtttaatcatccgaagccttcttctctcaactcgtcaaagtcattctctgtccagctttgttccgttgctggcaaggagctgcgttcctttggagggggagaggcactctgatttttagaattttcagcttttctgctctgttttttccctatctttgtggttttatctacctttggtctttgatcatggtgacgtacagatggggttttggtgtggatgtcctttctgtttgttagttttccttctaacagtcaggaccctcagctgcaggtctgttggagtttgctggaggtccactccagatcctgtttgcctgagtatcagctgcggaggctgcagaacagcgaatattgctgaacagcaaatgttgctgcctgatcgttcctctggaagcttcgtctcagaggggtacccagccatgtgagatgtcagtctgcccttgccggggggtgcctcccagttaggctacttgggggtcagggacccacttgaggaggcagtctgtccgttctcagatctaaaactccatgctgggagaaccactactgtcttccaggctgtcagtcagggacatttaagtctgcagaggtttctgctgcctttcgtttgtctataccctgcccccagaggtggagtctacagaggcaggaaggcctccttgagctgcggtgggctccacccagtttgagcttcctggccgctttgtttacctacttaagcctcagcaatggcgggcacccctcccccagccttgctgccgccttgcagttcgatctcagactgctgtgctagcaaggagtgaggctccgtgggtgtgggaccctctgagccaggcacaggatataatctcctggtgtgctgtttgctaagaccattggaaaagcacagtatcagggtggagcgcagtatcagggtgagagtgacgcgattttccagatgccatctgtcacagcttcccttggctaggaaagggaattccctgaacccttgcacttcccgggtgaggcgatgtctcgccctgctttggctcacactcggtgggctgcacccactgtcctgcacccactgtccgacaagccccagtgagatgaacccggtacctcagttggaaatgcagaaatcacccgtcttctgcgtcgctcacgctgggagctgtggactggagctgttcctattcagccatcttggaactgcccccctagaagctcttatcgtgagttttaatgtgattttaaagaatcttaattctaatgatattactttcaaatagagacagactattacagagttttatctaacaaagctaacatttatttagcatttcagtgatgtgagacgccttgctaagaggtgtctcagttcccattataatcctattataaaggtgccatgttatgcctattttacagaaaggaggactgcagcttgaaaacagttaagtgacttgttcaagctcacatatcagtcgagtaaatggcaaaacctagattcaaactcaatcttgtcaaactgccaaggccttgcttatcatcaccatgtgctatggtttggatgtccctgccaaaactcatgttgaaatttaattgccgttgtaacagtattgggtgctggatcctttaagaggtgattggcctggcacgatggctcacacctgtaatcctggcactttgggaagccgaggcagatggatcacctgaggtcaggagttcgagaccagcctggacaacatggtgaaacccatctctaccaaaaatacaaaaattaactgggcatggtggcagacacctgtaatcccagctacttgggaggctgaggcaggagaatcgcttgaacctgggagatggaggttgcagtgagctgagatcatgccactgcactccagcctgggtgataagagtgaaactccgtctcaaataaataaataaatacatacatacataaagaagtgattaggtcatgaggaatcctccgtcatgaatggatttatgttgttatcgcgagagtgggctagttattgctggagtgggctcctgataaaagaatgagcttgggcccattttctctctatgtcttgtgcttggttgcccttctgcaatgggacgaaccttaccagatgctcatgccatgctcttgaactcctcagcctccacaacagtgagccagataaacctgttgtttataaatttcccagtctgtgggtttctgttataacagcagaaaacagactatgataccatagtatgctgctttgaagtgggtgagcagctgggacaattaaggaatcagcttcagtactaagtgtctgggatgcaatgctttgggggccattttcaggttttgtacagcagtctttcttgggtcacattttcactgctctttacttcaaatggtcaagtcagacatcttttaagcaacatttatgggtaggttctgatggcatcttccttatatctgcatatgattggaaatctaagagcatttgggaaccttgtcactgaccatctttttttattgtaactctacattaaagtggggtgttttttgttgttgttgttgttgttgtttgagaatgataaggtaccatgggagcagaattacattactggaaaagtggtggctaggtttataaaagcaaaacagtcaatgatgttctcagtctcaaattatttcaaaataaaaagatttttaagaaaaatttacctaaaataattagtctcttttcagtttagccaccagcttcctatattcttagattgttttattttgatttttgggggttttttattgtgatttaattttttataatcatgtaaaacatttacgtggttccaaaggcaaactataaaagaaaatattttcaaagaagtatgttttctatccctgttcccaccctccttcataagtaatcattttcattagctttcagtttatactcattgtctttgctttaaaattgtaaatattgtagctgtgtgtgtttttacatacacatacatacacacacatttccctcttccttggataaaaggtggcatattctacacactattctacatcttcttgttttattaagtcgtagatactctggagttcactcaatagcatggtattaagattgtccttttttctttttaaagctccaggatattccactggatttaaatttttcaaaatctcatttgataaacatttattgtctactgtgtgtgtcatctgtcacgggtagtgcatagcattgtagggcaaacagaaatgaacaacatatagtcttcaccctcaagaaacttacagaattttaaaatacttttacaaatgtgtacctctcacagtagctgatccagtaacaattatttttatttttacccatctcctttttagagaacagagtaaaaatttttttgccatctattgtttctgttatatttaatgtcatttcagtagtatttataagcagtctaggaacacgtcccaacatttaaaatacttagatatatgattgtaaagtgtgaggcagagaagtacatcatatgaatgtatgctatttctaaatacttgctattaattttagtcactctaaagtcagaatataccagacagtccaaattactgtaattataccatccttttaaaaacttggcacctctttattcccaatattactccaaccattatcattataacaggttcctgttctgtacctcactcacatctgtactcttctccaatatttcttatttctttaatgtctgtacctcataagatgctgaacttttctttgaagacttaggcattggggctgtgggggtactagcctagacttattgaaagcagctcacctatggtactttgtcacgggagtgggtatatctgtgctaggtattgtccttcctatctctttgttggctcttaggggcactccgtctctcagggtcctgagtctgactttgcatctttgaatatggtgtctctccttaaagtcatcttggttacaccttgggtttaccttttctttgcctgtcctccagtagtggccctgaagcctatccatgttatcatttggctactcctggctcttccatcctggagctgttaacctagttgctcttgaactctgcatataaggcccccttccctttctctttcccctttccccagttgctctctaggttttctaatttctttcctgacactatgtatggctttagtcaagcgtaacccttgtccctaaatccacaaatataaagctaagacatgttacttgtctagttttcttagagaaggaaacttctcaggtctttgtatgcttcctcatacaattgtaggttgcagtaaggttaaatggctgaaaagcggtgaaggaacatgttcaagaagtttcatatgatttcactacatgaatgtagatgtggtaatctagcacctactgtactacttaaagcatttcctacagtgaaggcttctgagaaaataaatactattcctgaagtagtctcacaaaaaaaccttttttaattcagaaaattgattccaggttcactaagtcagcattttctctcatcaggcattgcaactaatgacattaatgagagccatgccatattttttaaaacaaaggataaaaagggcaaaactgagaattttaaaagggagttgtttccagtagtctgtttgaacattgtaattaaccaagaaataaaacaagaaaaggccattttaattgtgttttttagtactccattaacagtgcatcaagctccttatgaattgagacagtataaaatgagtgcttacgttaaagtaggaaagccatcagtctgcggtacagagcattgtatttattagagtatcccagacctgaatgagtattaccaccattaggtaatgcttaagtgtctattttaacaaaaggcatttttttttgttattatagagaacaaacactaaattgactaaataaatgaagtttaaacaagaaataaaacagctagaatttgcttgcttttgttggtggtgatatgctcttgtagccccagcaaattacatcagcattgttaccctcgacagggagctttataatttgtagcatgtaaaataacccttcccaaaaaagaagagagccaggacctgtgttgaactacttacaaagcaagcatgtccctggtgtcaccttagtagttttagtgagaaagatgggatttctaaggacagtagttcacagttgtgctctctctgttttctgtctttcatgctttaaggtttttttgctctcttattttaatgtgtgtgtctctatgtatgggcatgtaaataaatatgcagatggtggcacctatgtaagaaaatgtttgaacacagccccaatttcagagctcaatatggcatggggaattcttgggagaatgtgacctattgagggttggttggttgtttgtttttaagatggaatctccctctgtcacccaggctggagtgcagtggtgtgatcttggctcactgcagcctccgcctcccgggttcaagcagttatcatgcctcagcttcccgagcagctgggaccacaggcgcccgccaccacacctggctaatttttgtatctttagtagagacagggtttcaccatgttggccaggctggtctcgtactcctgacctcaaatgatccacccacctcagcctcccaaagtgctaggattgtgggcatgagtcaccgcgcctggccaattatcataaatatatgctttttagtggaccatatagaaagttctattctggttctttatatggttgggttttacttttatctaagtaatgtaagcacatggttttaaaagtcaaatcatgctacttctaacaacaaaaaagcagtgtctctcctaatttgttccaactccaccactttaagcatttttgctgtttcttctgtaaccagcaacatatattactatttcttgatttcatagtttcagatatcatcagttattgcctttttgctatgaaagatgtagctgttttatgttgctaccctcccaccccacttcctggtccctacttactttcccttccccatttttataatattcatatttcagttattcatataatatgattgtatttcttgtgtaatttattgttatatctggggtgaatcattgactcatttctttgattgcttagttttttgttgttgttgtttttgagacagtctcgctctgtcacccaggctggagtgcaatggcgtgatcttggctcactgcagcctccacctcctgggttcaagcaattctcctgcctcggcttcccaagtagctgggattgcaagagcgtgccaccacacctggctaattttttttaatatttttagtagagatggcgtttcactatgttggccacgctggtctcaaactcctgacctcatgatgtgcccacctcggcctcccaaggtgctgggattacaagcgtgagccaccgtgcccagcccgattgcttgttattttatgtattattgctaatttatccctaggctgtcccactaaactgtgtaactttcctcggtacattcaaccccattggataatttatcacattcattgtttttcttggtgacagagggccccctgcctgtgagcctttcatctgtttcattgtaagttggttgctgtcctggcctgctgggctcgtcatgagaattccttttgcctttcatctgtgctagagtctttgttccctaggtttcttgtttttttgcttttttggtttttttggcttccttcttcattttgataaagtatgccctctagtaactttctgagaagaggtgcttttttgagatacctgaaaatgtctttatattactctacaatttgatagtttggctgggtgtagaattctaggtgacaattttgaaaatatatagcatatgggtgaaagtttatatgatgcaacgagactacttaggttcatatcacacttaaccagctgtgtgtgacatgggcacatcacataacccttctgtgcttaagttttctcatctaaaaatcaggcataatatcttacctgcccttacagttattgagaggattgattgaataatgtatgtaaagcacttagggcagtgcctggccgtttttctcccaaagctttaatgatattctctttaccccagtgccctaaaattttacaatgatgtgctttactgtgggcctttttaaaagtcgttatactgattgcttagaaatatttttaaatctggaaactcattgttctttagtttagaaattctttaaaatatttcttagataacatccttttctccagtttctttgttcttcttttcaggagttgctgtgattcaaataacataagggcttataaggtagggcttcatctctaaccttttctttcctgttcctctttctttatctttttgctctactttgagagatttcttcaacttgatcttctaacccttctgtttgagtctcgtggtttagctctcattttttattttcaaggacttttttctgaatgtttttcttttaaactattatatagtttcatactcttgtcttcataggtttcatattcttatctatctcaaagtagtatatttttgaaattttctttgccttatacagggaacagtttcctcagaaaaatattaagagggaagtgttaaataggtgcctgggaacactctgtatatgggtaaattcattatcagtgatcagacaaagactaggccattttttgagcgccttatggatatccgttatctgtagatcttttgttcttaagcaggtcagtttgacagaagaatcttctgatcttctgccttgggctaagggtatgtgtattagggggagaaagggtacgtaggggcatttaagtctgactgcagtggttctgagagataaaggctgagggtctttattttaacatgtttaatacatggaactttccagttaatcctcttgtttgagtacagcacttcagtttgacgtgagctaggggtctggtgtccaaagtctccaaaaagtggggtaaggataatttgcttggccaaagatatccaaggtcatactgcatacctataaaggttcagccagtcctcctgttatctgctccaccatgcaaccctgccctcaaagatacctggtgcttcctattgctaaacctttcttagggacattttgacaggcatatcagcgtgcttcttactggctcgccttattgaaagcttgtgttcaggttctacagaaagcttgtgttcaggttctacaaaaagatgtcaagaagggatttgatgtgcaagaaatttattgagagtgaaaatgaatggtagggagctggaggaggctgggacagccatcacaggtcatgcaggtctgaccccgttggaggaaaaagggaagaaaaagaggaggattgggtggggaaattatttgaccaaggtgcagtttcaaggatgttttggcaaggcgtattgggagtccttgagccaaagttgaccatcagagacccatatctcacaggaattagcctgcttaagtattcctgctgctcttagtcaccagctgagagtatttataatagctgctttgaagtcttttctgctaattccaacatctgggctccctcaaaggcagtttctattttctgcttttttttcccctcctttgtaaaggtcacacttttctgcattttgcatgtctcctaacactttgttatagcaactgtggatactgacaccttcctccactccagggttattcttttttagttacttgctggactagttcagtgcaacctctgatgtccctcttcaggacaggtgtggtccttatccatgcatttctctgctacctctattggtgttaaacttaaccaatcgatagctgattgctcccttctttttgacaatgccttgtggtataaattgctccatagtctgatccaattaaaattgggtcccttcatggatgaaattggaaatcatcattctcagtaaactatcgcaaggacaaaaaaccaaacaccgcatgttctcactcataggtgggaattgaacagtgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaagaaaagaaaagaaaaaataaaaataaataaaaataaaataacattgagtcccttgtcagggacaagtttttctagtctttgagacttgctatacccttccctgagcagaatctctgcactatagagtaggagctggggaaaatggggaactcactcctcattggctgttccacccagatcctccctctgaagcagggtttttgtgttgccgggaaggaggaggtatgaactgtgcctccttttgcctctgctgctactcagtgtggatcttccacagctcaaaaccagggagtatgatatctgtcagtgttcaccaggtgctgaaagtactcagaatagttctttcaccctaggaagttgaaggagatgggagctgccactcagctgccaaacacatctctgtagctctcttgacaacacagagctgtgtgggcaggggggactacactgtttaccagcttcctcacctgattcctctgtttttagctggagttcaggggagagaaatggctgctgccatcagcttctgccgcttgctctatataggccttccacagcatggagccgtggaaaatgggatctgccaatgtttactagctgccaaatccaccccgagtagctcttccatctcaaggggcggatctgcccttagctgctgaactccttaaaacagttctttggcaaaacagagctgtggggggacaggtgcagtccctgtgtggtccctatctcgaatgctacagcctcttattgttcttatcgaatttctgtagattctattgaataaatgcttctctatttgttgtaagccctttgatcagtctccagggactttgaatgattgtgatttttgaccagctaaatatatgtctctccaggggagagatatccctgagctcctttatacagccattccagaagtcccacctagtcattgtgggggttttctgggttttttctgagacagagtcttgctctgtctcccaggctggagtgcagtggtgtgatctcagctcactgcaaccggctcactgcctcccgggttcaagcgagtcccctgcctcagcctcctgagtagctgggattacaggcgcacgccaccacacccagctaatttttatacttttagtagagacagggttttaccatgttggccagggtggttttgaactcctggcctcaagtgatctgcccacctcagcctcccaaagtgctgggattacaggcgtgagccactgcacctggctgtcattgtgtttttaatgattctgtcttaatagaaaactagttttacacaaatataatcaagtgacttaaattgaaaggactaagattgaaaactgaattgaaattgaaaattgaattgaaattgaaacctaagatttttttgaaaggtatgattttattacggaaatttgcttgattgagctttattttaatcaagactttgtatttccatttttagaattaattcagagaaatagctaacctataaagttcatcttcagaattgagtcattgtagacctaagaagcaatatagcagagttattaagagcataggttctggggccagactacctaggttccagtctttgctttgcagcttattggttctacctgggttccaatctttgctttgcagcttgttagttctttttatttttatttttgagacagtcttgctctgtcacctaggctggagtgcagtggcatgatctcagctcactgcaccctctgcctcccaggttcaagcaattcttctgcctcagcctcccaagtagctgggattacaggcatgtgctaccacacccagctgatttttatattattagtggagacggggtttcaccatgttgtccaggctagtctcagattcctgacctcaggtgatccacctgccttggcctcccaaagtgctgggattacaggcgtgagccaccgcccctggccgcagcttattagttctgtgaatgagttacttaactgctctctgtctattcatatataacatgagcatcatctgccccttagaattattgcgaggttaaatgggtcaacacatctaaaatagagcctgactcatagtaagtactcagtaaatgttagctgatggttattgttgttagacacattaaaggcaaataatcatctcatctttgtattttattattgagaccaataatattgtctaaagccagagaccttggtgaaacgctgggtgcccagctagctataatatgatctttagttccctctagtggaagaaaattagataggctctttgcataaacatgctgcttttggaattgtgatcatttaacctaataaaattacccctgaataattaaccaaagacaatatccacatacataaatggatttaagaaattgttaaaacttacaatcttaaatattctttccaagtgaaacttttttggggacgtgtaatttataatattaaataatatagtatataaaccatccagtgacataaaaagttaggcatatattacttttgtttaaaacaagtgcattcagtagtagtagtaccttgaagttttccattttaacattcatacccagttatctgcaagtagatggcatttcttggtcattctctgagaagtctttaatcattgtgatatgccacctggagtagatttccttgaagttttggcatttttagtatcctcttccacacagcctatggggtaacagaaagattgctagattgggaatctgagacctgggttcatcttccagttctgctatgaaatatctgtgtgacttcgggcatgtcttactagggcctcattttccttctgagtaaaatttgaggatagagaggagcatgtgatgatgactgtcttgctgtcacttctgtttctaacattctctgattcagtgatacatacactttgatgtgagacaggagatgtataatagatgttgagtctaagttgggtaaatgggtcctgtatgcttgatgttgccttctagcaggattggcaggaatggaaatcaccagcagtggaatgatttggtaaatgccaagatcttgaggcatctatggaggcggttgctagattgcagcagggtatgcctccctcagcttgggagattgttaaagagaactttgaggcaacgtctaagtgggatcttgatgaacaagtaggggtttaccaggcagagaaggaagcacgtggagtatcatacagagggaacaacatttgtcaggggacagagagcagggggccggtgcacaagctgcgggtggttcaggattggggtcagggaggctgaaggaagaagctactggaaaggaatgtataaatgtgtgacttcaaaaaaaaaaaacaagagctaaattgtttgactaagaagccggagagctagcttctatttccagttatactgttaaataggtctgtgaaccctagttaagttgttggacttaaaagattttttggaaggctttcaaagccatgcttagggattataatgtcttgctgtatggaatggagctcagtgaaggttttggaataatataatatctgttttagagtaaaactatgatgacactttaatgagtctaaagagaagaaactagaggcaaagaaacccatttaaagatctttgctgtgatccagtcaagaattgttgagggctgaaactagggtaaccgcagtaagggaaagatagttttgacaggtgttgcagaaatagaatggacaggttttggcagctgcatataggaagtagaggagaagtggtagatggtgtgaagatgactccaagggctgtctggaagattaataattttggtaatcagtaggccacacacatacagctacatgggttctgttttacttttcttaactagtgtccttattattaaacattttgagtgtgtctagtttttttcccaaataaccctatggtcatcttgaggttttttacgaaatatgtgatttcccaaaaaactgtagatgaaaaactgcaaagttaaagtaggcatagaactacactatatatagcagtgtggtttactaatagatgttcacattgctgccttcttggtgtcaaactcggtttgattgacatttgttaaacatagaatgatttccaccaaaaatgatgaaaggaaaagaaaacaaaacttattgtgcatgtgcactctcacatactttattaatcatccaggcctaactacaaccctgtataggagttgttatcttactctttctattttacaaatgaggaaacagatgttctaaggttatgcagctactaagtgatgaagacaggaaagacaggtcttttgactacaagtctattgccctatctattatatcataactgcctgccagcagaatgtgttagtgcttaaaaggatagatgccagatctgtggaagtagggtgaccagtcatcttggtttgcctgggaatgagggtgggttctcagaacccaggactttcaacctggaaagatcctcggtgccacaactgagaaagttccaggcaaaccaggacaggttggtaccctgtccagaaaagtcacttatatgaaataaaccattatctagaatgacttaaataaggtatttactgtatttctttcccataatattgtgtcatcaatgctaaatgacaaatgattcctaagtgaagaggagttaaggccccgccttccttccatctgtttgttttcactggctctgagcatcctgccttgctgcagttacactcaactgtgtgtgaatcagatactagatgcctttgcttctaagtcagttttattttattttttatttttatttatttatttgtttatttttagacaggatctcactctgtctcccaggctggagtgcagtggcatgatcttggctgactgcaacctccacctctcgggctcaggtgatcctcccaccccagcctcctgagtagctgggactacaggcacacgtcaccgcacccagctaatttttgtattttttgtaggaacagggtttcaccatgttgcccaatctggtcccaaactcctgggctgaagcgatccacctgcctcagcctcccaaagtgctagtagaattacaggcacgagctaccgtgcctcgtctctaagtcagtttttaaggaaacttatgctttgcccattccaaatttgatgaaatggcaaaagagctattcagggaaaaatcaaggagggctgtcagtatctgtgatttcaaagtatttatcaaaacaattaactcatttttcttggtcctttttcaaataagtatcacatattggtagttatttctttacgataaatttgttttatactatttttatgagactttgttgacaaaaggattctgtagctggatggggaaacccatattattaaaagaaaaaaaaacctcagataatcatttcactatgccgtacagaatttttacctcattcattttttacatattgaaacagaccacaaattgctttctgggaaaagttttggccctgctgtcagtatttcctgggctggccccatcctggaagaagatttgggggagaaatgggtggtaaggaaatctatcctgtcaacgtgtccttgttgagctcctcagctatcagttaataaatatagaaagtaaattatagataacacaattatgaaagtataaagcacaggtatgtgaagaacattttttttctttgacatattagttgaattcccattttatttcagtaacttctcgtttgctttttaaattttattgaagaacgtgtatgcacaataaaatgtacccatctaattgtacacttcagtgagttttgacaaatgtatgcattctgtcatcccacaaagttccttcgggctctaacatgtatgatttttaagactttaatattgaaaagtaattgagttataaactgatatttctctaattttcttgtataaagtaaggaataccatgttgaaataggtgtctggtttttctaatagtcaaatgccctgatcttcccccctttggtttacatttcccaaaatgaaaagcaacagagcaattgcaccttttagacaaacttagagcattgtatttctatttttgtcatatacaaatttgttacacttatcagaactgaaaactctttgggaaatatattaacaaaaccccattaatttgtaaatgcttaatgcagctaagattgatttctaattaatacacatttgcctatttaagaaaattttcacatcagtcaaacactgaattaatggtatgctgcttcctttctttattcacctgatgatgatatttggggccataggaattttttttcaatgggcaagaattcaaagaaattagaaggtgcttggatttctgtttgtgtgtgtgaaaaaagacaacaaaatgtatagagctagtagtgaaacatgtaaaaaagaatcaaagaaattatgagtttgcagttgacccagatttctatggtggcctgtctaggcctctactcttcactagctgaggtcaactttcctgaaggtcaatgaggaagatagcctcattaaagccaacctgacctgtgttgttgccaaaggcagctgggatctttattcttcaacttgattatgagataaaggtagaacccagcagcagaaattgactttgctactataatccttccaaggttctgcttggattcctttcttaaagtatcatttggtcattcatttcagtacactaaggaaaaatatgttgagtcaataatgactttcatttacttattttgttattaatatttattgaaatgaacacattagtacttgtcctagttctttctatgactagattagaatattctttattttgattttgagtccaggtcagctcttagcgaattttgtttaactgttgaatttctaacacaacctagacattgtttggaaatgaatgagaatacttgtatatttgttaggaaaagcgcagtatctagtttctgactatcactagttacaatgcagctgaaataagccggttctgtaacagtcttgatagcctgtcattcaagtcagtattaccatattagcactattgtgtgattggatcttaggatatataaaaactatgcagacccaggaggcactgtggtgtgatgtaaagagcaaagggctttggttattagtcctgcttcctccacttactagctgtgtgatttatatcattgagccctggacctcagtttctacctctgtaaaatggggagatatatgtgcatatatatgtatgtgtatatgtacatgtatgtcatgcagggttattacagtaacaaatgaggacttatagaggggcactttaaagtctcagagtttgcattagattaacaatagtgaagaaattccagatttagttattaaatgatggatttgggttattaaaagaagctataggatttccttctgtgaaagtattttttaaaaacacatctgtttgaatttagattctttttggaatgactgacattataaatatctgtaagaattacagaactcacaatcaggagaggataagaattaaagcaagtcaacttatctagagtggcaccattccaatttggtagacactagccacatgcagttattgagcacttaaaatgtggccagaccaaattgagatttgctataagtgtaaaaatacatgctagatctcagagataatagtacaaaaaaagtaacttattttattaattttagtatgattatatgttgaaataatactttgtatacattgaattggataaaatatgttatcaaaatgaattttacctgtttctttttacttttttaatgtggctactggaaaatttaaaattatatgcatggcttacattatacttaaattggatggtgttgatcaaaatctttattgagctaggtgcagtggctcacacctgtaatcctaacactttggaagtccaaggcaggaagattgattgaggccaggaattcgagatcaacccgggcaacatagcgagactctgtctctataaactatttaaaaattagctgggcatggtggcacgtgcctgtagcccagctgctcaggaggctgaggtgggagcatcccttgagcccaggagttcaaggttacagtgagctatgatcacaccactgcactccagcctgagcaacagaatgagaccctagctcaaaaaaaaaaaaaaaaaaatccttattgaatgctctcgagcaaacgaaatcttaaatttagatcttttaagttcagatacagatagaatgaaaagttctcctagttcttcaagaaaaatagtagtaaaataatactttacaggaaaatcatttttaaaacagaccacttgaaccagcttccctaactttcccttacttgaccagtctgataggcagaccctggtgggatacttgctttactattgttggagagcccaaactttttaggaaaataatagtcattctaatgccatatggcaggttgatttcatttaagtttctaatttgggttagaaaattaaatattgctacctgtattactagttccccttttaaagggaaataaattgataaaataaatataggcatatagttaaatgtaaggacactaaacacagaaatagattagtttaaaatatttttaaaatttcctgagaaattacaaaaaagaaagtacaacttagccataaaaaggaacaaaataatgccattcacagcaagctggatggagttggagaccattattctttttttttttttttaatctgagatggagtctccctttgttgccctggctggaatgcagtggcgtgatctcggctcactgcaacctccgcctcccaggttcaagcaattctcctgtctcagcctcccgagtagctgggactacaggtgcacgtcactacacccggctaatttttgtatttttagtagagacggggtttcaccatattggtcaggctggtcttgaactcctaacctcaggtgatccacctgcctcagcctcccaaagtgctgggattacaggtgtgagccactgcacccagctggagaccattattctaagtgaagtaactcaggaatggaaaaccaaacattgtatattctcactagtatgtcagagctgagctatggggacgcaaaggcataagaatgacacgatggactttgggggaagggtgggaggggaggtgagggataaagactacacattgggtacagtgtacactgcttgggtgacgggtgcaccagaatctcagaaatcaccactaaagaacttttccatgtaactaaacaccacccgttccacaaaagctattgaaattaaaataaaaaatgtactcattaaaaaaaaagaaagtacaaaggagagtgaagagaggtaccagttactagtctgtaaacaaaacaatacttcaaaatagagatggtaaccctgggtcatgtcattcccaggtacattttgtgctaacatctgtaagcagtcagataatcaccactttaaatcatattttcatcacctgctttcaaattccttcctactttgcctctagagttgatttgtaggcaaatagtgtttttagtttgctatatcagcgtggacttaatagcacttaatacatatatctttaattcacattcatatttagaaacaaacattttgagtttaatattcgtggaatctatagttggaatggatatatttgtgtttttaattgtgctatttgagctatttaatttatacttgaattcaggaaaacatgaccacaatttttctagatcattgcccttatcatttgaaatatatttttatgttgctagtttcatactagcaaatcaagtcaaatcagtgttctgactttagttctgaaatgtcagatccggtgacatttaaattgctttgaaggctggccccccagcaattctgcctttattttgagagtgggtaggtgataagagactagaccaaggacttgttcagccatttaccaaatcaaaatgtgaggctcaaatggagccaaatgtgtggcagaaatggagcatccatttctgcttacaaactttcagtataaccaatgtatcacatagcaaatggtgaatgtggagataaaaatacaatttagactgggcacagtggctcatgcctataatcccagcactttgagaggccgaggagggtggatcacttgaggtcaggagttcaagaccagcctggccaacacggtaaaaccccatctccaggtgctaaagttgaacgagctgatggatatgaaccaccagtccaagaatctgtttaaagttcagacttaaaatagtggcaaataaaaagtcctcatttgtgatggtttgcttctgaaagaaaaaaaaaagtctctactaaaaatgcaaaaaattagccaggcatagtggtgcacacctgtaatcccagctattcaggaggctgacgcaggagaatctcttgaacctgggaggtggaggctacagtgagccatgatcacgccactgcactccaacctgggcaacagagcaagactctgtctcaaaaaaggaaaaatacaatttagttacatgaaagaggcaaaatagaaaataagctgaaaataaagagaaaatatcagttttaattgtggcaaacaccaaatctgtttacttcatgactcctgtgtcacaggatagagttaaaatcaggcttttgattagaatagagaggaatggaaagagaaaaacttaagtcgaaaacagaagatatgaaagggtgagttctaataaaaatgggaagctagagataaacataaaaatgagtaataaaaattttaagcttttcctagaattagaaggcagaacactcctggagaggaaaaatctgtgcaggcatgtgattgatgttgtctggctcagcctggccctccagcacacttgttaaaagctttcctcatggttatgacttcccagcacaaaccccacagctgcttcacatcctcccctcctgcggggccttcctaactacttttggagatggaggcatctttcctgtgcctctgatctcttcctttgcagtaaacactgagcccccagccctgccatgctgggctccaaacatccagcttctcattagaatcttaacactgccctctccaactgatttggtagactctgcaggtaccacatcacttgtcactgccccatttcattgactctaagaaagtcatttgtagaagttagcagtcagcttgcagatggtaggacaaaggcaggaccagcaccatattttctgactccagatcctgtaggcttttcctcactgccacttacaaacacacagagtgcttcctttaaaaaaacaaacaagtaaaaccttctcttgaccccgctatttctttcctactgccagattcttctaatatgatcgtgttcaaacccagcatggcattattggaaggactgctgactttggaattgggcaggccagggttcaaaacctaccctcatgatagctgtgtgatcttgaacacgtttctaagcctcagtttctccatctgtaaaatacctacctcacagtgtggttgggacatcaagtgacagtgactatattaagtacttagcccaatgagaggtgtgataattttaactgattattacataattgtctctggcatactgacctcaaccctgactcctccccaaaagttgatcttgctcaggattctcattaccttttctggctgaatcttgtggtcttttctcagctttcagccttctccagctatttacaacttaatttcctctactctcttgattttcttaatattattgattcttcctttccttgtggcttctcttttgtcaaattttctgacttctttttctcattctacccttatgtaagtcaatcttctaaggttccatctacgatcattgctctgttgacaagactaagttgaattaataaatcagaaaggagataatattatctattttactttctgcagtacatccttagccttggttcttccttacctgtctcccttcgactttctaatataaaaatgtcacattggattttaagtcatcagcaaacgggtaaagccccagtgctattagcactggatggctttcattattctattccatgtagacatggcaagcgatttccatgcccaaactgttttgtatgatgatgatgatgatattaacaactttgttttccaaatagtattatagagtttacacagtagtcctacatacattatttggatttgttcttcaaagtaacattgtgaggtaggtagagtttggaattatccaacactttttttttttttttttttttgagacagagtttcactctttgttgcccaggctggagtgcaatgacgcgatcccggctcactgcaacttctgcctcccgagttcaagtgattctcctgcctcagcctcccgagtagcagggattacaggtgcccgccaccatgcccggctaattttttacatttttagtagagatgtgatttcgccatgttggccaggcttgtctcaaactcctgacctgaagtgatccacctgtctcggcctcccaaagtgctgagattacaggtgcgagccaccacgcctggccccagcacattttataaatgatattttaaaaattctgactttgactctaggaatagtgccttttctgtttaaaccatactattttttgttccctattccgtataacttccctgataggtctataaatgctagattttaggctaaagaatagacaacatatttttattttatttagggaaaactaagaaaaagaggtaaaaatcaaaacagtaaattgagttattagtttattagcagatcaaggaagagttacaaatttggaggctaagattttattagaagagttggggaaagtatttgtggtttgtttttttttttttttttgcttttggggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctcagtgctttgagagtctgaagcagggaggattgattgaggccaggagttcgagaccagcctgggaaacataccaaaacctatctctatttttttctaaaaaaaaaaaaaaaaggttgtaatcagtgactttgattaggaaaaaaaacagaagatatacttgctaaatattcaaaagataccaaggtcagaggttatattcattacctattgcttcataacaaaatgccccaaaatgtaatggcttaaaacaacatacatttattatcttagtctctgtgcatcaggaatgtgtgttccaacttagcagggtcctctggctctgggtctctcacaaggtgataataaagctgttggccagagctgaagtcattttgaggctccactacaatgtggatctgcttccaagctcactcacatgattgttggcagtcttaccttcctcacaggctactggactgagagccacaattccttaagagctgttggcccaagcctcccttggttccttgtccgttgggcctctccatagagcagcttccagcatggcagctggcttcatcagagcaagcaagaggacaagtgagagtatgagcaagacagaagtcacagtctcgtaacctaatctccaaaattacacaccatcacttctgcagttagaaatgagtcactagatccagcctatacacaagggggatgggattataccagggcctgaatatcaggaggtgaggatcactgggaggcatttcacaagttgccccctacaaagggctagctaacatattggctgtctacatcaaaattcaaaaatatttttacaagtttgtagcaaaggagctgaaacaaagaaggtgaaatttaagaccagttaatgttaactccttcattcaaatatgagtaagtgcaagatcagtgtgaatttagttgtgattatgtgaaaaaagatgtaaacattttagttgttgtttgcaacagcttaaaaagcgctgaatggaaggttatgctacattaattaggagtatatagtattcagaacaaagtcatactcctcccgttcaccctggaccattcatagtaagcaggacactggaatgtctgcagaataggataaccagaatggaaaggagcctgaaaattgtgtcatagagacacagccttcaaaatcttttctggcaaacctgctaaaagaattttgaggccaggcgtggtggctcatgccaataatcccagcaccttgggaggccaaggcaggcggattgcttgagctcaggagttcaagaccagcgtgggcaacatggcgaaaccctgtctctacaaaaaatacaaaaactaggtgggcatggtggcacacgcctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactctgtcacccaggctggagtgcagtggcgcaatctcggctcactgcaacctccgccccctgggttcaagcaattctcctgcctcagcctcccgaatagctgggactacaggcacgtgccaccatgcccggctaatttttgtattatttagtagagataggtttcaccaagttggccaggctggtctcgaactcctgaccttgtgatctgcccgcctcggcctcccaaagtgctgggattacaggcatgagccaccacgcccagccttaaatatattttctacacaactgtagaattgcctgtttatctcattcactgtatggaaaatgtctgctatgtgacctacatggcaatgctagtccttattgtcaaatcactcagccaaatcagactcattttctgtcagggaaaaaaaaaatctgacttcatttttcaaacaaaattaaagtgttaaatggacatccctgtgacactcatcttagtattgattttgaattcttaaacagcttaccatgaatatattgcctggataaagtaaggtggaacctccctttttttctcaaactctctttgttttgctttcaaaggtctctccctccctcaggggctgtgcatttcccagccatctctttgaagttaggctttttgggttggaggagtagtttgccttttggatgggtaactggagatgtggagatgggtgattgtagttgtggagatgtaaaagaaaaaccgcagaccacagacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgttgaaaagactgggaggctttggttatccacgaatgtattcgtttcattattctgctggaagagtccccaaagcagaagcccatagatagaacataatcaatgtccacagttatttgaaagattgtcatatataagactatatgcttattcagtgtggcatcagaggctgtaactagaatcaacaagtggcagacgtcacctctaactaaagaagacctttttgatgattaaacttactccatgaatgaagcagcctgtctcacagactatgtagtttctcactagaagcactcaagttgaagctggatccttccaaggggcctgaagataaggttttaattttggactagagatggcctctaacatcccttctaattttaagatattgtaattcttttgttttttttttttttttgagacagagtcttgctctgttgtccaggctggcgtgcagcggcgcgatcttggctcactgcaacctccgtctcccaggttcaagcgattctcctccctcagcctcccaggcacaggtcaccacgcctggctaatttttgtatttttagtagagacagggtttcaccatgttggccaggctggtctcgaactcctgacctcaggtgatctgcttgcctcggcctcccaaagtgctgggattacaggcatgagccactgtgcccggccaagatattataattcttttaaaattacttatctggtttaattttattctttattcaagaaatatatttctgtctgtatgtttattttctgagaaaactaagaacaagttgggtttgttttttgttgttgttgtttttgtttttaacagtctcactctgtcgcccaggctggagtgcagtggcgccatcttggctcacttcagcctccacctcctgggttcaagcgattctttgcctcagcttcccatgtagctgggactacaggcgcatgccaccacgcctggctaatttttgtattttttgaagagacggtgtttcatcatgttggccaggctggtctcacacccctggcctcaagtgatcaaccctcctcagcctcccaaagttctggaattacaggtgtgagccaccacgcccagcctcctaaaaagcaagttttacatactatataaagtaatgatcacagaaagcaaattttaaaaattcacctaaatttcaccatgtatgctaattgtatcaaaggggacttagtgacagtgtagtagagaaaaaaggatctttggtttcataaaacctgggttaacatcccagctctgtcacttttactaattatgtgaggttggccaagttttataagttccctgagcctcagtttgcttaccttcagaatcttcctaagattatgagaactagatgagaaactgtatgtgacttccctttgtaagtggtgaagtgctttttaactataaagtattatttccagtggctttaacaggatagttttagtccctcattgttgaagtagtctgtgtgggattttatgtaactaattttgtatgttgtgatggaaataattcatggttggctgtatatcgagatgagacctggttaaattggatattttccagtgacctgatcccagtgttaacccaaatcactagaacatggccttatgttttcttttgttttgttttcttttttaacagtgtaattgtggaaaatttcaaatgaaaagagagaatagtataataaaccccagcatactggtcaccaagcttcaatagttatcaaaacattttgccattcctattctgttcctcctgatgtctttttctcccctggagatttctaaagcactataatttcacctataaatactcttgtttgtatttctaacagataaggattttttaaatgatcatattattattatacctaacaaaatcaacaataattccttaatatcatgtcatgatcagttgatactcagttttccctgattgaacatgaattttaactgacagatttctgaatttagaattgttttattagctctagggacctgaaagtagattataaattcagttaaaataacttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagtttgagaccagcctggccaacatggcaaaaccccgtctctactaaaaatacaaaaattagccgggtgtggtggcacacacctgtaatcccagctactcgggaggctgaggcaggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatatggaaaagattagattagtaaatttcaaattttaggttagaaaatccggtataaaacttgttaaacaagcaggtacccaggtcccacctctagacattcacttttgcagatgtgagttctgaccgggcaggtcaagagatgattgacctttaaaatgggggtaatacaacataaaggctatatcatcattgtcccaacacacacagtagttttgtagacatctgcatatatttgcacatccattactttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccagactcccagaaagaaagcaggtgttcagcctaaatcacattgttagcacaaacagtttagacacagtgagtcagtcttttcagtcaggaatgtagaggaccgtcctgaaatccaagttcccagataaacctctcaagggccaaccttagtaggcctttcaagccttttatgagatagtagtttaggcctgctatattaactcttctgcacaaactaaaatagagataaatagaagaagggttttaaaagagttgatataaactcctggatctgcaaacaaaatataattgactgtaaagataatgacagggtttggagtttggggtttttttttttttctttttaactgtaaatacagtatcatttttatatctgttaaaaaacatttaggtggtcagatttttgtataaaacaaatcctggattgggatgttacagtatagaacagattttaaactttgaatgctatatgagaaaataaactattcagatgctactgtcttagaaatacatttgaaattgtcactccgataacttttcgtctatgacaactaatcttcaagccactaaaataattttgaataaatttgtgtacatataaaatctgaagaaaattcagttaattttctgttatttaaaagaagtatagtttgttcatttaaaaataaaagttattggccaggcacggtggctcacacctgtaatcccagcactttgggaggccaaggcgggcggatcacttgaggtcagaagtttgagactaacctggccaacatggtgaaaccctatcactactaaaaatacaaaaattagccaggcgtggtggcgggcgcctgtaatcctagctactcgggaggctgaggcaggagaatcacttgaacctgggaggcagaggttgcagtgagccgagatcacaccactgcactccagcctgggcaacaagagcgagactcagtcttgaaaaaaaaaaaaattcttagtgtacaacctttgccatatacataacttgtaaaaatttagaaattacagaaaattttgacaaaaaataatgtcttaattttgttataaaaattgtaacagaaataaatgtcattcacaaacattttggaccatttccttctattggaagcattttgctataccattaaatattttttggatacaatattttaatgacttcattaagacatctaaatgtgtgcatgtgccatgtttaataaattccctatagttcaacattaacattgtttttccctattagaaataatttataattaatatcttgtacataattacttgttcacgccccttgattgctttgtttcctcagaatacatttctgaaagtagaataactgggtaaaagagtatatgaatacatacaaatacatacatcatacttagatttaacctttttctcagtacaatgcctcacattttgaaaaatacattcacataaatatacaacttaaagaattattgtagaagtgaacaaccatgtaactataacccaagtcaagaaattttaaaactgccagtacctcaacagcccctgaattcccctttctcatgataatccccttcttctctcagaaataactaatctggacttcacttctgtgctttttatatccctagcatcaaaataggaattctcagaattctcaaataataaagttcactgtcgtctgctaaaatctattttttttttttttttttgagacgatgtctcgctctgtcgcccaggctggagtgcaatgctgtatcagctcactgcaacctccgccccctggattcaagcaattctcgtgcctcagcctcccgagtagctgggactacaggcatgcaccaccacgcccggctgatttttgtatttttagtagagacagggtttcaccatgttggctaggctggtctcaaactcctgacctcaagtgatccgcctgcctctgcctcctaaagtgctgggattacgggcatgagccaccacgcctggcctaaaatctttatttgaatggaatcctacagtatatactctatttttggtctctgagattcatctggttgctttgtgcagctgttcctttattttattgctatgtagtattgcagtgaacaaactcgcactatttattcattttaatgctaatgagtatttgggtgattcccagatttcactattttgtagagcagatccttccacgttgttcttcagccatgttttaagggatgtacttgtctgcatttctcatatacattttagaatgaggttgtcaatttccaccaaaacaaaaaaactattgagatttttgtcttgaattactatatcaaatcttgatagcaatttgagaataattgacatgtttacagtgttgaatcatccaattcgtgaacatagtgtctatcttcccatttatttagctctttgatttcttgcaataaagttttatatgttcctctgtagaggttgtgtacatctgtattagatttatgtattgtcagatttattcttaggtattttgtttttagggtaagtcagtttctctcattctcccttctctttccctttccttgtactaactttgtgttcctattcatcaggcttcattaattccaacaattaatctgtagaatcatttggattttctccatacataatcatatcatctgtgtataaggaggatttgatttgccctttccaacttttttacatcttttcttgcctttattacaatggataaaacattcagggcagtggtgatggcagttatctctgcttatttctgatcttagagtttgctaagcatgaatggatcatgaattttatcaaatgtcttttttctgcatatgcagtcatgcatcctataatgatatttcagtcaacaacagactgcatatacatgggtgctctcataagagtataatggagctgaaaaattcctatcgactagtggtatcatagctgtcataacataatagctcaacacatcactcacgtttgtggtgatgctgctataaacaagcctgtgctagcagtcatataaaagtataacacatacaattatatacagcacacaatacttgataatgataataaataactctgttactggtttatgtatatactatacttttttgttgttttgtttttattttaattttatttattattattataccttaagttttagggtacatgtgcacaatgtgcaggttagttacatatgtatacgtgtgccatgctggtgcgctgcacccactaacttgtcatctagcattaggtgtatctcccagtgctatccctcccccctccccccaccccacaacagtccccagagtgtgatgttccccttcctgtgtccatgtgttctcattgctcaattcccacctgtgagtgagaacatgcggtgtttggttttttatccttgcgatagtttactgagaatgatgatttccagtttcatccatatccctacaaaggacatgaactcatcattttttatggctgcatagtattccatggtgtatatgtgccacattttcttaatccagtctatcattgttggacatttgggttggttccgagtctttgctattgggaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcctaccaacagtgtaaaagtgttcctatttctccacatcctctccagcacctgttgtttcctgactttttaatgattgccattctaactggtgtgggatggtatctcattgtggttttgatttgcatttctcggatggccagtgatggtgagcagtttttaatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttagacatgaagtccttgcccatgccttgtcctgaatggtaatgcctaggttttcttctagggtttttatggttttaagtctaatgtttaagtctttaacccatcttgaattaatttttgtgtaaggtgtaaggaagggatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagttgggtagcgtgatgcctccagctttgttcttttggcttaggattgacttggcaatgcgggctcttttttggttccatatgaactttaaagtagttttttctaattctgtgaagaaagtcattggtagcttgatggggatggcattgaatctataaattaccttgggcagtatggccattttcacgatattggattcttcctacccatgagcatggaatgttcttccatttgtccttcacgtcccttgtaagttggattcctaagtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttctcctgcctaattgccctggcctacagtatgttttaagctaagtgttattacaggagtcaaaaaggttttaaaattttttaagtttattatataaaaaattatagtaagctaagatttattattgaagaaagaaaaatacttttatataaatttagtgtagcctaagtgtacagtgtctagaaagtctacaatagtagaaagtaatgtcctaggtcttctcattcactcatcacttactgactcacccagagcaagttccatgaatgcaagttcccttcatggtaagtgccctataccagtgtaccattttttatcttttatgctatattttgattgtaccctttctatgtttagatacccaaatatgtattacagttgcctgcagcattcagtagtcacatgctatgtaggtttgtagcctaggtgtgtagtaggatatcccatctaggtttgtgtaagtacactctatgatggttgtacaggaacgaaatcccctaactatgcatttatcagactatatccccatcgttagcaacacatgactatattgaaataattatataataccatccttcaatctattgctgtagtgaattgcattgattcttgggttaaccaaacctggtcatgatttatgatcttcataatcctttttacatattgttgggtttggtttaggctttctgtgtctctcttttttaatttatttttacttttttttttttttttttgagacagggtctcattctgtcatccaggccatagggcagtggcaccatcacagctcactgcagcctcgacctcctgggttcagttattcctcctacctcagcccctttctgagtagctggaaccacaggcgtgccaccatgcctggctaattttgtagagatgaggttttgccatgttgcccaggctggtctcagactcctgggctcaggtgatctgtccgcccagcctcccagagtgttgggattataggtatgaaccactgtggcttcctggttttcatacctagattacacttgcctcataaaatgaattggggaatgttctctcggtttttttgttgttactattgttctattgattgattgattgactgagatggagctttgctcctgtcgcccaggctggagcgcagtggcgcaatatcagctcactgcaacttccgcctcctgggttcaagcaattctcctgcctcagcctcccacatagctggaactacaggtgtgcaccaccacgcctggctaattttttgtatttttagtagagacagggtttcaccatgttaaccaggctggtctcaaactcgttacctcaggtgatccgcccgcctcggcctcctaaagtgctgggactacaggtgtgagccaccacacctggcctctattgttctctttatgtgatttgtagaactcacctctaaatccatccaggccagagttttcaatcttagttcaattccttaaatatttataggaatattcagggtttttattcattactgtgtcacttttagtaaactgtattttgctaagaatgagtgcattttatctaaattttaaacagttttggcataaagttcataataccactgcaggttctgtagtcatgtcttctttttcattcttgatactggtaatttgtgccttctctttttctttctcagccttgccagacatttaccagttttattattcttttcagtgacaacttgtagctttgtaattcttttttttttttttttttttttttttgagacagagtctcactctgttgcccaggctggagtggcgtgatctcggctcactgcaacctccacctcccaggttcaagtgattctcccaccttagcctcccaggtagctgggattacaggtgcctgccaccatgccaggctaatttttgcatttttagtagagacggggtttcaccatgttggccagactggtctcaaactcctgacttcaagtgatccgcctgcctcggcctctcaaagtgctgggattacaggcatgagctaccgcgcctggcctgtaatttctttttattgtgtgttgttttctattttagtaatttctacttgctgttatttccatccttttattttgggtttaattttctgggagctttttcccttttagtttcaacctttttgtatccttgggttttatttgtacctcttgttaaaggcatatagttgtgttttattccagtctctcaatctttgtcttttacttggatcatttagtccatttacatttaattatattttagtatattttgagttttatctatggtcttatgtgttctctatttgcaccacctattccatgtttttttctctcttgatttatttgaatcaaatgaatatttttatcattctattttccctctgttaattttgaagtttaagcactcttttctgttatcttagtgtatatcccagaaattacagtatgcttcgtaacacatcaaattctgatattgataccattattgtcctcctgaacagtgcaagtactgtagaacatgttaattttatataattccttccttgacttttaggctatgtttttcatgtatttaaattatattcgtgtgtataaaaacataaatcccatgtatttatatcatctcctatttcttatattatttgtatcgatttggatttacccacacacttatcctttgtttgttctttattctttcagcatctctaaggttttatctgggttcattttccttgtgtcagtctgctggatgcaaactttccatttttcttagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagatagatagatagatagatagatgatagatagatagattgtattatttttggcttttattctcttgcaaaaaaaaaaaacaagctcagcttttatgttctagggcatagtaagcttcattgtttgataatctgtgctggataatctcagtatatgaagtccctgtgggtttgcttttattgtctgttatttttgctggttattggtcgagatctcttatcccttcatgtaccttattcatttttgtcttgtgctagaaattatgttgaaaattattggcctaagatgatgctttctttctccaaagaggaattttgttgttgttgttgttgttgttgagacagggtcttactctgttgcccagactgaaatgctgtggctcaatcacagctcactgcagcttctacctcctgggctcaagtgatcttcctgcctcagcctcctgagtagctgggatgacaggcacacaccaccacagccacttaattttttttatttttagtacagacatagtctcactgtgtttcccaggctggtcttgaactcctgggctcaaggaatcatcctgcctcctcagagtgctgagattacaggcatgagccactgtgcctggcccaaagaggatttttatttgctgcttctactgcgaaccttcaggcacctagctgtttaagactttcttactcaagatttaaggcttagattttcagtgccacctagatgtaaagccgggttgcaagtctgtgaaggggctgattgcttccagttcacccctagctctttagggcatcagctcagtgctggagagtagagtttatcagattctcttgaattctcactcattttcccttttgagcccaggaattagagaccagcctgggaaatatagtgagacctcatctctaaaaaagtttaaaaattagccaagcatgggggtatgcacctatagtcccagctactcaggagactgaggcgggaggatcacttgggcacaggagatggaggctacaatgagccaagatcatactactgtactccagcctaggcgacagagtgagactctgtctcaaaaaaaaaaaaaaagaaaaagaaaaagaaaagaaaaaagtactttttttttttacttatttagttgtcttcaatgggagacatcatctagtctaccattacaagaagcagaactctagcaatgtatttaaaactcttttaacgtagttttcatattactctccataaagatttaccaatttatattcacacatggtaaataaatgtatctatgtttacattttgataggtcaaaaggatgttttggtttaatttgcatttattttgtcattagtgtggtcaaatattttaaaagtaaatttacccatttcttttgcatctagtcactttcattagttgtttagttttccttagttgttttagttgtaagaattcttttttgtttgtttgtttttgttttttgtttttaatagagatgggctctcccttgcttgcctaggctggttctgaactcctgggctcaagcagtcctcccaccttggcctcccaaagtgcagggattacaggcatgagccaccacacctggcgaagaattctttatttgctaaagatatttacctttttcatgtatttgtaaatattttccccaaatctgcctgttttattttgcttgttgatttttttttaacatgcagaacattaaaattctgtcagaaaattacagataagcaatagggaaggctagaatgaactcttagctactagattagagttgaagacagcagtataatctcatattgaatttattatatgtacacacacgcacacatacacatatacatgtacagatatatacagaaatcataaattatatgtgcatacatgagttagtacacatacattcctagctctgtccacttagagagcctaaagcatacccacacctagatttttgtttctgaatgtcctcctctaatttaagcagccagggatcctcggaaaaatgattataaattctagggctggaaaagagaaaatataagataaacatgaagcatcttagagtgcctgaaggtaaggaagtattcaaaaagatgggggcatatcagagagacataggaaccaacctgaaagcatgtccagtggccaaaactggaacaatttgagcaaaaaataacacagtatagattacaatccaaagtataaaataaatacttatgagtgcatagtgatataaagaaataattagataaacaattgagagagaaaaaaagaagaattccaagtgttaggtatagataatttccctccacccttgagtgtaggttggacttagtaactcactttcaaagaacaaagtatggagagggaaatagtaattttacagtagagagaactaacagattatcttcaccaagtgatcacattagcattaccagtgatcattcctgcgtatatcatccgctccttgatatgatgtgatgagaagggcatttcacctctgatattcttcccaagaaacccataaccctgacctaggcaagagggagacatcagacaaacccaaattgaggaacattctataaaatacttggccagcatgctttaaaactatcaaggtcatgaaaaacaagtaaagactaagaaactgtcaccaaccagaggagactaaggaatcttgacgactaaatgcaacgtggaatcctaaatggcaagggaaaaagtatatagttgacaaactgatgaagtccaggtaaagtctggagtttagttaatagtaatgtaccagagttactcttagcttttacaagtgtactatagttacctaagatgataacactagaagaagttcatttagtggtatacaggaactctctgtacaatcattcctcagtatatatgcaggggattggttcctggaacctcacgtgtactaaaatccacgcatctcaagctctgcagtcagccctgtggaacccatatataggaagttagccttccatataggcaggtttcgcatttagcaaatactgtattttttatctgcatttggttgaaaacattctgcatataagtggacccatacagttcagaactgtgttgttaaaggatcaactgtactatctttgcaacttttacgtcaatctaaaattattctaaaataaaaagttttctttactctaaacaaacaaaaaagaaaccatgagtttacaccatttccagtttaaagtagcaattacagatttttatttacaagacagttattaaattataaggaattattataagtaattttggtattatagttatataacaaaaaagagttcttaccttttggagataagtactgaaatatttatgcataatgctcttgtttttgtttttttgaaacagggtctcactctgttgccccagctggaatgcagtagcccaatctcggctcactgcaacctccacctcccaggttcaagccatcctcctgcctcagccccccaggtagctgggactacaggtgcgcgtcaccatgcccggctaatttctgtattttttatagagacagcgtttcaccattttggccaggctggtctcaaactcctgagctcaagtgatccacctgcctctgcctcccaaagtgctaggattacaggcgtgagccagtgcgcctagccatttatgcataatgttttattgatgtccgggatttgcctcaaaatcaagcagtgggtaggcagtgggtactatgttggaatacaggtgaaacaagattggccaatgtgttgttaattgttagagcagtgtaatgaatgtatgaaactctgtattttctacttttgaaattttccataatataaagtttttttaagtgagaaagaaattacatagtttttaactttttaagttttatatttgtatatcttatctctgaaaatctgggttccttgccacattaatatacttatttgcttcatcctactagtttaaatatgcaataaaaataagactattgaatgcagattaggatttctttgcacttcttttcatccgaagggtatatcccacaggaatgcacaatcaaaaccctgggttttaaagaaattttaaataactcttctcattgtggttttgccacaagcttgatatagatagatttaagtttgtttgtttgtttcagtttgtttttttatttacatagtttttattacaattttagattcacatacagctataagaaatatagatccttgtagactttgcccaattcttcccaaaattaacattctgcaaaactactgtgtcacagccaggatattgacattgatacaatccactgatcttattcagatatctgcatcagtttgtttttaatttttaaaattgtcttttttttctccttgctttaattttggttttagattatgaaaaacatgtatatgattacacaaagtcaaacctgtgaatagggttcattcagaaaggtctagtttgcatccctgtccccattcactttcttgccctaaagaaaacaatttttaaaaattagttattttatttttccattatttttatttgaaaatatgagaagatatgtatatgattttgtgccaccccccttcttacacacttccatatattctcatctaaaccttgatttttaaaaaattttaatatgaaaacactggggatcactccatggcagtaagtagacatcttcttcattcctgtttatgcctgctgaatactccattatggcaaagaattgtttattaaaccattcccctaatgatggactttgggattattttcagccttcttttactacatgaataaccttgtgcatacgttatttcatactgttgctaatgtcaaattccttcctcaaatgttgtgtcattttgcatcgccaccagcactgtctgagggttgtaggcttcaattttaaattgtgatttaaaggactaatctctgtcatataaattagtatatgtcttacttcattaaaaaactgtactcatatgtataaggctagacaaagagagtcatagataaattctgatttattttatggccctcatttatatctgtggacttgaccagaatgcttttaactagagtgggtttcttatcattgtaaggtcactaggtctaagaaaatttgtaatactcagaaatagagagaaggtcatttgtccctctgccatttgtttactttagatagtaggcagagtcattgaatcttattaggaaatataaaaaacatacttgctctttttgccagactcgaaaaagtactaaagctattcatatttcttatacacaccattgagagctcaagaggttcacaggaaataaaggcaagattttgatgggacttttaagacaaggcaaggatttggggtttatcttgaagatgtggatgccatcctaaggcatgtgatcagatcaccatttttaaaggttgtttttttttggctacagtatggctatagtataggaaggaacacatttggatatggggagaattgggaggccattgccattgttcagtatggatattgatggctaggatagatcagtgtcagcagagagcaacagaagtgaattaggaattagaaaggatagggtttgatgattagataaaggaagtaaaggaggaagaggagtcaaagctgacttgccgtctctggcttgggcacctgatatatgatggtgccactgactaacttgggcaaccctggaagcagatgatgcagtatactttggacatgctgagtttgaagtctctgtaagatatctgaatgaaaggactaaataggaagttagatatgtggattaggagcacagagagagatcttgggtagatacagagatttgggaatggttgctacttagatgatttagaagagtatatagagggagaagaaaaaaggacttgaggactgaggttcttccaaattttggaggttgtagaaaaggaggaatagctagcaaatgagatagagaaggaatagctgaagagatagaaaatcacgacagcaaggagttgcagaagccagaaaaaaaaaagtgtatcaggaacaatattataggaaaatgaagggtttgggtaattcttagttccatcctttactagattcctgtattcttcaactattgtcgagtgttcatgctctgcacagctcccattcggcctcatttctgagatgtgctgccttttggtatctattggtatctctttgctgccatttggtattcctatctgatatctcatttccttagtgagggacatagtgagtgaaagaacattagaggacaaatggaaaggcctatactgttgtcctagctctgtcaccaactttatttagtaattttgtttctttatgcctattatctgtgagatatagctagaatttcaggacagagatggctacacatggaaacaattacaatgagaagtaaggagagagaggaagagaaagagccgtcatagaggaggtgatactgagaattgaaggatgaccaggagtttgccaagtggtaatggcaaggatgaaactagaaagaagtagtaaatatattataaagatacagaaatatcataaagctttctttttgagacagggtcccactctgtctcccaggctggagtgcagtagcacaatcatggctcactgcagcctcgaccacctgggcccaagctgtcctcacacctcagcctccaagtagctgggactacaggtgcacgctaccacacgcggataatttttgtatttttttgtagagacagggtttcaccatgttgcctgggttggtctcaatttcctgggctcaagcgatccacccacctccgcctcccaaagtgctgggattacagacatgagtcactgcacctggcaaaataataaaatttaaagaaagaaaatagaatgaagccaggcctcataggaactaggaaaaaagatctcaggaatccaagttactgttctcttcattccttagggttttgtgtctactttgctctggaagaaccagctttctccagttactcaagcgcttgcacatgaccccaaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctatagataaccttcttttgaatcagggatctgtttcatccagtggcaaacagaagcccactgctgtttccatgattgggctggggctttagatgggagagtttaatagaatatagatggcaaatcgactatatgagtgggaaaagagagaggcattacaggcaggcaaagagcatgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccagttgagaatatccaacacacataaacaggaattctagaagtagaacatagagggaatgatgaagaaaagagaccttattcaaaaagataatagcccagaactttcccaaattgaagaaacattgtaacctcagatagatgtaaggtttggagaagaaaattgctaattttcttggattatttgagtttatggtggttgtaggatacccacctgtaggtgtctactccaaactgcctgagtctggcccccaggagaagaacctaggctagcaataagagtttaggaggcattaccattagcacagggtccatttcacttcttggcacctcagtttctaccctagcaacttttgagaatgaaatgaagtgtaaaagtactctgataatcacaacactacatagttttaccattgtcttcattgtcattgtcataaattctattgagtatagagcctcagtattagaggagaagagctaaggaacctggagccagatttcctatattcaaatcctggctctgctactttgtaaccatgtgaccttggacaagttatataacatttgtcttaagcctcaatttcctcatctgtgaaatagtacctgtctcctagtgtttttatgaggattaaataagttactacttgtaaagcactttaaatggcacttggcatgtagataaatgcccagtaaatctttgctattagctattaaagtacctgcatttcacaggaaccttcagtatcttatttcagaggagtgactaatgtaaaaatcatagtctatgaggataataaatttaggtatctgtgtcttcctgtaatactcaaaggatcagtttagttaactgctggcttttgtctatgtaaagagttttgtggttgtttgcaaattgctcatgatgttatttgaacattcaaggacttctatttttttcttggtaatgtctgaaacttggaaataattcatgggcatatgggatattctcctgaggacacaataatggttccatttttcttgctaagttggaacaatttaatcttgagcaaatacctatgcttgtgcttctgtttttgtttatatctgtatacatctatagttttacaaataccaatattgacattttcattttagccagaaacttgcctaaaagtaagattacacgagctagtttgatttcagagtgcaaatggcagtaaaatgaaagcagaaaataaaaaattaaccatatgattattttgtaatccccagtgtgtttgttcaaggtgagatcattttccagattcatccttcacctgtaccaccttcctgatctgcaaggccatatcagggctggcatggttatttacagttatttagatgttctgtgaggcagataaacagaagacaggacacaagtagaactgtcaaaaaaaaaccccaaaatccatgaattccacaagcgactagaaggaacttgttgtggttttcatatctacatcgtttgaaagggcactccctctcctagagatcaggagctgtactgttagtgatggcaggggctgcactgatacacctgcctctgaatgaagagaaggttttgaggagcaagaaggagaacttatttctagagagaagaatggaaataagggctagagagacttagaaacaatcgcagatacacatccataccagagttacaagaacttacacaggatagcaagcaaactgatgcaatggttatgactgatttggtttggggtggcagaggatccatcccagcttctacctgcaaaagtaagtaggactaggtcaaaggtctaagaaacttaaaaaaaagtgtgtttaaactagctgaactaatacatccagtagataaagaattgcacataaggtatttgtataataattttttttgaattaatgaagttaaaaaatttggggagagagggctgggtagaagagagagaaactcgagaacttgggcctttaaaccctgcaagcataactggggccatttaactaaccaacgtcctagttgaacagagctcattttgagtacagaaacaatagtagcttggaaacttagttctacctaaccccatgaaaccctgtctgtctcctggtcagttgggaaagaacttgtgaggatttcagtaattaaaaaaataatccccttgaagaattagaatgtcactgttctctcgataacccccgtaagtccaagttaaggcaatagcagcctcctccttcaaaaaggtgaacaggaagcatggagttatacagcgggctgagaatcaagagactgaggttctagtcctatctgctattaattagttactaacctaaagcaagtctcttaaacttccagttctaagattctgtgatgtaactcatcgtgatttatatctggaggtccctccccctcactttagtgttagagattagggaggtgggtgtttagctgtgaggattagtgagtacactgaggactaacagtgaagttcctacatggtagaagctagaacagaataggggctattgctcttatctgccttgctttttttctggaaattattagaaagccatacagatatgtatgttaacgtaaacaacaaatccagaggtcgtcttagaattatttgctatcccttgtagctggagcttccttatccactaggaggcaccattgtcaaacaacattgattaggggtcaagagctcttgatcatttaagcaattggagaggaaaaatgtctagaaagaagaaaaaagaggtaaatataggaccctggaaattgtgaaaaatcaatctttgttatctagatggacattagaacagttctcagtttctaaaattcgataaacagtatttcagactacatatcaattttagaagtggcaaaatctttcaaggcagtctttttttcgaagaaacaaataagatatgaaaaaagaccttagaaattactgagccaaatcccatctttattgaggagtcatgatcaacccagaaaggttaagtgtcatgaccaagatctgccaggcttgagcctaaaaccgatgtgtagggggggcatttctcattgattttggccatcccaacacctgaactctcttcaagtatttggagaatccctcattttaagagccttgataggggaaaaaatcccatattctactataaaagctaaaaatggcagatatttgcactactaaacatttagacccacagaactaccacaggacacacttggcatcagattcacttagaaggatacaggacagggggaaagaaaaaacagctttttagtcaggcagcaccaggcattcctctgcagtacgagtcctttcagtagtatatacaataaagttcagtaaatataacagggaaaagaaagatttttaaatagtgttgagaaaacaagttaacagttcagaaatcaatttagattcacccttccccacacacatgcacatacaacaaaaatactacaaacaaaatagagttgatagaagctaatcaaatcataggaaagctagcaaaagataaaattatttaacagatctttagagagcttttaaaacttcaaagaactgggatccacaaagaaaaaaggtatcaatagatttaacaaaaattgaaaaaactagaaaattaatttgcttcaatcttgacataaaaggtttacattctatcgaacataaagagttcaccccaacgaaagggaagatattaagcttcatacacaaacaggcaaggacaggaatagacagcttccaccaaaagaactacaattggtaaagaggcatttgaggatatgctcagtcattttaatgtctttgacagtatatcagaattgctttattaaacagtgaatattccctttctccattgaaaaggtgaaggtttctatctacttgcatatcttaattaacaatcctgaataagcaccattcatattgaaaaaatatgattatatcctatttacagtatcagtgcaagaggaggccttagctccatttatagcacctcagacattcccaaccccaaacccacctactatgttgacacatttcctggtgctccaggccttattgttctttgtcggaacaaatgccttgaaatgctgctgtcctcttaactaccatgtagtcaccaccactcccccatgctctcacccttgcttcttgaggacctgtctcagaggctgactactccatgaagactttctttttttttcctttttttttttttttttgagatgaagtctcgctcttgtcacccaggctggagtgcaatggcatgatcttggctcattgcaacctctgcctcccaggttcaagcaattctactgcctcagcctcccgaatagctgggattacagatgcctgccaccacacctggctaacttttgtatttttagtagagacggggtttcaccacgttggccaggctggtctcgaactcctgacctcaggctatccgcccgcctgggcctcccaaagtgctgggattacaggtgtgagccactgcgcccagcccatgaagactttcttaatctctccttctgtaatgtaggctcttagaagatgggatcttcatgtaactggtccttctatcctctacaaatagtagatgtttaatgattgaatactgaatgaaacataatccccccacaaatacggagtagtttagatggggaaagggtgaaaaagattatgcgtacatgactcctttctttcagaaatgaattcgccaccaacaaatatttgtatatattcatcaatatgtgggatagtatgctgaagacaaaatacctgtttatgctctctatttgtctatagacaattgtacagaccagaaggcacctacccatgaaataaataatagtaactgccaggtgcagtggctcacgcctgtaatcccaacacttcgggaggttgaggtgggaggatcacttgagaccagcctgggcaatataacaagattccatctctacaaaaaaatttaaaacttagccagacatggtagcactacttgtgaggctgaggcaggagaatcacttgagcctgggacttcaaggttacagtgagctatgattgtaccactgcacttcagcctgggtgacagagcaagactgccattcattgacttataaataaatacatacgtacacacaaacaaacaacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaattagaaaaaaaacagaattaaagatttttttaaaaaagactgatttgtgtatgcaaggattacagcatttatcaacaaacttactaaatatagacaattcatttaaattatatcaataatatagtattcatatgtatcatctggaaagatggggacataggctctgtattttaaaaatccccctatatggttctggaacatggggcccccataataggcatgaaaatggatttcacatatggagcctttctttacattatgattttacctacttagttgtaatctcttgtcttccattaagtaactgaaagcctggagcagaagtgaggaagtttccctctttgtaacctgagcattttgtggaggataatgcatggactgtaagtcagcttgcctgagttagaatccaggctctaccccttacaagctgtgtgatctcttggtcaagttacttaacttttgctgtttctcagttttctcgtaagtaaaataggggaggtagtcataatacctatgtcgtagacttctcgtgtaaacattgaatgagttaatgcatataagggacttagaaaatacctttcacgtagtaagcactcaataaatgctagctttaattatttattacagcaaaataaggttacttctgtctttgaactgtatataaaataaaccaagcagtttaggtttggctacatctgcttcactcagtattttgtcttcaggattcagccatattcctttgtgtagctgtaattaatttcctttcattgctatatagtattctatacccattttatctattctactattgatggacattgggttgttcacagtttgtgaccattgtgaacaatgctgctataaacattcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtggacatggaggtgggggctaaattttgaaatcaagtacagcaaaaactccaagaggtgttattcttccagaatatcttgagtcttcttggccttctgcaattccatatacattttagattctgctttagagtttccacaaaacctgttgggattttcattcaaattctgttgaatctatgcttcaacttggaagacatcggctgtttacaatattgagtcttcttgtcagtgaacaggataattttctctccatttatttcatttgtttaatttctcttaaaaaaatcatacttttctccacagagatcttatatacctttcttttagatttatttctacattcttaaagaaacactcttttaaaatttcatataacttacaatgattttgctgaactctgcttagttctaattttaacttagattattttggatattctatatataccatctgtaattagtgactgtttcttccttttctattctcatacattttatttctttatcttgccttactgccctggctaggacctccagaataatattgagtttaaattgttagagtggactttcttggcttgttcctgatctaagagttttttaagttttttaatcacaaatacatagttttaagtgttttgacatttattgacctgaccacataatctttcatctttaatctatcagtgtacacaattatattaattccaaatgttaaaagttttgcattcctcgggtaaactcaatttggacctggtgtaattcttatatattgcctgtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaaaaaaaaaaaaaaaaaacttgtcagaaatggcatctaggcctagagttttctgtctcagaagattaaattactgattcagtttcttgaatcagtaaaggattattcaagttttctaattctttttgttaattttggtgagttttatttttctgagaatttgtcggtttcatatacatttttaaatttgtgacataaagtttcagtatcatcttttatttctgcagcatatgaaatgatatctccttcattgttaatactgggtgctatatgtgtcttttctcttttctttttgttatcagtcttgccagagattcatcatttcacagggaacaacttttagctttgttaatttcttgaatatgtttgtcttccatttcattaatttctgcttctatttcctttcatctaatttctttgaatttaatttgatgatctttatgtaacttatacaggtagatgtttagttcttaaatgtttagcccttctctttttttgagtcagggtctcactgtgttgtccaggctggagtgtagtggtgcagtcatggctcactgcagccttgaccttccaggctcaagcaatttggccgtctcagcctcctgagtagctgagacaacaggcccctccatgcccagctaatatttttattattattatttgaagagatgggggtctcactatattgcccaggctggtctcgaactcctgggctcaagtgatcctcccacctcagcctcccagagtgctgggattacaggtgtgaggcactgcacttggccagcctttcttttctaatatgtacatttatagcagtaaatttccctctaagtactgctttacctacattttacaagttttgatgtgtttactgttattattattcagtttaaaatattttctaatgatttattctgagatacatgtaataaaagtatattgtctagtttccaaatgttaggaattttctagatttattaattgctttaaaatttatttatttacttttttagagatgaggtcttgctccatagcccaggttggagtgcagtggtgccattatagctcactgcagcctcaaactcctggattcaatcaagccttccacctctgcctctggagtatctgggactacaggcatgtgctgccatgcccagctaatttttaaatttttagtagagaaggagtctcactgtgttgcccaggctgatatcgaactcctggcctcaaatgatcctctcaccttggcctcccaaagtgctgggattataggcatgagccattgcacctggcctttattaatcatttcagagaatctatttgttgctttgctttttctctattttgtctctttacttcattaatttctgcttattatttccttctaccttcattgggtttaatttgctgttttttaaaacatgtctcatgatgagatgtcactgacttggtaacttttcatattttctaatattttaagtcagcattcacaatatttctattaaatttctaattaaagttttaaaacaagtttatggatacaaactactttgtaagtaccatttcatctgcattctgctttttttttttaacagaactgatttcctatgacaaaagtatagtgcctattcatttttttaaaagtaaaggtaaaaagaagaaaacaaaaaatttcaaatagaattctacccagtctttaacaccccattttaatagcaaaggcttcacactgcatctacttatacataaatatgcatatatatgtttatacatgttaatgtattatgaacatctatgtcaataaatatatgtctataacatcatttaatggcaatataatattctactctagttaccacaatttatgtaaccattctgttgggaatttaggttgcttctaatttctccctattataaatagctgtgataaacccttgtcattaaaacttgaccagtattcctaattatttcccttggaaggaaataattgagccgaaggacatatacatgtttaaggtttttgtcacacattataaaattgcccttcagaaagttgtattggtgtattgttctatcaatagtagattacctactttaagcaaggtttctccagtgccaagttgtgtatgtaacatggatcaccagcttcttaacctgtaagattggacctatgcccctcctcctttcagccatttttctatatttgtgggtctattaatggcaaaaccctgatcttgaaatgtaacgtaccaatcctgtacaagttttgatagtactcttttcattatcattgttaggaatatgttctgctgggcatggtggctcatgcctgtaatcccagcattttgggaggccgaggcagaggggatcacttgaggccaggaactcaagaccagtctggccaacacagaaaaaccctatctctactaaaaatacagaaattagctggacgtgaggtgtgcgcctgtaatcccagctactcgggaggctgacgcagaagaataacttgaccctgggaggtggatgctgcagtgagccaagatcatgccattgcactccagcctgggcaacagagcaagaccctgtcttggaaaaaaaaaaaaagttctaattttcattatgatgatttcttatttgattaattggctatttagcatgatttctcaatttccaagcatttagggttttctagttattttgttaatttatttctaacataactactttgtggttaggaaacatactctgagtactcgtttcttgcagaagtttttagactgagcttttatctccatagtaagcattgaggtttttggggtgttttttttttgtgtttttttttttggtgggtggggatggggtcttgctctgttgcccaggctggagtgcactgacagagtcatggctcactgcaacctcaatctcctgggctcaagcgatcctcccacctcagcctcttgagtagctgggaccacaggtgtgtaccaccacacccagctaatttttttttattttttgtagagacagcatctcactcttttgcccaggctggtcttgaacttttgtgctcaagcaatctgcctgcctcagcctcccaaagtgctgggattacaggcctgagccaccaccatgcccaaccagcattgaggtttttctgtgctaccaacatgacataccagaatttattctgtaccccatttttcatagtgcagctctatggtcccagccaggagcaaagggtgtttcatcagagccttaacctcttagatcaccctggtgcaaaagcaactggaccctgtcattctccatctgaccaccccaccccctcctacctctctagagttcctaaaagtacccctcctttccaaaacccacattcttcccctagggcagaagcagctcttgttcacctctttgagttgtaatcctttctctgttctcaggactagtttttcactcactatactgttaattctcacaagctttaacaaaaactttttgtttgactgggcacaatggctcatacctgtaatcccagcactttaagatgagaggcccaagcaaaaggatcgtttgagcccgggaattccagaccagcctgggcaacatagccagatcctgtccctacaaaaattaaaaataaaaaaattagccaggtgtggtggtgcatgcctgtagtcacagctacttcagaggctgaggcgggaggatcacctgagcccaggcattccaggctgcagtgagccatgattgtgcccctgcagtccagctctaggtgacaaaacgagaccctgtctccatttaaaaaataaataaataattttaaacatttcatacagtttttgtagttggcgtttttgtcatcctcagaaaaaatgctggttggaaaaatccagatttgctctgtacaacagtgttcttcaaggatatttgcagataagtaccaatctgtcaccagtctgccatgagatacatacagaaattgacagtaaacatttagaaactgttacagcaatttgacattgctgtgaaatcatagcacgtgattttgtgccttcaactccagataatcctgttgccaaagcagcatattttggagtggcatattctgatctccctcaatgtgcagccagtaataccttgtgcctcaagacctgtgatctgttttgtttatttgatgagtttggttttggataatttcttaattatataaataatgcatgtttattataaattttaaaaattcagatggatgaaaaggagagacagctaagctcattcataatcccattacttttcacaattcagactaaactgcccttaatttctctctgcatacagtatagaagtccacctcccccatactcttccataggagggtttcttctccctctcctttcattccctcagaatggagccaactaggaaaattcacaatgtgttctttgggggttcttgacagccccagaagcaccccaagatgggaagccaaagagaagagcaataaaagatgccttgtcagtttgtagaatcattatattatcaaataaagtttatcaaagaattgagtcatcaactttgttcaaaaggttcaaggttaggatatcaggatggtatgtattatgaatatgtgtattttaaatttcgttgaataaaatttgcataaataacagtatttttagtttttatttctatatctcatgaaatttaaaattagtagattgcttcttttactttaatatcaattaatattataaataatcaaatagctttaataatagaaaaatattttcacagtgatgcctctctttcagagtaacccttcaaagaatgtgcctgtatatttactaagttgcacaggtggttttgtttgatatctgtggttatgaagcattgaattaaaaaaaaacatataatggctgaaagatcccatttacaatagcaactaaaatataacatgtacagggaaaaagcctaataataaatactttaaaccaatataaagaaaatcgtaaaactataacttagagacatgaaaggaagtggagagacatatcatgttcattgatgagaatattagaaaatgttaatttctagaagttaacctatacatttaccatctgaatcaaaatacaaagattttttatagtttgacaaaatgattttaaaagtcaactgggaagaaaaaaatcataagaaaatgttggtgaaggccagttgtggtggcttgtgcctgtaatcccagcactttgggaggccgaggtgagcagatcacttgaggtcaggagttcgagaccagcctggccaagacggtgaaatcctgtctctacaaaaaaatacaaaaattagctgggcatggtggcaagcacgtgtagtcccagctacttgagaggctgaggcaggagactcacttgaacctgggaagcagaggttgcagtgagctgagatggcgccactgcactccagcctgggtgacagagcaagactctgtctaaaaaaaaaaaaaaaaaaaaaaaaaaaattggtgaagaataatgagatttttttttgccaaatattaaaagctgctactacagtattttattttgtctgtccatgtttttgtttttgttttgagatggagtctcgctctgtcaactggagtgcagtggtgcaatctcagctcactgcaacctctgcttcccgggttcaggtgattctcctgcctcagccttcagagtagctaggactacaggcgcaggccaccatgcctggctaatttttttgtatttttttagtagagacagggtttcaccatgttggccaggctggtcgcgaactcctggcctcaagctatccgcccgcctcggcctcccaaagcgctgagattacaggtgtgagccactgtgtccggccctacagtattttaaatggtaacttgatgcaagaataggcaagtcagtggaagaaagtagaaacctaaaaatacccccatgtgtgtatgcacatgtgtagagattgtcatttcaagtaccagtatttcagatatgaccagacaaaatggattgatccttgctgataattatagcacagggcagtaaataatttccaagtatttctcacggactggttccctccttagtctttatacttctcaccactttgctgcctcctccccaggctccgtcttttccctcatcccttctgggtccctccagaaagtcctctagctctcagaacatctcccaaattctttttggaaacaccagagtccattgaggcattttatttgtaagtatatattacatccctagaaaaagaattccaggattttccctcctatatgttttcatcttgcttcttcatggtccataatgccagctgaggtcgttagtacagtgaatccaaactggtgggataggaacaggttattctgccattttactagatctttgggttgcacatcaaatctgggatctggggctgatcactccacacttgtttaacctacctcaggttcacaacaattttcccagctctatgatcatcagtgatttcaaattcaccaatgtaaccatgcttcatcatcacagttagaaactggacagtaactttggagcacaacctaataagaacctggtgtttgcctctttttggtattgttgatgctctggatagcatcagccaggacattcatgcacaccattatggcagcatggagagatggcagaaagagcctaaattcttattgcttcattatgcaatcagtttagctctctccttttcctaacccctctctcatctaagttgaatcgtgcttaccctcatatatcacaattacaaaggaaaacgcctaagcaaaactgattccttcgctatgagatgttttttagtcctcatagatcaactaaccagcttaaactacagccagtttttaaaatagcgtttcttttctccccacaggacaaagaaatgaaaaatatttactctctgtagtaatcaaggaaatgcaaattaaagcaatcatgaatgacttttttcctcttatctaattggcaaagatggaaaaaaaataatcattatcctagtagagcaagggacacattcacacatggtagtgggagtataaattgttaaactgtttctggtcttgtgtatgtatcaaaagtgttattgtaggccgggcgcagtggctcatgcctgtaatcccagcactttgggaggccaaggcgggcggatcacgaggtcaggagatcgagactatcctggctaacacggtgaaaccccgtctctactaaaacaaatacaaaaaattagccgggcgtggtggcgggcgcctgtagtgccagctacttgggaggctggggcaggagaatggcatgaacccaggaggcggagctcgcagtgagccgagatgcaccactgcactccagcctgggcgacagagcaagactccgtctcaaaaaaaaaatgctattgtatataccccttgtcctagcaactcagcttgtaggaattttaccatacagataatcagagttgctcaccaagatgcatgatcacgttcatccaggctttatttctgatggtggaaaatgagtgctgccatactagggagtagactagaccattataataatgtttatagtagactaggcaactataaacattattttggagaagaatcctatttgacattggaaaatgttccttaggtgtgaaatggaaacttggtaaagtttttagagcctgtataaatgtgaaagtattttcattcatttatataaaaccacaccgagaatcaaataatagaatcaactgttcattaggtgtctacagtgtgtcttctgctgagtattaggtaggggtacattgaaagtataaatatattttttcttgttctttaggactttacactatcatggaactgttgtagggcttaaagatgtgcatttgttccttgcacacccagtaggtatagctataatcaatgggaagagcacaggacatagctagacagagatttcgatcttgtccctatcacatacttgtccactcacttagacaaattatttgaaaatgatgctgacctcatggggtggttataagtatgaagggaggcataacaaggactgcttcctatgatgcctcatgaataggaagtatgttagttcctttactttcccttccagaagtttctatttcctcagtataatatctgcagcaggtatattgggaaactgaactactgaatgaatgaatgaatgaatgagatactggatttaaaaatatgttataagccttaaagcattatgaaaatgttagctgttaatatttgcatagtttcattaatatgtataatatggcaaaattcatgtatacatatataggtgtatgtggggggagggggaggtgtttgtatgtgctaaatgttatggaccatatagagttgttatagaatgaaaagcaaaggaaggcattaatatggctggtaatcattgagggggcttccagggaaggtaggattggaatgaaaccttgaattaaggtaggttttgaaaatgaaaagcaatatatacaaaagtaaaaaagaaaatggtgtactcagggagtgataataagaccattctgcctagagaggaagattttcttgaaacatcagtggacaaggtaggtagaagaggcaaggtgtggccaagacaacaagaggccttacttatctagtaagaaatagaaaactactgtaagttctaagacaatatcgtgacattgcgttaccaacacatctatgtgttacaatatgtttgtagcgatgaactttgggaatggcagtgtaaacaaaaataaattttattttatatatgtcattgttttttccttccacagtatatagcctgaattttccatttagtggtaataacaatagcaagattgttttttaaatccttgtattctacataactgaatatttttggaatttgacttaaaaatatgcacacaaccctagcattgctgttttctgatgcttctttttgtgaaaacctaaagaaaaattatagtcaattttatatactcaatgttatttgatattactgttagcctactcttcctgtttctttccctgcagattttcaatgtgaagatgactgtcatgccctttataatttatgtctatatttcattgaaagaaaggagatttaaataacataacccttagcagtaaatcaactaataacttagttacaatgtattcactttcagtgttgtcttcctggaatttcctcttttcttatgttctttttcacatttttttacagtatggatggagcagatctgtgttttgaaatcgtaaagcgagctgacgctggttttgtgtacagtgaagctgtagccaggtatgtattgtatatctaatcaccagaggtcaagttgaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggtcaggagatcgagatcatcctggccaacatggtgaaactccttctctactaaaaatacaaaaattagctgggcgtggtggcatgcacctgtagtcccagctactcggaaggctgacgcaggagaatcgtttgaacccaggaggtggaggttgcagtgagccgagattgcgctattgcactccagcttgggcaacaagagcgaaactcagtctcaaaataaataaataaataaaatgaaaacgtgggtttataatacaggcttacattttcagtactgctgtctttcccatttctgatgatttttgtacaggaagcggggatctaatagctcaggaaccatgtagaattctacttgggtttttttatttttgttttggcaaatctgcctcattagttcttcattttgccttttagtgatatcaaattatctcacaataattaaggaaaagtaaagaacagtaaaaggaagagaaataaaagcaccatttttaaaaatatatttgcttcaggccagtgtgagacctaccaatcaaatggcagctgttgttctaagtggagaagttgtttgtaaagacctaatgactcaaaataagaaggaaatatgggccgggcgcggtggctcatgcctgtaatcccagcactttgggaggccgaggcgggtagatcacgaggtcaggagatggagaccatcctggctaacacagtgaaaccccgtctctactaaaaatacaaaaattagccgggcgtggtggcgggagcctgtagtcccagctactcgggaggctgaggcaggagaatggcatgaacccgggaggcggagcttgcattgagcagagatcgtgccattgcactccagcctgggcgacagagcgagactccgtctcaaaaaaaaaaaaaaaagaagtaaatatgaaaaatcacaggagccatgcacgtgctgggccacttgcttatacatttagagcaacacagctttctgttttggttacattcaatcataattacccactcctgtaggttgcctttttaatacatggaatacagcatccctccttagtcaccagccatagtatgttgaagggttcaaactcacaaacatattaagtttttttttttttgcggggggtgcgggcggcgggggacggagtctcactgtgtcatccaggctggagtgcagtggcactatctcagctttctgcaacctctgcctcccaggttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattgatttttaaagccacctgtataagctgttaaaatggtgaaaggaactttccagagtggaccagaaaagagtagcattgggaccagtagatgacattgcaaagagagaggtttggaggcagtttattaaaggttcttcctctgaacaataaaaaaaagtaggcggggactcagaaagtattattatgtgtgtttgctattgcagaggatcaatgaccatgcaacaagggcgcgtagattcttccattggtttaatgacagatgacttctaatctttcttcgtcctctctgattctgtgatttattgttaggaaattcagcttgtatcagtattctagtgagaccgactgcaagaagactctgagacaccaagtaatcaaattgataatgttgtttttctccaactggctgagcttcaagaggagcagcaaagcatggcataaaataaaactgtgttcagtccttagtgcaacccaattagttattacctccatcctttcaggggtgatgagttgtggagtgagctaacacacaagatcagattatcaaatcaaactctcagagatcttcttaactagtaccaagctttactaaataatctcaaggatacaggcagtcagaaggctcaagtgaagcagagaagggaagggcagccccccacgtcacttcttactgcctcagaaatgcacctctggcccagaatagatgaggtttatactggggtttgtgggtttccacacacaaaggggagcattgcaaatatcttcattttacaccccagagatttggatagctccattgacattctccaggaagccatctgtgcctcagagatcccgtgttctacttaccatagtaatccttagccagagatatcctattaagggcatttcagagataaggtctcttctgcctagcaaatagcattaggcttttcacctgcattgacaagaatagcagactgaatcacctctcttctaccatgctgcacccctgaaatgcctccttccaaaggcagtaaatgcattgctggccagctttttccttccatggagttattatcttgctgatccttaggaaagataaagataaacaaatatattgctgagtttctctgaaagcacaggtctctatgatgcttcatgaagtgaagttttttgattaaaagtttagtcagcaacttcctagaacatgtgggcagattttagttcttgttttattctgcttgcacactttgacatgcattgcctcgcaggatcatgactgggagggtggagaaagatagttcagttctgttataacttgggaagaaaaacagttccactgtctccacacacgccgcaaagattctgctgtgtacatacgtttgggtcaagtaattgagtgttctcatatgcaaatgaaaaaagcctcattcattgagtttggttttgtgttatgagactttgagataggaattttctttaggttaaagataatttaggtggctgtctcagtgctttgtatccaaaatagttcattctgtgggtacaagctatgtccactttaactaatttaaatttacccagtatttccatgttgacatctagatggacaaataagctgttcctaaatctttgattgaacttaacaataataatattgtactaataatgtcttaacctttgtagcatggtttagagtttacaaagcactttgacaggtgtagtctcttagccatttcaaggggttacagatcttccaaagcctgatttgaaccagtaatgggccacaacaccaagttaacccctcatttgaacaaaacttatggccaggcgtggtggctcatgcctgtaatcccagcactttgggaggctgaggcaggctgatcacttgaggtcaggagtttgagaccatcctggccaacatggtgaaaccctgtctctactcaaaatacaaaaactagccaggcgtggtggcgcatatctgtaatcccagctacttgggaggctgaggcgggaaaatcgcttgaacccaggaggcagaggttgcagtgagccgagatcccaccattgcactccagcctgggagacaagagggaaactccatctcaaaaaataaaaataaaaaataaacaaaacttaattacaggctacaatggcccaagcaaagagtatatgagcacaaccccttatatgtgcatttgcaaagtaagataaattaaaacatcagagctaatgattacatgagcctagctctctggcttaaagccccgttgtaaggagcctgtgattagtacaggaacaaggcttgtgattagtacaggaacaaggcttgggtttgtttttgtttttgttttttctcctacctttcatttttaaaatggaacctttccaattaattgtaatacatgaaataatgcatatgctaactagagaaatattcctgtgagcttgattaaatggtatcatgccaaagagggaacttgatggaaatgtcttttaattgtaaagccaggatagggattttttttttttttttagtcctgagtcacatacacatgttcaaggtcacttgtatcagaaatataagatctggaaacaaaacaaaattctataaatattatacagtgaacagtgttaagtctattgcatttctgtcatgctggttgggaaggaaaagggaaaaaatgagaaaagaaggggaataggaagaaaagagacaaatatggagggaataaaatacagaaaatgaaacagatactcagagaaagagtaatagggcaattatagaagaactttagaaataggagaaggaggttctaaagtggtactgaatcaactgctcttgtcacacatggttgctagttaaccccattaccattttttaattcctgttctttaaaatgctgatttcttctttgttcttcacctgtgctccatgagggctcctcagctggccatgtaaggagtcaggctttctaggacatgtgcctagaattaactccactttgttcaagggagccccaactaaaacttgattatgttacaaaaagaaattgtccgataagggtggctcttccctcatttgtcctcacagctaaatagaagtaagatgaagagcatcttattatttgctggcagatcaaaggctcccactgcttgagtctgaatccttggggcagccctgagcactgtttacataacgcagtccagtttaagtagaattacctgagtattggggaaaaaaattgtcatgttttaagcttgaatttttagtttgcaaagcaaatttacttatgaactatgtgtaattcttttgacttagatagcttagaaaatatagagcatactatttcttcatgaagcccataaacttttgagtctgccaacattttcattattaagcctcactttacaccaatcctgtctgctcaaatcaaatgtgtccatggacagctaatatgagagtgggagttataaactaggagcactgtatattaagttttaaaataaaaattgtttacagtttttagatttcttttgttttttacagccattatatgagacagatactggaagctctacgctactgccatgataataacataattcacagggatgtgaaggtaagtcatttgttatcactaactttaatgtttgtgaagaaatactgatataacaatgataatcaagaattcttctttaatattgtcataaagaacatcttaattttacttctaagtaaaaatgtatttaactgctttgtatttgggaagtcattgtactaattcttactaggaacactataatttcaatttatttatttttactgaagtgttcatgcaatctaaaattgtattatttctcttttgccattgtgtgtgagagagaaatgaaaaatccaataaataggaaaaaccaaacaatatcctatactgagttaattgggggggaaattagaatttggtttatatagtaaaagttaatcataacatattttcataatattgcaatgcagaatagtcagcattgtatttttttgcagatagtttttaaatatagtatgaaatcataattatacatgtaatacgattttatgcttggaataccggtattatcattattcagtctttctgcctatttcatcccagtatcgggttaatgagaactctcagttcctggttctttaacggtgtcaagccaaacatagagggaggcaagaaatgagaccagtaggccttcctcctgatccctagcttctcccaaggcccagaatcactagggagcccctgaggtccctttgaccctgggctacacttttaagctctgatattttgtcactggcctttctctaacctccagcatgcacatacatagtgttccttccctcaagatatattattaaaggcctggcttcttcgatgtatttaatactttaaatgattaagaaaattaagtagagtttaattaaagtgtctataatgtttgggaaattttcacagaaatccttgtagttaaaagctgagggaaaacatgagcaattccaaaaccatctagtaaaatattttaatagcaaatgaaaatcactggagaaatatacaaaatacacattagtgtaaattagttgtaaaatatctcactcatccttttcagatgtgttaagaaaatgatattgttattatcagaactcaacaccgagcatctcaatgggtccccctttatgaaaaagtattctggccaagcccggtggctcatgcctataatcccagcactttgggaggccaaggcgggtggatcacctgaggtcaggagttcaagaccagcctggccaacatggtgaaaccccatctctactaaaaatacaaaaattagctgggcatggtggcacatgcctgtagtcccagctacttgggaggctgaggcaggagaatcgcttgaacccaggaggcacaggttgcagtgagccgagattgtgccactgcactccagcctgggcgacagagcgagactccgtctcaaaaaagtattcttcagttatccaaaaagaaataaaagtgtggaaaggtaaaaggcgggaaattgtcaactgtagtagtttgctgtgcagttattttgcattaattaatgtaagaaagttcatatgtagagagtaaaatatatctctttgtatatattctaaactatatacaagaaaaaaatgataatttaaaaacctaaaatgtgttcatgtaatagcattatgttaagaactgttttgctcaagaggcaattttattttgaatgaattattctcgaaagataattatatcaacatcatataataaacaatgattgacaatatattctactgtaatactttcaataatgtagtcagcttttgattaactggtatttgatatgacaacctaaacctaattaatatccaaaagtagataatttgacctcaccttttaatttaccttctgatttatttatttaacaaatatttgagtgcctactttatacagattactgtgcttggagccctaaaagtattatggtctcagtagggagataaggctcggtatctcttatctactgtagcagatcaacacatgccaaaacatagtgacttcaatcaataactgctgcttacttgctcacaattctgcagtttgggcagagcttgataggactgctcaattctgtttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttagggctccaaaagagcaaaaatggaaggtgctaggcctcctgaagcaaactgacactgtgtcacatcttatgcatttcattagttgaaacatacttcacaaaaaggtcacaaggctagtctgagttcaaggggaagaaacatagattcatattttgattgatggagtgccagatatatacaaggatgggagaacttgttcgtggccacctttagaaagacaaataattattgtgcaaggtagaaggtgataagtatcattaaaagatgaggtcagagaagtttcctgggggaggtcacattggagcttgttcttgaatcatggggtagttatatggagacaaaaagacatttcaggcagaaggaacagtttgtgcaaaggcccaaaagtagtcttacgttggagtatgttagattagtttattatttctaaagtacatgctaaatagtttagaggaagcacgtagaaacatgccaaggaatgaaaaagaagtaattctcaaactgcaaataagtaagaagaaaccaccccaaaaattgccattgttcagttgggagacacactcaacacagagcacacgttaatgttgatattctttttttgtttgttttttgtttgtttgtttgttttgttttgtttgttttttgatacagggtctcgccctgtcacccaggctggagtgcagtggcgcaatctcggctcactgcaacctctgcctcctgggctcaagcaatcctcatgcctcagcctccagagtagctgggactataggcgtgcgccaccacacctggctaaattttttttgtagttttttgtagagacgaggtttcaccctgttgcccaggctgctcttgaactcctgggcttaagcaatcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattctcattctctctctctctctcataattcttggcatatgatccaaaagcattacatttcccaaggatcctgttattatatttattaatacttttttctttacttttttacaaaaggtatttccttttgtaatcattgtaactgagtcttaaaaggattatttggttagatttgaatatatggtaccatgtaatctatttttgggaactgcttgctctgaagaagcagtttcacataaaactgcataaaaagcaatcatataatcctttgaaattcgagagatgtgtgaacatagtgctgggcctccccacagccacacttagtgacatatcaggctatattctttgctgtgggaggctgtcctgggaattgtaggatgctgctaagcatccttcacccactagatgccagtagcatctccccctagttgtgacaaccaaaaatgtctccaaacattgctaaatgtcccctggggcacaaaaattgtccctggttaaggcccactgtcataatagactgttataattctcaagatttgcctccctacaggtattaattaaggcatgcatataaatttctatttttttctgtcatcttcttccctttaattctactttttcttgtgaaagaatgtgaaaactttcattatgtttctggtatttttttttcttcctctcacccctaaattaaaagtactttagaaagaaatagcacagttgtcaaggtaaatgcaactcctggctctttgccttctttcatgggctctactaagcactgagagtttgtggaattttctcctctctcctaactcttgcaggcagccttagatcatgaggttgtggggagacttagttttagacctttctgtcactctgacctactcatgtataattctaataactgaagttgaagtgaaacagtttctctgagaatgcaaattgctacccacaatcactttctattctgaatggtgcctgtgcccagaaggtctgggtgctgtttttagttcttagaactgtgcaaaccccagtcacacacacactcagccagaggccagagtgtttctgagtgtgcttcctttaaatggttttccttgctaacctgtgtgaacacgcctggctgctttttggttcccttctggtctcagttctccttttacctatttaaggccagactttatgataaatttgtgtttatcatataacactggttggcatgacattgtggatttcttaaagcattccgtagtctcttgttctccgttactgatgtttcttttacacctgataccacaactccccaaagtttatcatgttgtatagagaaatttaaattctcataaaacaaaaacgtatttattctttatttattttatttatttatttattttttttgagacagagtctcactctgtcgcccaggctggagtgcagtggcgccatctcagctcactgcaagctcaacctcccaggtccacgccattctcctgcctcagcctcccgagtagctgggactacaggtgcccgccaccatgcccggctaatttttttgtatttttagtagagacggggtttcactgtgttagccaggatggtttcgatctcctgacctcatgatctgcccgcctcagcctcccaaagtgctgggattacaggcgtgagccaccgtgcccagccactattctttattattatattaacattggttaatcttctgcatttcttttataagattttttaacataatgtgcacgttcagttttaatgtggcattttaataattgtacttaggaagatctcatggattacatgattattataaatttatcttgtgtttctaactgctatacttctctttgcccagcctactcctacaaaaaaagaaatcaactccttggttttaagtttctcagcctgagcaacatagtaagaccctatctctctctctccttttttttttttttttttgagatggaatctcgctctgttgcccaggttggagtgcagtggcacggtctcagctcactgcaacctccacctcccacgttcaagcaattctcctgcctcagcctcctgagtagctgagattacaggcgcctgccactacgctcagctaattttttttatatatatattttttagtagagacagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtgatccccccacttcagccccctgaagtgctgggattacaggcatgagccactgtacctgactggaagttgtatttttttaaaactcctaagtccagtgagattattacatgcagtatagcttatgttaaacaaacattactgtcttagtcggatgagttttggtctcaaaactcatgtaagaataaaactacttagtctgggcacaatggcttgcccctgtaatcccaacactttgggaggccaagatgggcagattatttgagctcaggaattcgagaccaacctgggtaacatggcgaaaccccgtctctacaaaaaaataacaaaaattagccgggcatgatggtgggcacctgtggtcccagctattcagaaggctgaggtaggagaatcacttgaccccgggggggtggaggttgcagtgagccagatcacgccactgcactccagcttgggtgacagagtgagaccccatctcataaaaagaataaaactacttttgtaactgtggagaaatctgtgcatctcaggaactctccctgatggactttgagttactctatgatttacatgtctagaaatcactagattggacacttccatttacagctagcattcagggcggtcacctcaagttcccaaatctcctttgtctctgcacattaatgagccaaaaatccaattactactataaacgaattgatactcactgtaaatatttgaagccagaatgtgttcagacttttctcagaacattttcatgtctcagttaagcatcaaagtagaaaaggaaaaaaaaatttactgggtttttgtgtgtgtgtgtgtgtggttttttgtttgtttgttttgcccccggaataacctctggtgatttttgaacacatggctcttgggcaatgtactgtgaattgcttttacagctctaactcaggaacaaaacatgctatgagattaaagccttggaaggattacgtgaacttactttaaacttcattttggacactgaagtaattactatgtgaagaaaaaaaggagtctttaagcagtctctaacaaagtggcaagttactattaatggttgattttattcagctgtttttgtttggttatctgagaagagaatatcagtaccatggaagtagaaatagacaagaagtttatagctccaaagtgcttatgatctctttgggcagatagtacacgcttttttttttaatcataatatatgtacttattacagaatatagtcaccatcatttgtctactgacaagattacatgaaagaaaagaaattaacattaagaaatgcttatctttaaatgttcacttaaatattagaaaaaattggggtgatttacttaactatgcacatatacatacatacatacatatatatatatatatatatatatatttttttttttttttttttttttttttttttttgagacagagtctcactctgtcgcccaggctggagtgcaatggcatgatcttggctcactgcaacctccgcctcctgagttcaagtgattctcctgcctcagcctcccgagttcaagtgattcttctgcctcagcctcccaagtagctgggactacaggcacacaccaccacgcccagctaatttttgtatttttagtagaggtgggtttcgccatgttggccaggctagtctcgaactcctgacctcaggtgatctgcccacctcggcctcccagagtgctgggattacaggcatgagccaccgcacccagcccacttcaatattttcatcagtaaattagtatactttagagttgtggtgattaaaataatatatgtaaagcatataagtagaatgcttggcaaacagcaagtgcttactaagcgttagctactcataatagtaacagctgatttaataataggatctgtaaataagatagtattttctgctctacaaatgaagaaattaacacgtacagaggataagttaatttgcctaagattgtccagctaaataaaaagtagagccagattgaacccaagaagtataacttcagagatcaatctcttaactgcaatactattacactcccttattattcattcatttatttcacaaaaaattaactgccaggtactgtttgtcactaataacattatttatattgaatacagaagaaaatatgcacaatgtgatgaagatgggcatataatgacatagctttttactttgacaaagcctaatccaaatatttaagcatttttataagtatcatctgctttaaaaatatagtcaatgaatattgcttctccccaataacatgagccagataatttcaaataaataatatgtttataaaaccttggatttttttcactgtattattcatgcatttaggtaagatgtgaatgaggatatttcttatttatttttttacttatttttatttttttgttttgttttatgagacagagtctcgctctgcctcccaggctgtagtgcagtggcacgatctccgctcactgcaacctccgtcccgggctcaagcgattctcctgcctcagcctcccgagtagctgggattacaggcgcccaccaccatgtccagctgatttttgtatttttagtagagacagggtttcaccatgttgcccaggctggtcttgaactcctgacctcaaaatgatccacccacctcagcctcccaaagtgctgggattacaggcgtaagccactgtgcccagctacttatttttaaagattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccattggaaacctttcaggaaatagatactcatgaaaggcatggcactgcacacaagtaagtttgcagtcacaaggtgtgacaggtagatgtgcgttgatgtttttttacctatttttgttaaaaatatccattgagagagagtgtttccaaaaacaccaacaatacaaaggaggatgtaaatgattggtaaagccatggaagagatcatagatggttgaatacatgttgtattgttgttcatttatgtcaggttttcttgaattttgtcacaggagctagaatagaattgcagatatttaatattaaaattatttttggtacagtatttaagctgaatagtttttaaaaaagaaaaacattgaattaaataaaatagtaacaaaaatgtattggatggaacgggaaagtatagatggcttcttaccttttctaatcacgattgtccggttgaaataaagacaaaaagttacttattgtgatggataatgcctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaacataaatgctggtttttacttttttctgtcttatatttaaatctttctcgcttcaaagggtacacatgaagtgctgaagaatcatatacaaactgcttttattcttatttttctccttatttcctcacttctttcaggtgagaataacaaaagttactggattctggtcaaataagaaccatgatctctattcagaatgtgccatattctctgtgttcttcaccatagccttctgagcaccacattctccactctttcatgatctagagcaaggtttctcaatcttctttttaatcatgttctcttttgataaacataaaaactgtaccatacacaaccctttgaaattcttatatccccccagcccctcagggcaattttactctctacccccttcagaattatggtttgatttattttctgcatcttggattacagaaattggggttttttttcaaatatgatattataattttataataactttttaaaccaatccacacccaaagtcttgaaaacttgaggactgtgcagtgtctgtgggtttaaataacaagattcttaattaatgtttaccactgtctttataattttatttctttgctatttttatttagaaaacagtccatatgcttcattgtaagtttgtatctgaatctagtgcaacctgatgaattataatctggtttcagttagtgtagaccctggtataaatatataaaacctaatctgtaacttcaccagttcaaaaatcagtcagacagtgaaatgagccagtttatttaagaaaaaattatctgctcacagtaggttttgattttacataaggattggagcttccttttatgatgctgttaaagaaaagcagtagctcctaccttgtgcagataatgcatagtatactaaaaactgcaaaggtaatggtgcttctgtatgaatattaaatgcttccaaacaaaagggacatagacttctgcagaggctagctttatcagacagaagttgagtctctgtaggactctcagtgtagcagtcaacaactaggtcaccatctttaccttcccaaacttgtatctactatgtacatctccttcaaaaataaacttggatcataaaactactagataactattttccagaatttggaaagtactattaagaaatcaaataaaaattacatgttacagatgcaaaactggtctccagaaaatgtctctaagtctatattcccctcaggagaatgtctatctcaagtcactcatgcatacattttgtctctgctaatttgacaaatgaaaaaagttctacaactcttaacttcagttactaatgactgtctacatagttaatatgctgactgcctttcttaatgatcagctttcaaaatttaaaccattaggtcctgtttatttttatagagtttaatttttaagctaaaaatgaataataatcactcttacctgtatgagtagtttatgccaactaaggttatattgttcagggcagtgatgccaaatttcagacttaaaattctctgatcttcactcttccaatatctttagtcagtgtgaatagattcttgcatgacaccaactacagtgggaggaaaaggggaaattaaacagaatattgaagaaattcaatagttatggtcaatgtggcaactgcctcctcaaaaaaccctcatttctctatttctgtagtgggaggaagtggtgaacaatatacatattatacttccttatgattatttcatgaactagttacactccagtaacctttgtttgcacgattgactgaagttaagttcacaggtttaatcccccatggccagttttatatgacacagtgatagaaggagccactctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattgaaagatagttgtaatattatctgttcaggcataagcgtctttggtccgaaaaaagaacgctcttgttttcctccattgtctccaaactcagtaaatgataccatcactccttcagttattcaagccaaaaacttacgaatcatccttaattcctctttctttcacatctcacatctaatcaattgctggtactacagcttctactatcactaccatcattcattagccacatttcatgagagcttactatgtgccagatatctcgctatgtgccttacatccaagtcttatttggttttcacaacaccctgtgaaatgtctcattttaaaggtgaggaaaactgaaactcagaaagatctcataagttgcccaaggtcacacagccatctgtcctcacaggatggtgattggctcacctcaaagcaactaattcaagaacaagtccatagctgcaatgcctttttgtgatctagcctctgaagtcaacagtgtcacttctgcagtattctattggtcacacagagccagccctgcatcagtgtgggacgggtaaatatcaggaggtgatgatcactgggagccatcttggaaactggctatcacagatgtcaatcaaccgttgaaacaaaggaagagtcagaagtactgcttaaaaaccgttgtcagtccactggttgtttattggacaagcatacctggataggtgtaagttttgccagttcttacactattttggtttttaggtctatttttgttaaacagtgtaattcattcaacaaatacttattggagtttctactatgttcctagcagcatgtggaggtcacagaagtaggatgtttagtcacaagctaattgagggtctctggaaattgagcagattccacaagcaagccaagaatttagattaatatgtgatacagatttcaaatgctctgtgaattagagaagggcagaaacagtgactcaaagtggttctgaaaggctttgtgaaagcaaatggaaggaaagagaggagaacataacctagtaagtgacagttttgtgccaggtatgggacagagcattttatgactaagaaccctagagatgtgtggtgggagtcccattttacacgggaggaaattgaggctcaaagaggttaaatagcttgcctagaggaatacaattagtaaattagctttaaaatgacctcattctctgccttagaaagaaattattggttgttctagcaggtcaataagggtaccttatggtactcacaatagggtcatgttttaagtatttttaactttgttcagatagggtttcctgttctgatttatgtatttgtgtatcctgttctagacttgaggtagcagaaactgaccatggaagaaatcaagtccagtttttttctgtctttgaaaactctggactttgttaagcaaactattattccaacaatggcagtataaattctttaggattcagtgattttgagttccccaattgaaatatatgtaaattttattttcattcttctaagaaattaggaaatattgttacaattggtaaaaagagtaaatgtcagggaatactagattaataaagtatgttacaagtattctgtaaaagtggcccctttggacttttctcattcaaatcaccaatagttttctttggttctcattcatcttgcccatccgtctcttcaaggttccccttctattgtccaagtccaaatgctcttggcctaacagttctagttgattcctgtatcatctgccaaatattgatctcctaagtgttctgctgtcacccttaggatttacttccttgaggtgttagagttatgtcctacaattgaagttctgtcttgtattaattttcctgcttttgagatggatttgtgtatcaagtgtgttttttaatctggccccaaaattcatctggagtggttcagtgagagtgtttcaaagggcaggcatatacttacctggcagaggagataccatcatcaaagggcaggcatgtggacatttattttggcaatccatggtgggctatacatagcaaggggacatgagagctttcctgactcacatggattgttggggttagaattagggtcccttatcaatttccctcagagccagaacccagaggacacaggacagcttagtcattcctgaagccatgtgcttcatctagaaattattttaggctatccaaactagtgtttaaactggctgcaactggcctcttaagtactctcactaaccaatcaggagctcagggcattgggaggctggtatgcagaaagagaagacatgactaatttagtacacattagaatatcatattcaaaagataattatttctttaaatcaggggcagtggtaagtaagccttgtccagttcaacatacacccaagccagtggttatctttaggaggagtgagacacagtgcagttactcaaagctatggtttgttcaaggctcactgagccccctgccctctccaggaagtggtgtctggccacagccttgtttccagtcacactgttctcaggccctcaccgcctgccacaagcagctctgatcgtgggtgtcccacccttaatcagagtgtgaagaaaaacctctccttgttctgaagagctggtttctcagcaagcaatgggagcgtttctctcaagaattacttttaaaaacagcagaaaatacagtctgaagtttgtaaatttataataacacagaaaagttatcagcttttgtaaaaagtaaagcagaggttcctcttcgaagactttcctccccatttaattaggaataaatagtaacttctcttagaagtgaaatttattcaaagacctgtgctaacattcttaaatatctgctagccgtgataaagaaatcaatgtactttatgttcttagctcccacaatttagcctaaatatttgccctggcatgcttatactggtgcaagcaagcattgggtcatagcctgttcctcttccttatttgcaggtttttacttttctcagcattccacaagttacttcctccttcttttgttctcctctgcctttgccttttttaagaagttctaagttgctagccaatcgggacagatacagaatgcgaggtcccgttccagccaatggaaaccggacacagcagtagggtggacacgtcagcttataaatgaccctgtctcctttgttcagtgtactcttgtggcaaaactgctggcgagtgtaccctttctgcaggaagtaaaaatggccttgctgagtaaattaaatttatgttcaagtggtatttctttatggtaccggggaacaagcatttcaaacgcttttaagaaaagactaatgacaaaacagaaatggacttggtgagttgaaaaacacatacacaaactcaaagggcattttcttattagtttgcatttccttgtgcatccagtgaaccaactccccaggagttggatccatctctaaattccgctagtaacttcaccttcagtaaccgattgcagcacagctgctgctccaaactgtgggtgaccacccaggaattaaaggttcctcatctcccaaccctttcatcctttgtcttaccaaaccacatgtttccatgaacctgaaccagggccattccagcaaaccccacttcattgacactgagaaagagtagagacaggcttggcttcagctcacctccactagagcactcccactgatcacaaaacccacaccactacctcaaatgctaatagttcttaaagaattccaggaattggccttatgagataactaagattgcctcaggaaggaatgctgaacaattgatttacagccttgttgccacaggccacgccaccaggtggcccattactcaagataaccatagcaaccagatctgctgacctgctttgctcagcccagcctgcatacccttcccctgttaccagttcctgcactttgcctaataagaaagccctatgactcttttcagaaggaagcccgggaattctctctctcttgtgctgcctcccttttgtttgggcataagctccagtgaagctttgtctatgaaagcgcttttggcctcatatcaatttctattgcattgagagtccaagaacccatgatcggtaacaatgccaattgagggtagaaaaaagaaaaaaaatcacacacaaacccaaagtgctttttctattctctcattcaacaagagtctaaacagatgacctctgtgaccaaatgtgtggggatttctcccaatgaacaagcaagcaagcaattcagtggacaccagctgtgtgtcctctaattcagttctattctgacactatctacctggagatagcgtcagatcccacaggttgaaggctgagtccccaagacttcttcctaccttcagatgccagtggcaagccccaggttgtttcacctgtgcttctgaccgacaggctataaatcaaagatcccacagcccctctttgggtccaattaatttgctagagcagctcacagaattcagggaaatacgtttaccgatttattataaagtatattacaaaggatacagttgaagagatgcatacagtgaggtgtgggagaagagagggacgtggagcttccatgccctcctgggcgtgtcaccctccaggaacctccacatgtacagctatccagaagctccttgaaccctgtcattttggggttttatggggacttccttacacagccatgattgattaaagcactggctactgttgattaccttaaccttcagcccctctcccctctctggagggttgggagtagggctaaatgttccaaccttgtcatcctgccttggtctttcctatgaccagccccatcctgaagctacctaggagctgccagaccgcagtcacctcattagcatacaaaaagacatcactttggagtttttgaggattttaggggttgtatgccagacaacagacgaaagaccaaatatatatttcatagtatccagtccaccctctgtcttggatccctcacatcaaaaggatgtacaactcaaaagataccgccaaattactagaatctcattcaatcagtaataatcagtccagcccatcatattgtatgaatgtctcccaaggcgaggccactcaggtttgcaggcttccattcagtcttgtcagagtgctctcggcaaacatatagcttcaccctttacagcagctggtataattaagctaggagacagatatcatttcttgctctaagcctctttcaaggtattaatataatactgggtttctttcatttcataacccatttattctttactctcactactatttttccttatctctataaactcccaaacttttccacctttggatgggacaatagaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagccccactcatgttgaatgtgagcacacacttgcgaaggcaaataaggcagctcttcgtgctttcatctccctctgttttagacaaccagtgttttcattgcctgttccactctctatcaaaccgttactctgaggaagatatctctctgcccattgctgaacattataggctatataatgtgttcctgggtctgaagaagtgacagccatccaaatctgtgcaatatcttctgctctagcttttatggcactctgagcaaactattattctgagaagaatatctctgcccactgctggaacattatgggctgtaccgtgtgttctttggcctgaagaaatggtgttcagctctccaaatatgtgcaatatcttctgttctggcttttttatggtattctcatcattcacatcttccaccgggcaagcaaagcccagtccagaatcagtgtctactcctgtcaaaacccatttgtggcctcccagggctaccagcatcagcctcacttgccagcttgttcagggctttcccaccagggaaatctgccccacagccatgggcaatgtctgtctcttttgctggcagacagaacagtttttattggcattttgtgcctaagatggtgcaaaagaaacatgtctaaatgcagcctatctctgcactgttgcagtacccgtttatccactcatttcacagacccaggtggccacttcaagggagcacccagggttgtctgcttgtgatatcaatcactttctgaaccaggatcttttttttttttttttcaagtcagagttttgctcttgtctcctgggctggagtgcaatggcgcaatctcggctcgctgcaacctccgcctcctgagttcaagtgattctcttgcctcagcctcccaagtagctgggattacaggtgcgcaccaccatgcccagctaattattttgtatttttagtagagacggggtttcgccatgtcggccagggtggtctcaaactcctgacctcaggtgatccacccaccttggcctcccaaagcgctgggattacaggcatgagccaccacgtccagccaagaaaggagctcttctgatgggcattgacatgttctactttaatgcactcctcaaatttccatagggccattctccatatgggcatccctttaataaataggccaggtttccactgcccttctgcctgaccatgtggccaggccactgagtcagtaaaaaaatcaaacacaggggtttttgctattgttcatttctgcagaatgcaattcagccaccaagctaatttggtcttaccttctttgatcaagagtggcatccttccaaacaagattgttcaccttggaactgtcatttacacaccaagcaactctttgttggtcagttgagagctgtttacggggccctgtccaagtctcagtagaatcccgcagttcctcacacagttccagagtcagtcctaggggaaaagaggctccctgcatgagagtatttcctctttgcacttcccagggaggatgctcctgtataaaccatttccattttattatggaagtgttctgggcactgccatccccatttgaatgtttctctgacatcatgtgagaaagcatgggtatttcaggtgtcaagatcattttatgtccttcagtcataggggttaacttcagttaatgtcccatagcaaggtagtaaatacccccaagtggaaattctctactgcaaagtcccagtagttgtcactgggagatgctcacagacttctgagtaagccccagtaaacgctgacaaaggggtagcaaatggagaatttgtccctatgatattccagcttctattctacagattgtgggcttgggtaatcttactggtttgccatttagcatgttcaattaatattgctacaagggtgttttacaatacaaggtaagagaaacattccccagtcagacacaatatccccataatacagtcaagtgaaagagatacaaccacttcatgtaaagtgtgttcaaatgtaccaacttaccttaattttctcaatgcttactttcctaactgtagcctctattacgactttaccaacaggttttgagtttacagtactaggtaggggaagtgttccccacccagacataatatccagttccatcaaacattcaggtaaaggagacataacttctttacataaagcctgtttataaacattctaaatctcgtattcctaccaacccttactttctgtcccagtcccagaatttctcttcttcactcccagaccattttaccattttctccttagaaaaaagctttgaatccccagcagagggttgagccaagggaccttagcccttttgtcaatctttgtcttgattaacctgcctcaacactgctccaagtaattgttggtcagctttctcattgtaatctcttcctctcattttttcaatttctcctaactgggataaatacaccaaacctgtttggatcctcttaccgttaggagaacagcagaatctccctaccaaccttctatagtgatgacctttgttttaaccccatcgatttccactttattcatcccattttttaatagccctctaaagactctaccctgcttagatgagtcccatgactctcctttctttttcctcttagtttcaccccatcaatgttttcttcattcaccttatttctcaataaccatttagactttccaccttcctgggatgagtcctgtgactctcccctctgcctttccccagtctcttgttaattacgctcatgttttcattggtgcccatacaaaagaggctcccttagccatagcatttactacagccagagtaatggatgtattcagtgagtgaatatctcagtcatcataaagccagtcccacatggtctacataggaagcaaatgagctgctgcttcagggtacaccacttggcatttataggtgaaattggacagtccccttctcagggtaaacaggtccagtccaccacgctggccattcccttggaaataacctcctgtgtgtctggaaatctacctttccatctgtgattgttcaataatgaactgcaggtcctacctcaaccaaacatgctcttccactcttgagcatttaaaaccaaagaaactgctctgacagttccttcacagtataccctccagtttcaatagtttatcagttttaccctttccccacattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagggctattatttaaactataaattaaattccttcccaaggctagtttggcctatgcccagtaatggacaaggacagtttagaggttagaagcaagatggagttggttaggtctgatatttttcactgtcataatttccttagttacagttttgcaaaggcagtttcaatcgtaaaggtacttcagtgtccttgcataatttttccttgggggtcagctttgaggctagtggcctgggctcagacagacaaagtctaacctagcattctcctttaatttcatttagctattagagataaacaccaaagaatttagtatttcactttttcatattagtctgcataccctcatgcaaccagtgaaccaactccccgggagttgcatccatctctgaattccaccagtaacttttacctttagtagctgattgcagcacagctgcagctcaaaacagtgggaaaccacatggccacccaggaatcaaagattcctcatctcccacctttttgacgcaggatttttcttggccactttgccaatcagggacctccatggccagcaacgcccccctacctggcctttgcttggccatgggcctgctgaggcgtcaggcccactcaccccacctgtgctatggcttgtacctgcgttcagcagttcccaagctcctgtccttatccacgaagaatgaggatacgctgacaatttgaagggtgaggatgggtagggaagaattttattgagcagcagaacagctttcagcagagaggggacacgggtggcccccccacccctgcagtcgggtggtttgtctctctcagtgtggctgggtccatggtattttatggattcagaatggggcatgtgtgctgattggtttgtgagtatgcagaaaaggttaaagcgaagacaccactcaaaggtgggcacaacagtgtagaaaaccaattagggaagggtaggtatatgtaaaataggtgaggggcggggatcaatcagaggaaagcacaccaaacaggaagacaggttctcaatccagtccatggatttacccgggacatgtaggtaggctttaaactgtcttcagcttgaaggtcaatttcactgaggactcgcccctatctgtctaggcattttgtctgcctcctgctgctgtcactttcattctttctcttcccaaaccacatgtttctgtgagccaagtccattctagcaaaccctacctcactgaaaccaattcatagtttggaaggaaaacaaaactcacaaagtacttttctactctttcaacaacaattaacacagatgatttctgtgaccaaatgtgtggggatttctccccaaccaacaagcaagcaagcaattctgcagttgacaccagctaggtgtcctctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctcacagaactcagggaaccagttacatatacccgtttattataaaggatacagatgaaaagatgcataatcctggggcacggagctttcctgtcctctctggacagaggcaccaccatctgggaaactccacaagttcagctatccagaaactctccgaacactgtccttttgcggttttatggaggcttcattatgtaggcatgattggttaaacgattggccattggagattaatttaaccttcagcccctctcccctccttggaggttggggatggggcttaatgtcccaaccctctaatcctgcctagtctttcaaggctaccagcctcatcctgaaactacctaagggttccagccatcagtcaaccattagcatacaaaaagacatcattctggagtttctaaggattttagcagttgtatgcctggaaagagggttgaagaccaaatatatattttatagtatcacagacctgatcatcaaagtttcactatccttcagctttggcttttggcttttcatataagcttgagtgtgctggctaaacattgtcttttaggaatgcacagcatagaaactctagcgacttcagtggcagtcataagaactggaatcatttcaggggtggtagttgaaaagcagacaggaaattagcaggtttagaataggggagaaactttagcattgaattacgtgaggcaaaaatatatttgagggacaaattttgaattttgacatcttcaaatcagtcaaacttggttcatattatgcttcagaactaaccattcttttctgtagattctttaaaaagccaaaagtagataaagatttctatgaataaagcagttgaggatagaattccaaaaataatgctgttccattgtatcaccccaggtacaaaacacacacacacacacacacacacacacacacacacacacacacacacacaaaatctataccctgggaaacagtgacttggattgcagtgagatttagcgaatttaaaaggcatcatatatcagtgcccagaattctccacttcactgtctctttctagggccaaggtttcctggccattttattaccaatcacttcttttgaatttctagatacaattgtcttaaggtgaagtcccctgctccatgtaacttcctgtccttaatcaaggggaaaaaaagagatagatgtcaagggaagagaaagaagaattgaatatctcatgtcttccctcctatacccattagtgtctgtattcattttctcttaagcgccccaagcatgaaagtcacaggtttctctgagaaccacatttagaaaattaataataataagtgacagccactgatctgcttttatatatatattcatataattttagaaatatctctgagatagattctattattactgtcactttctagatgatggatgtgggtccacagaggataacttgcctacagtgataaaactgctctattataaggtctagatttgaacccagatagtctgactttagagcccacattctttactgttttatatggactctcataatatatgataatactcaatagaatctagtttattgctttaaataaggagaccagctatccccaatgaccaaaaatatatctcatttatgtacttgtttccaattttcaatctcgagatttattaactcctgccaactctccactgtaaaggtaccctgttttcattgtaattgataagtaatctgaaggtgatattttaagactctatgagtatactgtgtttccctttcacccactggattttgacattcttcgatgattctcttcttgcctaaatcagctgtttccttggtggtggcatcttggtaatcttttggtgaatggatatattagatttgaagtagtccttttaagacatcttttggtgagtggatgtattacatttgaagtagtccttttaagacatcactctaaacaagtcttgttgttttatattatttctcaaacagcactgtatgtggcatagtttctaatattttcatgttgcctcttcttccctttcctctatcaaaagccagcctaaaaatgtatggttttaataaacctacaaataaagtattgaacttggaagtataagttctctagagttccagaaatatctggagaaaaaaaaaactggaaagaagaaacctgcgttaaattttataataacactgaaaaaagtctttaagagggtcacttttttaatagtgccttggccagcagagggtaatatattaccagccctagttaaaccacttttgctgacgcataaactgcccacattgcactattttccagctagaaacataaagcaatagaaaagtttggggattttttgaagctctaatacaacaataaatttcttttagtagctgaaaaccactttacacatgatagaaaaaaagtaattgtatagacaatggatttctgtccttaagatgaaagcccggtgccactcatctgcccttaatagggtatgtcctttagggatagtttttgttttgttttgtactagtgattatcacaagagttacttttgtaaagtattcacaactacagttatcctagtggtagaaagaaagtcttacatttcagtatgtgaaagtttttattactgtatcttttagtttttctttaactttttttaatcatagaaattgatggacatagttttaaaagtcaaataacactgaaaagcttgtaataaaaacatgttatgtctattaataaatgtaatttaaagtattttcacctaatgaagacagtataggagaaatcacctctatcctcgactatagtcacttcctcctgtcagtgtaacaacttacgctacatatcccttccacttaagtggtaattttttttttttttttttttttgagatggagtctcgctctgtcgccaggctggactgcagtggcgcgatctcggctcactgcaacctccaactccctggttcaagagattatcctgccttagcctcccgagtagctgggattacaggcacgcgccaccacgcccagctaatttttgtatttttagtagagacaggatttcaccatattggccaggatggtctcgatctcctgacttcgtgatccaccaacctcagcctcccaaagtgaagagatagcttataataaccattccctctttattcagctctcttcatcagggggagcatgtacttgtttttatctcctagaacaagtggtttgttactaaatcttcagcagctccactactccctgcccttcattggtttggaaggtacattctgtctctctctctttctctctctcgctctctcatgcacacacacaaagctttcaagtaaaataactcaaggcattgtcttttttgttaaattactatatttattgtcatctttttagaaatcagtgctacacatattcttcatttatattttttatgcatcatttatctattgctgcatacttaactacccctagacttggtggcttaacacaagaaccatttattcactctcaattctgcaatttgttctagactcagctgggtagttctgtttgtctcacctggtggtcattcatgcagcttagtcatctgtcagctcagctgaggctagctggttcaacatggcctcactcacgtgtctggagcatcacctggaagagttgagcaggctgtgcccctctctccatgtgatctttcatcctgggcttctttacaatgtgatggtctcaggttccaagagggcaaaactggaagctgcaaggtctcttaaggccttattcaaatgtcatacaatgtctaccacattttattggtcaaagcaagtcttaatacctgcccagattcaactgggaaagtagactccacctctggatgagaagagtggccaggaattgggggcaatttttaatctaacacatttccttggatgtgctttcaactttaatgttctaactagacttgttatattttctccttgaaatgcagtgaattggctctttctttagggattactatagtatgtgtatctcagagttcgtagtttcctgggtaatattcctaaaagaaaaggaaattttgctttgtgagagatacccaccctgtcccactttggtcttggagctgtcatgttgttttggttgtttcttgtattaaaaggtatattcagtgtgccatgaatccagctgggtacagtggcacttgcctgtggtccctactacgtgggagactgaggcaggaaaatcgcttgagcccaggagtttgaggctacagtgaactatgatcgtgccactgcactccagcctaggtgacagagtgggactgtgtctctaaaaaaaagtatatgtgtatatgtatatataatatgccatgaatccatgatgtttcctttgtgctttttatcttctataaatcctctccctttaccttctctttccagaatattaatctaacttttcaataaaaccagaagaaaagtctgttgctcttgcttcccaatagctagtttgatcctgagagctggataagttcattgacatcttcaataccagagcttaaaaggatgtagaaagatgattagtctagcatggtggggtagctttccctcctaccatgcttattccctcctaccattattcaaggtttcattattttcaggatcataaatgtcaaactactgggccatgagacttgcattcacttacttagctgcatcctctccctacttgccacatctttttggaaccctgtaatcagtccccacaagagctgaccctgtgtgttcctgtgtttttcaagtttcactagccacaaaggggaactgaatatgaacatgcatgcaaacctcaccagttccctttgcagccagctgaaagttatttttcatgtagaggaaacagtgtttttcttttgagaacaaactgaatttccacacaaatatgaagtgtttcatcttctgacagttcagaggacccaagagaagagggcaccaaattgtgagaaaggccattaaaagagaaactaggaaaacaaagagacaaactgaattggggaagagagaggtgctgctgagtacaggaaaggaaaaaagcagaccacggggaggggtgccggggtgctagaaagtctcaataagtaatggcacacaggacaaggcaggaaatgtaggaaggaactgtctgcaaagggcctataatagctatgccagcagtattaatggaaggcattaagaacttttggtttagaaatttgctgttggacaaaatttcaaaatataccacatttacgtgattactgggcctgcctgagttcatgctatggagccaggtttagatgaaggtgccttgtcctcacttcagaatgcaatatggtgacctgtttggtgtctctgattagacggagaaaaaccaagaatcagatatgtattaacatctcttctaattttttttttttagaagatctctgtcacccaggcttgagtgcagtaacatgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgcaaattaaaaccacaatgagataccatttcatacctaccagattggcaaaaattagtaaatctgataaaaccaagtgttggtaaggttgtgggtaaacaggaactcatttctgccttgtagtgagatgggcatataaattggtaaaatcactttggaaagcaatttgtcaaaactgagataagctgaaaatgtacatacccttacaaccaagcatttctgcttttaggtgttagccataaacttcacacatgggcattgggtatacaaaagaattcacttgagcatggtttcaattagtggaaaaagtggaaaccaccaaattgcccattgttaggggaaatggagaaatgaaccattgtttattcatgcagtaaaacactacatcagtgaaaatgaatgaacaagacctacatgagtctacatagataaacaaaatttgagtgaaaagagttacaaagaatgtaatagtaagataccatttgtgtaaatttttaaaagaaaaagtgcatattgttatgcatatgtatgttgtaaaagcacaaaaatatacgtcagagtgatatacaccaacttcaggaaagaggtttcctcagggaaggatgtgaagtgagctttaatatatctaacattttggatgatgtatacgggtatgaaaaaacttttaagtaaaacgaaaatgttaacatcttttcaattggggtgatgggtacttagctgcctgttatgttgtgtttttccatttttgtatgtttgaaacgttttataactaaaaactatttatatgtgaaattaccaaaaaagaatataagtgtaacagttaactgttgctcccaaaaaacttgcatgacttattaaagcaaaaagagattccatgtatcatcaacacctgtatccaaaccataattagaaggcctttccatcttctgatggttctttatgcatttcatgggccagaagcaaaactaataagggtaggatgctctaatttgattccattttttttcttctattcaacctgtatgagtttgttctggattatcgtacatgtttcagagagagcttccagagtatataaatgtgtgatggttagaagactagttttaaagattgttttttgtttttgtttttgtttttgttttgagacagagtctcactctttcatcaggctggagtgcagtggtgcaatctcagctcactgcaacctccacctgccaggttcaagcgattctcctgcctcagcctcccgagtagctgggactacaggtgcgtgccaccacacccagctaatttttgtatttttagtagagacggggtttcaccatgttggccaggatggtgtcgatctcttgacctcgtgatctgcccgccttggcctcccaaagtgctggaattacaggcgtgagccaccacgcctggcaaagattttgtttctttggcatcacacaattatgatgagtggtaagcagaaatttttgcccccaatacatattaatggcaatttatgtttttttattttattgtaatttatttatttatttatgtttttgagacgaagttttgctcttgttgcccaggctggagtacaatgacacaatctcagctcaccacaacctccgcctcccgggttcaagcgattctcctgcctcagcctcccgagtagctgggattacaggcatgcgccaccacgcctggctaattttgtatttttagtagagacggggtttctccatgttggtcaggctcgtcttgaactcctgacctcaggtgatccacccaccttggcctcccaaagtgctgggattacaggcgtgagccaccgtgcccggcaaagattttgttttttttgacatcatacaattttgatgagtggtaagcagaaatttttacccccaatacatattaatggcaatttatgttttttaaaataaaagacatctcagcaatcaccattgtgcttggacagaactaaacaaaagtgaaaagcattagcagagacaatgtcagtagaatggaagtctaccaacttgcatccctacatatgtaaaatacagttgctgcttacatcacaatgccatgaagattaactgatgataatgcatgggaagcacctagaacagtgaagggcacataaataaacaaatgttactttgcttcccattcccttgcatgtgaacttgaagtggggaaataaaaggaaaaatagaagtttcgaacaaacttactacctcctttccagttctgtgctcactgttaccatccccaaccagctctccaagtcttcatctgaaaacatggactgactgaggcactatggcagccactcagctgggccatgtagctatgacagaggacactacatcatccaacatgggaatgccgcatagtttatctctcgtctgagttgacataattcagattatattccgagtttcaaatcttttcttccgattaaaaatacccctacaagcctctttacaagtgaagtttgtttgttggtggctgaaataaaaggctctccagtaaatgtcatatctgttgtgaatatttttcctgctttgtacttttgcttcagtttttatggtttgggacaaagaatctaaatttttaagtcaaatctatgaatttttccctatagttatttctattattttgtttgaaagttctttcccatctacagatgaactagtcattttttaatcttttatggtctcattatttacacttaattcttgagtgtccttataaattttggggtatgataaaaggtaaggctgtaaattggccttttattttaaataggcacagcactattatttattaatccatcccttccttcctgatgctttttgtgatgtttcctatatatgcagtgattttctctgagggaggagaatgtatgggggtcacctgagctttgcaaaaacacacttaaccccacctttgcaagattccagcacatcttgactaacaggaaccttttttttttttttttttttttttgagacggagtctcactctgtcgcccaggttggagtgcagtggtgcaatctcagtggggcatggtggctcaatgcctgtaatcccagcactttggaaggcaaaggcgggcggatcacctgaggtcaggagttccagaccagcctggccaacatggcaaaaccctgtctccactaaaaatacaaaaattagccaggcatggtggcacgcacctgtaatcccagctactccaaaggctgaggcagaagaattgcttgaacccaggaggcagaggttgcagtgagccaagattgcaccactgcactccagcctgggtgacagagtgagaccctgtctcaaaaaaaaaaaaaaaaaagtcatatacgtattttgtacttttctcatatatcatctaggatctgcttagacatgtgtattcagttccacagataagtttatccttgtgtctgctccccagtgttatccttactgaaggataagaatatattttaatatctgataaagtattatattttgaaaacctaaaaaataattagcccattaacatgttgctgcagcatccaggttgcttgttgggagaactctcttcatattgcttttcttttgtgggataactttcagtaagtctttcgttcaaatagttatattacctctacttttatgtcagcaggaataaagaatccattttttaaagttgaaaataaaactgtactggaagaggattgtctttttctactgacctaatcttagaaattcaaccaccatcaaacctggctctatacagcatacttttctaaaactaacagcaatattcaacactgaggtctcactctgacagccagacaattcattttgcccatatttggttttgcatgtatgagatgttatttagaaagctgttctgaaggtctttgcaaggtaaagatacgtatatacttctgaatttccttttcctgtatgcttctagaactaaaccttgggttaggagaggtaggaactgtttcctgcttgcaaatactaatgcttagtaagaaatgaaagattatatgtcataagtagccttaactttggtaagacagtagcatattttttctaaaaatttagaaaccttctcaggattcaagttactctaaggcatgttatcagatttctctcagtaagcaatctgttataaatagacagattgatttatatcaaaatgtattttattccaaataatatagcaataattaattgagtatactttaaaattttcttaagaatgccattgtgcagagctttatagtaatcatctagtataatgagacagcttctagaactatgagtgtatttatattcattttaatgtcccttaaaagtgataataattgataatataatttcaccaaactgtatacaatgagatatgtaagatgtttaccagtaatgtaaaataaatttttaagtttgaggacatgaaggaaaatagaagttttcataacttaaaaccatacaaacagaaatgctaaatttcatttagatggtatgtgttaacattgtcagggcaaagtaattaatataattttgtcacctttttctgaccctctaatttttctgcaaatttcagtatttatcctcaaatattacttatttttaaaatatacttttgctttgacttattctttattcagttaattatatttgcgggcacttattgaaatatagttaactggccgggcgcggtggctcatgcctgtaatcccagcactttgggaggccaaggtgggtggatcacttgaggtcaggagttcgagaccagcctggccaacatggtgaaatcccgtctctactaaaaatacaaaacagccggtcatggtggcgggcgcctgtaatcctagctacccgggaggctgaagcaggagaatcacttgaacccgggagacagaggttgcagtgagctaagatcacgccactgtactccaacctgggcaacagagtgagactccatctcaaaaaatatatctatatatagttaactgagcactgtatacaagccaaatctcattaaaataaactcagttctgatcaaaatcttcatggtcattcacattgatttctcagccaatggcctaccttaagttttaagaagtattctgactctaaaaaaattttatacaccatgatagaaactttcagatgagtccttggagtttgtcctaagatgcttttacataaattcagtcaataacattcaggttctgtgtatgaccaaagaactggacaaatgctggccaaactttcaagaatgtttgcctaatgacaccccctagattgcaactgtatggtgttctatacagctatattcaaatggactaggaaaaaagctaattactcccaactttttttcttgtaagcaccccttccttccctttctccctatcttattcatccgtccattcttcttaattattcaataaatgtgtattgatctcctatagccaagaaacatactaagctccagggaggcaatgacgaacaagactaagaccgctttcttttagagcttgctgtcctgttattttttaatgtacatgaaaattgcagagtttgctccttttaattctaatttgcaggtttttattgttgtaaagtatttcaaatacccaggagtttaccaaaaataatataatcacgtgcctactacctagatttaagacattaacattttgccatatttgcttcaaatttctccagatataaccattaagttggtatgtatcttgtatatattatcatacatgttttgtatctttattttatatgtattgatccataagaatgtggtattgttttctaccaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaatgtggtattgttttatgtttttatattttacataaatgatttcatgcagtacatacccttttgcaattttgtggggttttttttactcaacattatatttgagatatacccatgttgatgcatgtgagtgtagttcatttcattgcatcgctacatgatattccatttcgtgagtaaaccagttcacttctccatgcctttgctgttatgtccttatttccagttgtttcgtattatgaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggttttgtgaacaatttctttccagtagcaagatgatacatttagctgtgaagaaatgtagatgaatcgaaaggcatgatagggaacaaaacatatagtaaaaatgataagtacaataaaggagttacgagctgtagtggcatatttaccagaattaggaaattttgacctccttttagaaatcctcaatagattcttcccaatcttaatatatgaaaggattattagtaagaaaattagccagaacattaccacaagaatgaagttaaaaatggcttctccttttgcgttatgcttatctctgtaatggaaacacattgtggaattatgccctcctttcttaagtgttaaaataatcatagttaggaatccaccaagagcaagcatccatactatacaacagacataaatactttgtttggttgttattgccttccgttgctgtatagaccgattaatttttatatagcgatccaaactgatgaatccaagcaaaataatgctaatgtacatgttcatataaaacagtgttcccacaaccttgcacagaatcacacctagtgtccacttgttttggttaatatgatacattattcggaaagggaggcagaagatgagtaggaggtctgcaatggctacgttaagtagataaatttgaatggaatttcttttacggtgaatacccagaaatacatagagggcgattatgttcccaaccagtcccacgatgaaaataacagagtaggatgtggttaacacagtagatagcaatttttcatccatgggacaggtagtaacatttggtgttgctgagaagttttgtggcggttggtcgctatgattggttataaagcgcattctgtgggaggagtaaggccagctgctgactgaagttgtcgtcattgttatggtatgacttctcattgtcttctgtggagatcaaaaagtgaaagtgctaaatgacatattcctcatgtgtagttcttatgtcttcagatttttcctacaacggaatgccaaacattgagtcatttgctattttaataacagttactttaactaaaagtgtaaataataggctgggcttcccagcacacgcctatggtcctagctactcgggaggctacagcagaaggattgcttgaacccaggagttcaaggctgtagtgagctataattgagccactgcactccagcctgggcaacagaacaagaccccatctctttaaaaaaaaaaaaaaaaaaaagacagtgtaaataataaatgatttattttcagacattgcgagaaactttacttttatcctactgtatgtagtaacattattgtatcattaaacaagcagcacatagtgtggtatctcatggagtttcatgctctaacctttcctgtggccatggcctacattgaagttctgtttcatgtattatattaaaataactcaatttatgagatcatcttctcttagggaagttcttatgggaatacagatggtggtgaagagaaatgacagctcatatttctcaaagatgagcatcagtttctctaaaggtatgtacagccataagagagctgggcccactgctggccctgcccagcttcagaaccacttcctgccttgactttttccctcatatgtggcattcattcattttgacatgtattgctacatggcgtgtgacttgtggtggtctcattctataagtgggaataaagaagaggatcctaaatttcttttcagcctaagaccaaggtaggggtcttagggcatgcaattaacataatagactaagagaatacagcacctgcaaggttacacagactcttgtatcactggacaggagaaaaaagtaaccaaacaaaaccaagttagctggcagctgccagttagccactcctaacctagaagcatagagtaataacgtagatgggaaacagcatgtgcaatccaagattttgaaagtaacctgaccaaagcttaaatgtgccctgggttcaataatttgagacttgctagaaccttcgaagagatagtgtttgaattctacttgtttgtggcagcagagaatatttgcaaagctacttattattggcccattgactgctgtaaagagcttagtctgagagctggtcataacaagtaaagaaagcatttctggaggtctcatcacattcctctcatagagtgactgccctatttctctacagcagccacttagcagggttaacataaagatgcccagagcaaggttctcaaaatcagacccaactaacttgtgaccaagggcaaataacttaatcttttctatgccttagttttctcatttgtgaaaatgaaaaatgcataagaagaacttaatcctggcacatagtgactgcttaataaaagttagctttaataaacaccttttgattaatctcattttagtaaatatctcacacttggctaagtactgtgtgggaaaggaaggtgaataagacagagaccctattagtaaacattttggaggagtggacattcaaaccctgactgctaccatgcaaagtggatttgaattacataaattaagtccctgatttgatcttatacacagagaaaaatagcctttcttaaagctctacacataatttgattaaaaacaaagcattttggtagagggtaacattaagatttaaaatgttgtaaagttggggagcattgattccacagaagaggaactggctggtgaagaggaagttatgtaatccctggtaagagcctgtttccagaattcaggaaagtggagggagaaaggaagggagcggggaaggactgagtctagtctgtcatgtgtctcaactgcaggaagacaaatttcagaaagtttatagaaaggtataggcatgtttcttgtgatctaagattctggtttttgtttgtttgtttgttttgttttgtttttgagacagagttttgctcttgtcacccaggctagagtgcaatggcgtgatctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaaggaaatcatttttttctaatgaaatgatctctcttgggaggcaatataaggatcttaccactggagatttttgagactaccaccaattgggttctttgtagaagggattatcagtggttctcaatcctggctgcatattagaatcctcttgagggttttttaaagataccagtgcttggctccttccccagatattctgatttaattggtctggaatgggtttcaggcactggtttcctttaaaagctccttaggggattttaatgtgcagtcagaattgaactcttaagctagatggccaaaccattaactaatatttatttagtactttctgtgtaccagacactgtgttaaacacatttatattacttcctttacataattcttgcaatactctgtgaggtaggtatcacaaaagaggtaatgaaagatcaaaaggttggccaggtacagtggctcacgcctgtaatcccaacactttgggagactgaggctggagaatcacttgagaccaggagttcaagaccagcctgccagccaaggcaacatagcatgaacctgtctctaaaataaaaaaaggaagaaagaaagaaagttcaagaggttatgatctttactcttggccacacaactctttttttttttttttttttttttttgagacagagtctcactctgtcacccaggctggagtgcaatggcatggtctcagctcactgcaacctccgcctcccgagttcaagcagttctcctgcctcagcctcccaagtagctgggaccacatccagctaatttttgtatttttagtagagacggagtttcactatgttggccaggctggtcttgaactcctgacctcattttccgcccgcctctgcctcctaaagtgctggggttacaggcgtgagccaccgcacccggcaggccacacaactcttaaatgacagtgcccaagttaggactcagatctgacttttagagcccatgatgcttttcaccaaatctcactccttatcacatagggtcagcattttctttattaatattgagttctatcagcagtattttgacatgattcctttaacatacactttaacaattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctctacaaaaagtataaaaattagcgggtatggtgacgtgcgcctatagtcccagctactcgagaggctaaggtgggaggatcgcttgagcctgggaagcagaggttgcagtgatcctagatcactccactgtactccagcctgggtgacggagtaagaccttgtctcaaaaaaaaagaacataaaaaaaaaaaaaattggccgggagcagtggttcatgcctgtaatcccagcactttgggaggccgaggcaggcaaatcactggagtccaggaattcgagaccagcctggccaacatagcgaaaccctgcctctactaaaaaataccaaaaaaaaaaaaaaaaattagcagggcgtggtggcacgcacctgtagtcccagctactccggaggctgaggctggagaattgcttgaacccgggagacagaggctgcagtgagctgtgttcatgccactgtactctagcctgggcaacagagcgagagtctgtctcaaaaaaaaattttttttttaattaaaaatcacaattacattctgttttaaacttggtgactgtttttttttctcctttgaagttggttagtacattacaatgtcattcactatataaggctatttactgatattttttaaactacctgtttgatatgttaagaattgcttgtgaagacaagaaacaaaccactgtgtttacataggggattaatttcccagtgggcattacttgtgacccatgtgctatattgaagtggtcacaatagttttgtaatagtagatagtgttttttaaatgttgttacttggcaaatcctattcacaagttcaaaaacctagtattagtgcattgtacccccgcaccaccacctactcctgcagttttttttcaactggctcatgtaggagtactggacccagagggcaggacccaacagattccactgtgactccagatgagcagaagcttttaaaatgcagtttgggtatgtttgtgaaaatatcacattgctatgttgaaatacatacctatttggtaatagtcgcaacctttcaccgtttttagtttgacttgataatgactgaatctattcagggcatgcttcaaaattgcattaactgctgtataaaaaatgaaaattgaaaacatattactttggaaataatactattaatagtgtgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagcacaagcactgaatttctgtttcttaagttttcatctgtacattattttagcatattttcatgtattcctttaagacctttgctaaaacaaacttgtattattaggactagatgagatttctgatggtgttctccccttttgatcactatgataaactctcccgagcaaattaaaacatcacctgtattttaagcgaaataatgatgggattctgcagtcttggttttgatcctagtccaaaatttaaccactatctgtccatctatgtaactgctggccctgcagtttagtgttatttccctttttttgttgtcatttgaaatgaagaagttagtttttattctccccataattgttatcctgcagcttgtttgcactaaatatttgactcattgggctgtatctaacattctaattatttctgggtacactcttctgaacattatattctccagagctttttgtttgttataaatatgatttatgggacaggatatttttaaattaatagaataaaaatgttttgtagctcttacttccccttagaacctctgagaaggaaggtggttgctgtattagtcctgcaatattgttgtattggcaggattttattttattgtggtacaatatgtaacattaaatttaccatcttaacttttttttttttttttttttttgagacggagtttcgctcttgttgcccaggcgacaagagattgtacaatggcacaatctcggctcactgcagcctccacctcccaggttcaagcgattctcctgcctcagcctcccaagtagctgggattacagacatgcaccaccatgcccggctaattttgtatttttaatagagacagggttttgccatgttggccaggctagtttcaaactcctgacctcaggtggtccacccacctcagcctcccaaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacaggatttccttcttttatcaaactgcattatattccactgtatatgcaccacattttccctatgcattcatctgttgatggatttttgggttgcttccacctcttgactaatgtgaataatgctgcagtgaacatgagtatgcatatatctcttcaagatcctagcaggaattttttaatgactaaataggcatttaactacgtgcattctatttcatataatctagcatgaatatatttttttctatattattttcctacacctaagacaacccttttcaaaacactaattgttttaatcttcagtttcctcatattgtgaccacattttctcctcaatgtgagtcagcacagctaccaccagatttgagtataatctttttctagttctttctttatataagctttttcctgttcattctgaacattctggtttgtctctgcgttcttagctcattttcgatatgtcctcttcccttcacgcttcctctttctcttgttgggattataaggtatttatattaagatagaagtagaaaagaacaaatgtatacgcttgtttggtgccatctattactgatatcactgttctctttaaatcccaaccctggttaaattcagctcaccacctactccaggcctgaaccttgccatgtaaaatgaggactgctggatacaaacactcaatgatgctgattggtctcacttcaaattcatgactacaaacctcaagtgggcccctgggctgccaacagtcctagtatatttccttagtccagtggttctcaaaacaggggtcccaaacgagttgcgtcaacaccactcagaagcttgttagaaatgtatgttcttagctgggcatggtggcgtacgcctgtagttccagctacttgggaggctgagatgggaggagcacttgagcctgagagtttgagtctagcctgggcaacatagcaaaaccttgtccctaaaaaaaaaaaaaaaaagaaagaaagaaaaggccaggtgtggtggctcacgcctgtaatcccagcatgttgggagaccgaggcgggcagatcacctgagggtcaggagttcgagaccagcctgaccaacatggtgaaaccccatctctactaaaaacacaaaaattagctgggtatggtggcacgcacctgtaatcccagctactcaggaggctgaggcaggagaatcgcttgaacccgggaggcagaggttgcagtgagccaagattgcaccattgcactccagcctgggtgacagagcgagactccgtttcaaataaaaaaagaaaaaaaatgcatgttcctgacttcatcccagacctgtgagccagaaattctggggatggggctcagcagcctgtgtgattctgatgctaaggtttgaggaccactgcttaatcagttcattcttctattccttgaaaatactttttcacacctgtactcttctcagactgccaggaacccctctccttcctcactcccacctggtgatcactttttatttcactgagaaaatagaatcactcagaagagaattttattgtcttccagtgtccacctctgctagtatatacaaatgtctctctaagaaacaaaagccgggcgcagttcttcatgcttgtaatcccagcactttggccagctgaggtgggcagatcccttgagctcaggaattcgagagtagcctgggcaacatggcgaaaacctgtctttaccaaaaactacaaaaattagccgggtgtggtggcacatacctgtagtcccagctactcaggaagctgaggcaagagggtggcttaagccccaggaggtggaggctgcagtaagccatgattgtgccactgcactctagcctgggtgacagtgagaccctgtctcaaaataaataaaataaaaaatttaaaaacctccacaaaaaagctctaggtactactatggaattacctgtagaatatattgttatgtggaaattttgaatatttgtacatattttcttatttttaaaaaactgaaggataaactgaaaactgataaaaatagttaccaatggggaagaaaagattgggagtgggggaagagtgcaaaagctagacctctctgaatagtatctgttttacagtttgtactttagaacctatgtacatgttttatacaattaaaacaccaaattaaggcaaaatctagttgaaacaaatgaacctcactctattgcaaagtgaaagcataaccacaaggagaattatttttggtaacttttaaaatagggtaggggtttttgttttgtttttacgtaattttagacttatagaaaagttatgagaacaagtacgaggattctagataccttttactcagattctctatgttaacattttttccttcatttgtttaatccttctcaatctctcactcttatccatttatgtatttcctaaaaatagggaattcctttacatagctgcagtacagttatcaaaatcagttaatttatgttgacctaatatcattatgtattctacagaccttgttaaaatttcatcagttgtcctagtaaatatcctttataacaaaaataaaaacaaaccgggcacagtggctcacacctgtaatcccagcactttgggaggatgaggcgggcggatcacttgaggccaggagttcgagaccagcctggccaacatgccaaaacactgtctctaccaaaaatgcaaaaaattagtcaggcatggtggcacgctcctgtaatcctagctacttgggaggctgaggcacgagaatcgcttgaactcgggaggtggaggttgcagtgagcagagatcatgccactgcactccagcctgggtgacaaagtgagaccctgtctcgaaaatatatatatattaaaaacaagatctatctttttagtctcctttaatcactttaacctggaactgtatttgaagaatataggccagttactttctagaatgtccctctttgggtttgcccagggttccttcatgattagatctcgttatgtactttggcaggaataccacagcagtgttgccaagttctcaatgcatcatatcaggaagcacatgctatcaatcagtcccattagaagcagtgttaacttcgctagtttctgctgggtttctcccttgtaaaattactagtttcctgtttgtaattaataagtatgctgtagggagatatttagagatcacataaatatcttaccactcttcaaacttccactcacaagttagcatccttgatgattcttacctgaatcagttacgataatgaaaactgacagattccagcatttcttctacatttaattgattttctacttaaagcttttcctccttccccattcatgtatttgtttatttatttacatcagcatagactcatggattctttacccagtagtaaaatgctattttgaccgggcatacctagtgggatatatcttaaggacaaaaagaaccacaaaatcttaaacagcattcagtggtgttgttattgataatgtaggtattactattattttaaaactttcacacacacatacacacacattctgaagcacaaagcaaatgagtaattatgttagtatcattaggtaccaagattacagttgacccttgaacaacatggggattggggtactaatccccgcacagttgaaaatccatgcataacttttgactcccccaaaacttaactactcctggaagccttaccaataacatagttgattaacacatattttgtgttatatgcatcaagggagcctcaagtgatcctcaagtgatcctcccacctcgaccttccaaagcactgggatcataggcatgagccaccactcccagccggtttgataattatagaaagaggtttggctttaaaaatgtcaaaatagcaggatgcagtggcacatgcctatagtcccagctactcaggaatctgaggcaggaggtttgcttgaacccaggagttctgggatgtggtgcattatgccaatcaggtgtccacatgaagtttggcatcaatatgatctcccgggaggggggtaccaccaacttgcttaaggaggggtgtgaactggcccaggttgtcagcggagcaggtcaaaactcccgtgctgatcagtagtgggattgtgcctgtgaatagccactgcgctccagcctgggcaacagggcgagactcccacctctgaaaataaattaaaattaaataatgtcaacataacaggaggatcagtttttgtcagcaaagaggcagcagatgagttctcagatgccattcagaaaagtattgaagaggagcaatatctgcctgaacaggctgttaatatggatgaaaagtgccctattctggaaagaaaatgccacagagaacatctattaataaggaacagaagcaagcaccaagatttagggcaggaagggatacactaactctaataagcatagtcctgatataattccaactgcatttgcacaaaacagtagagtcagcctatctgcctcacttgaggtcaggagtttgagatgagcctgggcaacataacgagacactctaaccccccaaaaaatgtttttaattagccaggcatggtggcacacacttgtagtgccagcttctctggagactgaggcaggaggatcgcttgagcccaggagttcaaggctacagtaagctatgattgcaccaactgcactccagcctgggtgacagagtgagaccctgtctcttaaaaaaaaaaaaaaaatttatcaaactgtcttttgccaccattgcattctccagcttttagatccttcattttttttttttttttttttttttttttcctgagacagtctcattctgtcacccaggctggagtgcagtgtcagcctcctgggtttaagcaattttaccgcctcagcctcctgagtagctggaactacaggcacgcgctaccatgctgggctaatttttgtatttttagtagagataaggtttcgccatgctgcccatgctggtctcaaagtcctccactcaagtaatctgcccaccgcagcctcccagagtactgggattataggcatgagccaccacacctgaccccttcaccttctttttgctttaagttgctatttcgctttttctcaaattatgttagaatctataggtatgtcttttttatacccacataaaagctgcattttcaatactacttaaaaaggtatttcacaaaaagtgcaagattttagcacctactggtgttagctgcaggagtagcttcatgaatttcctttcctttttttttttttttttttttacaatggtccttatgttggattcatttatcttgagatggcagccaattgcagttgcagacctcaatctacaatacatatcaagcaattcagctttttctttttttttttaagatggagtctcgctcttatcacccaggctggagtgcagtggtgcaatctcggctcactacaacctccgcctcccaggttcaagcagttctcccacctcagcctactcagtagctgggatttacaggcgcctgccaccatgcccggctaatttttgtgtttttagtaaagatggggtttcaccatgttggccaggctggtctcgaactcctgacctcaggtgatccacctgcctcagcctacctttttcttgtaatgtcatgactttcctctgtttcttaggagcacttctagcatcaccaatggcactttttatggatcctatggtttaaggtattgcactaaacacagtgaaaataatatgagaactgtgagattacttttactgtgatatgcaatttattggagagatgaactgctcaagcaaagataagtagcatcacacaacatattaggtgaatactcgcaagacttgagctcactgcaacagcaacaggagggagctgtgaaattattacagtagtataatatgtactacagttaattttatggttatgatttaatattgcattctttgtatttgttcacatttctcttgactgaatggcaccgtttacagtctgtgtaggtgtaagttttgataaattttaactctttataatagatttgtgtacatttttatagtactaaataataaaatagtatctaaatatgttttatgcatttatgatatagctttttcttaattttttattccagaagtcatccttcacctttttcttaatttttaaaatagttctaggcaacatggttggtccacgagttttttcaaattgttacgaatctccaaaaaaaactttcaatatattttgttgaaaacaatccatgtataagtggacccacacagttcaaacccatgttcaaaagtgaactatacttgccaaatcaaagaattaaagtaaaaatgctataattgaataggaagaaatattagcttgaacttgtggtttatttatttattttttttttttgagaccgagtttcgctcttgttgcccaggctggagtgcaatggcatgatctcggcttaccgcaacctccacctcccaggttcaagcgattctcctgcctcagcctcccaagtagctgggattacaggcttctgccaccacacccagctaattttgtatttttagtagagacggggtttctccatgttggtcaggctggtcttgaactcccgacaggtgatcctcccgcctcggccttccaaattgctgagattacagacgtgagccaccacgcccagcatggtttatttttctcctaaaaatgcattcttttttcagcactgtccactgaaaagccaaagtaataataacccagtaaaaataatatgcctagtacccacatcatggatttatttatatattttattttatttttatttttattattattatttttgagacagagtctcgctttgtcgccaggctggagtgcaatggcgcgatcttggctcactgcaacctccgcctcctgggttcaagcgattctcctgcctcagcctcctgagtagctgggactataggcgcatgccaccacgcccagcaaatttttgtatttttagtagagttagggcttcaccatgttggccaggatggtctcaatctcttgacctcttgatccgcccacctcggcttcccaaagtgctgagattacaggcatgagtcgctgcgtccagccaattttttttttttttttgagacaaggtcttactctgtcacccaggctggagtgcagtggtgcaatctcagctcactgggttcaagtgaagctactgcctcagcctctcgagtagctggaattacaggcatgtgccgccacgcccagctaatttttgtatttttagtagggacaaggttggccgggctggtcttgaactcctgacctcaagttatccacccaccttggcctcccaaagtgctgggattacaggcatgagccaccgcacctggcccacatcatggatttaaatcgttttttgcactaaaaagaaacagggctacttagagaaatggctgattccagatctggggcaagaaatggacatgacaagcctggaacatcatcttgtgactgaaagcaaggaagttatcagacttctggagtcttacaaaaatacagaagaactgacttaaaggggctcccactggcccaaaatgggacaatttgagcacaaaaatttgtaaaggcagcaactgattaaaacacattaaatatataaaaatctgtaagttcataataattaaaaaaaaaacacctcatcagtcacctttggaggttgcctagaaactaacttggtattctggaaataaattataacagctttattcataatatccaaaaactagaaatagcctaaatgtctgtcaacaggagaatggacaaactgatatattcatacaatgcaatacttacggcagtagtaaaaagaaatgaactactgatcacaacaaaatgaatgaatctcagaacatgctgaatgacagaagccttacataaaagaatacatacttacggttttgtgtctatcaagttctaatataggcaaaacaaacctatggtgaaaaaaatatcagagtagtggtttgcactgggggagatggcagcagagattgaatgggaaggggatgagggagggaggtttgtgggataatgaatttttttagggatttgggttacacaaatgtatgcagttcatcaaaactctaatggtacgcttttgtgcatttcacagtatatacattttttaccttaagcataactttattttttttttactttttatagaagttttaagagacagggtcttgctgtcacccacgcaggggtgcagtggcacaactgcagttcactgcaatcttaagctcccaggctccagtgatcctcctacctcaagttactggtcccaagttactgggaccacaggtgcacgccaccaaaactggcttttttttttttttaagtagaggcataattttaaacaaatattaaatttcaatgatatgtgtgctaaggtgtattaaaaagtaagatggatagaaggataaagagatagatatttgataaagcaaatgtaacaatatttaattgtagaatctaggtggctctttacaatataattctttcaattttctatatgtttgatagttttcataacaaaatgttgaagaaaacctccattttggcacctctaattatgggtctaggcatcaacatctgctaacatcattgagtgaaaagttgatggtgaatcttataatgatgggtcaggcagacaacacctgaacccactgctcaatcctgtcactaaaagtaggatagccaggtgctatgttcttcctgttgcaatacaatagatatatcacctatgaagtattagtgcataaaactaaaattgaatctgaatctaatcaagattctagatctaactacaaatttacaggaaatacaggagagtaaaaaacattaaataataccatgtaggtaccattagtcaagtacagattgtgggggatttcacaggaaaaattacctagtatcttaacaaatcaatggcatgaacattggaaaaaaaaaagcataaggaaggggatctgttacagagtaagagacactcacaagacatagtcatcaaatgcaatgtacagaccttggatcctgtctagaaccaaccaaccgtaataagacctttcttctttttttagtctgttctactccttcaagttattggtagagaaaagacatttttgagacaatcaaggaaaactgaatgtggactgagtattagatgatactaaagaagtattgctcattttgttggacttaataatgatattatggttatttttaagtcctgtgttagaaatactgaactattaacaggttaaattacatttatgttaaaatacttctggggaaaaaaagtaaacagttggggatagatgaagcaaaaatgaaagaatgtccttgtttttgggtttttcgtttgtttgtttttgttttatttttgcctggagacgggcaagttgcccatacatcccagcaggccaggggaggagctgaaagaatgtcagtaattgccaaagctgggtgatagatacatggaagtttattaatctattttctccacttgtaaatgttaaaaagaggcatcctcagcttcacactttcttctacatcccatttctccatttttactacagtaagactgtgaaagatatctgtatttactgtcactacatcatctcctcccattctctcctgaacctggtccaatggggatttttgcctccatcgtgccaccaaaaccactcttatcaaggtcaccagtaacttccaaattgccaaatctaatggtcagttctcagttctcattttaaatgacctttgtaacattgatgactactaatcattcctacttgaaaaagtttcttcacttgacttccggataccaaactgattttcctcctgcttcactgtctagaccttgttttctttgctagattttttcttctgacttcagatattggcgtgcaccaggactcaatcctctgactcttctctatgatttcctaagcaatttcattccttaccatggctgtaaatatcatctgtgtactgttgattcccaaatttacacctctaatcccagcttccccttaatgtcatcttataaaatctcaaactcaatacgtatgagaccaaattcttttttttttttttttcatttttctataaaatagagatggggttttgccatgttgcccaggctggtctgaaactcctgggctcaagcaatcttcccgccttggctccccaaagtgctaggattacaggtgtgagccaccgcacccagcctgaaaccaaattcttgatccaccttacaaactcctccctcagtgttccctgtttcagtaaatggcatcttcattttcactcagttgctcagaccagaaaactaattgttataattgacttgtgtctttctctcacgctcatatccagtagcaattcctgtcagctttacctttagaacataaactgaatttgactacttctcatcatctctgcttctgtcactctagtctagtccaagtcaccatcttctcttgcctgtgcaactgcagtagcctcttaattggtctcctttttccctgtttcttcacaatctcctcacacagcagccagagtgatccttttaaaacctaaaactgatgatagtactcccctgttcaaaaccttatggtgatttcccatctcgctcaacataaaacccagagttcggagagcaggccagagcccaggcccggcccagcggcgcccgccaggtagacccaggcgaggccgcgtgccggcgcgaggggagcccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttttaggagcccgtaggtcatcttggagggtcgtctcaagtattgaacaaaagacggaaggtgctgagaaaaaacagcagatggctcgagaatacagagagaaagttgatacggagctaagagatatctgcaatgatgtactgtttcttttggaaaagttcttgatccccagtgcttcacaagcagagagcaaagtcttctctttgaaaatgaaaggagattactaccattacttggcagaggttgccactggtgatgacaagaaagggattgtggatcagtcacaacaagcataccaagaagcttttgaaatcagcaaaaaggaaatgcaaccaacacatcctatcagaccaggtctggcccttaacttctctgtgttctattatgagattctgaactccccagagaaagcctgctctcttgcaaagacagcttttgatgaagccattgctgaacttgatacattaattgaagagtcatacaaagacagcatgctaataatgcaattactgagagacaacttgacattgtggacatcagatacccaaggagacgaagctgaagcaggagaaggaggggaaaattaaccggccttccaacttttgtgtgcctcattctaaaatttacacagtagaccatttgtcatccatgctgtcccacaaagttttttatttacgatttatgacaggtttatgttacttctatttgaatttctatgtttcccatgtggttttcatgtttaatattaggggagtagagccagttaacatttagggagttacctgttttcatcttgaggtggccaatatggggatgtggaatttttatacaagttataaatgtttggcatagtacttttggtacattgtggcttcacaagggccagggtaaaactgcttccctgtccaagcaaagaaaactgcctacatattggtttgtcctggtggggaataaaagggatcattggttccagtcacaggtgtagtaattgtgggtactttaaggtttggagcacttacaaggctgtggtagaaacataccccatggataccacatattaaaccatgtatatctgtggaatactcaatctcaatgtgcacacctttgactacaactgcagaagtgttcctttagacaaagttgtgacccattttactctggataagggcagaaacggttcacattccattatttgtaaagttacctgctgttagctttcattatttttgctacactcattttatttgtatctaaatgttttaggcaacctaagaacaaatgtaaaagtaaagatgcaggaaaaatgaattgcttggtattcattacttcatctgtatcaagcacagcagtaaaacaaaaacccatgtatttaactttttttttttaggttttttgcttttgtgattttttttttgatacttgcctaacatgcatgtgctgtataacaatccaagcataattgttaagaacacatgtattaaattcatgtaagtggaataaaagttttatgaatggacttttcaactactttctctacagcttttcatgtaaattagtcttttggttctgaaacttctctaaaggaaattgtacattttttgaaatttattccttattccctcttggcagctaatgggcttttaccaagtttaaacacaaaatttatcataacaacaaaaatactactaatataactactgtttccatgtcccgtgatcccctctcttcctccccaccctgaaaaaaatgagttccaatttttttgggagaggggagattgattagaaaaaaatgtaatatgttccatttaaaattttggcgtatggcattttctaacttaggaagccacaatgttcttggcccgtcatgacattgggtagcattaactataagttttgtgcttccaaatcactttttggtttttaagaatttcttgatactcttatagtctgccttcaattttgatcctttattctatttgtcaggtgcacaagattaccttccttttttagccttctgtcttgtcaccaaccattcctacttggtggccatgtacttggaaaaaggccgcatgacctttctggctccactcagtgtctaaggcaccctgcttcctttgcttgcatcccacagactatttccctcatcctatttactgcagcaaatctctccttagttgatgagattgtgtttatctccctttaaaaccctgcctatcctgaatggtttgtcattgtctgcctttaaaatccttcctctttcttcctcctctgttctctaaataatgatggggctaagttatacccaaagctcactttacaaaatatttcctcagtactttgcagaaaacaccaaacaaaaatgccattttaaaagaggtatattttttcttttagaatgtaagctcctcaagagcagggacaatgttttctgtatgttctgttgtgcctagtacactgtaaatgctcaataaatattgatgatgggaggcaaaaaaaaaaaaaaaaaaaaaaacacccagagttctcaccacagtttcaaggccctacacctttgatcatccctcagatcacatttcccaccgctctgccccttgctctcatgcctttccagacacactgggcttccttcttcttctccaaacaaccctccttattcctgtgggcctttgtattggctgttcttctcatctggaacttgcttccatgtggcttgctttttcacttcgttctggtctctgttcagatattacccattagagaggccttctctgaccccaactaaaatagcaattccctagtccccatccctataacacctccttaccagcttaattttacttcctaacaagtaatactacctggctttacattctgttaatttgcatttatggctctatttgctttcttaaattcaactctttaggccaggcacagtggctcatgcctgtaatctgggcactttgggaggccaaggtgagaggatcacttgagaccaggagttcaagaccagcctgggcaacatatcaagacccctcatctctttttaaacataaattaatttaacttaattaagttcacattttataacttgtcttaaggattcaagaatgactgaatctacacagaggagaattatataaattcccttgtaacattaacttaagcctaaacatcatcaacatactattaagggcatacagaactttggagttctgatttcagcttctactccttcctaaggtgataacagttacacagccatggccagaagaccctgttggagtctagtttgcacttttttcttctgtatcatgttcattcttttctaggcttgctcacttgctgtgtcccatactggaatcatgctaggggtattgccatcttagtctgttgtcattgttctctctttgaaccaacagaaagttctaactaacagcagtctatcagttgatttcggtagaggtttgcctgctctcccatagactcttcttgctactttgtgtcatgctgtggtttgctcactattcatttctacacttgccttccttctttctctggctctcacatacacacttgtatttcctggctcatctctgtttgtgctagactattggaaaagtctttaaacttctttggacagaaagaataacttccaaagtagaatcctgatgctcccattgggcagagtaaggattcctcccacctgtgtgtcatcatcaaacacaggtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaaccctcattgttatcacaaagcatatgatataaaggagccctggtcaagcaggataccccttggggagaggatgtctttgccctggactaggaatcaggcaagtggttttctttccccttctcctttttcacctcccacccccacagagaggaaaagcagatccagagaagacatgcccaggaagagcgttgaagtccctgggaacaaggcttaattaaaatcattaaatctgacccatccatgtagtactccttggcttaagggtggaatgaataaagcaaagaaaagaggactgggcagggtggagaaagaaagggccatggctatcccctaacaaccaggatacaatggctctgtaggtaaaatcagaggtttcaagaaacattttggaagtgtaaaatatattttttcctaaagaaatctagactgtcactcaaaggaagacaatattgcatagtaaggcaaaaaaaatgtatctgtgtttcttgaacatccatgcttccttagtaattcttagcactgtactctaaccttacaagcaaataatacctaaagaacattggatggaacaggtatgtatttggagaaatcagccagacgtgagaatatgacaaataattcaagcatccagaataatttagaagtttttaatgtgtttctctattatcatgttatctaattttatgtaaactgcattgttcatcttcaatgaatccttatcttcgggtttgttttttgtttgtttgttcgtctgtttttcttttcagccccactgtgttctccttgcctcaaaagaaaactcggcacctgttaaacttggaggctttggggtagctattcaattaggggagtctggacttgtagctggaggtaagactgctttaaaaaaaaaaaattcttcaaaacctggtcacttgcgactggtataaaactttcaagctacatattagcccaacctcagtgtttcatacctcattccaccccaccccaactcccaaaaagcatcatcagatagtttttaatttaataactctgtagtcataactagaatcttagtcccttaagaatagactcttttttctctttgtacctccagtacttaagagactgtacaagattaaaacagtgttcagagaaaataagtttgaggcatagtgccttttaaagttgaactggccaaatgaagtcaaatctaaaatgtgtagattagccacttcctggtttacactgatggctaatttttaatttcatactgtttgcctttttccatttatcaaagaatcctgctcaagccatcagcctgtatattagcaaagaataagcagatgtgaatgcaggctgattttattattagccaaagcaaaacataatttttaaattcccatgtcagaataaaaagaaaaaagttacaaattatataatcttgcacagcacatttcatataactcaattccttatagctagaacatcaagcagtaacaacatagaccatcttcagaaaaatgagccataggtcatagttgtaatttttttttttttctttcagacaatgtcttgctctgtcacccaggctggagcgcacagtggcacgatcatggcacactgcactgcacccttgaccttccaggctcaagtgatcctcccacctcaacctcccaagtagctaggatcataggcgtgtgccaccatacctagcaaactttttttatttttagtagaggcaaggtctcactacattgcccaggctggtctcaaactcctgggcctaagcagtcctcctgcctcagcctcccaaagtgctgggattacaggtgtaagccactgcacccagccaatagttgtattctttaaataattttttcaccacagtgccctctaaaattaaattacattcaaattttcttttagtttcacattcttttccagttaatcatttccaataatatgcaaaactgcaagctgagtatagtttcaaagaatgctaattttttcccctaatttaaaactttctgttagtgattggaagactgaccaaagggtcaggtagtaaagcacagtttaatcatagaatctcaggactccaaagggccttaacttctccagtcttgtaactaatgattgaattcttccataatattcccaagaaaagattgagttctggtattaaacctcagagagcaaagtagtcactacatcccaagacagttcatttcatttttggataactccttaagtattaaaaagctcatctttgcatctttctgtaacttctacccagtcatcctaatcctgacttttgaaaccactctgaacaattttcatccttccgtatgataaccgttcatctgtttgtagacaactaccatgtccccctaggtcttatccaagttaacttccctagggtgatttggccattcttcatataaactggttcaaaatctcttcagtatccacaaagtacagggcctgaactgaacactctaactacaggtagtacagtacagccgatccagtgcacagtagcattgggctatcacttttttgtgttctgggccttaaatttccctcgagttccccaaattgcattagctttttggacaactacatagcactgatggttcatactgatcttgtaatcaagtgaaaatcctaaattattttttaaacaaatgtcactgttaagctaactctctcaattctggtacttatacagatcatttctatgttaagactacgtaattataacaaataatttctgatgattatattaccaaggttaatgggatgaaatgaaatgaatttattttatatgttatatactggccatatataatgactttgtttctgttgctctggatctatatcctgttggtatttagaatgtcatgttcttcgtattttattgtacatcttgactgggggggaaaatagatgcattatgtttacctggacattttctccatattaatctttttctaaagtccatgaacctttcacctaaattgtttatttttaaagctaattttgaactcccccccaccgcccaccgctggtatgtcagtattcaaaatgtatttttctccatgcttctagaattaaaatacttcctgatggtcaaaatattgtcatttcttagcacacctttttttgtattcttgaaataactgaatgttacgttttaaaaaatagaatatgaataaattagagataaattatttctcttagaaaaagcttttctgctgtttaaggtacttttgaaattttggtaattaaggttgggcacggtggctcatgcctctaattccagcactttgggaggctgaggcgggcagattgagcccaggagttcaagaccagcctgggcaacatggcgaaaccccatttctccaaaaagatgcaaaaattagccaggcatggtgacaagagcctgtattcccagctacatgggaggatcgcttgaacccgggaggcagaggctgcagtgagctgagatcgcaccactgccctccagcctgagcaacagagcaagaccctatctcaaaaaaaaaaagaaagaaattccgtcaatcatttaattatttatcaactttaaagcagaaagccattttcctgtcagtttgaaatcccagtccctagtcctccaaatagaaaggaattcatttctttatatgttgcatatagtaaaaatcatttaaacatatttacactccccctacctgaaactcagctatttaggaaacttacttatccagaatacaactagaaacctagaaaataactacaatagcagcaaaattattcctacccttaaaaatccactcatgctcctcacaattgagcatctaaagacactctctaaggctgacttgctcccatgttttaaaaagttgtatagattcgtgttccttcataccttgcacatgctattccttctagttggagtgccttttgttattttatctatctggttaactcctactgttctggaaggctgagctaacaattatctcctctttaaagcaggcttaccttcaccatcccgagttggatagccctattccttctctctatattcccataactatctgggctacatacctccatgtagcattggatgcagggacttacatcaaagactgtgatttgtaagagtaagggggaccatggctgagggtatctaggacctagcaagcacttaggaaattgctattaaatgaaataaactggttgctagtcaggttctagttaatagcagattataaaagcaacaaattaggagaacgcagaactaaagcatagtgagagaaaagaaataaaagcctgacaaaaatatatatgatatatactgagcagacaccaaaacttggaaagcgcaacagcctttcaatatgaaagaaatcaactcttgcatacctctgaagttcctgagggtgctttctgttctacagcctaggtctttaatcagtatctacaatgacaactctgagtcatcaagaaaaggttaaattatgagcagcattctgtgtaaaagaagtcaggaaattgtagaaagccatacaaaattatttaactaaggtgggcactgtgactcacacctgtaatcccagctacttgagaggccaaggcagaaggatcgcttgagcccaggagtttgagactagcctggggaaaatagtgagactctgcaaaaaaattattaaaacaaaaaggattgtgcgcataaagattcaaatcacaatgtatttaaaaatgtagctattcagaacaattctccccctgagattctggtaggaaggttttattgtattatcaaaatatataatatttaaatatttgtccaaaatatctcaaactgccatttaatttagtttgctaatttgtttccttttcttaaaattttgtggtcaaagtcctaaaagtcaagaagaagtatcagcaaaaacaaggatttttaggaagttggtgtatattaaagattaactccagtcctttttaccttctactgatttacatgaaataaaagagccttcctctacattctttctaccatggtttttcccctatcatctgtgagcaaattattgaaccaaacaacaggcatcttcccgaagattgaacactaattctccagaattgggtagtcttcgtctagctaaatggagagaaccttctcaggatggctgggactggccatggtcgctctgattattcccaagttaaggcccccattttgagtggcttggcccaggaagtggtaggagtcaagttgagtttcaaagcatcatccaaactgtcagcaggtacctaactggtaccctggtaccaattgaatgatactggtttcccctactcctgctagctcctgtccatcagaacaaggctaattctccagtggcccctccctgtccaggctattaatgaagtatggaaggcttagttcccatccctgcagcttcttcgtgttacttgaggaagcaaaatggggcaatacagaaataaaagtatttctctagccaggtccttctagtcaatagttttcactgatctatcgtacattttaaatgaaaatattttcactactggaaccctgaacttaagcttttctattatggggggaggaagggaaaccatatgatctgcagcaaaggtacatcctgatacacaagctaagagctcttttatctttctgcatcccaactgagtttcataatcatgaacagaacttgatatattctctctagctgaaccagaagatctctaaggtcttttaaaaccacagttctgagttctagataaagtattgcacaatcttcaaactaaaaattatcttgaactcagtatgatgaaagagagagacagagggaggaagggaggtggctgggcttgcatatatctagaagagctgccaagtctagtgggcagtgccccatcccacagtgatcttcctgccgggtacaagcctttcattccacaatagaagacttcttttgggatactgagttaaagatagttatgaatgtgcaaacagctagtatcagattccttacagaaagctaatttttgatagagaaacaaaagaaaactctttaaagaagatgaaagtcaaagaggattgaatgggaggagcttcataattttgcttttgtttatgccatatatttgctctcattctcttcatatgttaatgttaggaggaagctaaaaactcctactataacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaaccttctttgtgtaatttgagaaaggggcttcatttttaaagccttctgcttaatttgtaaagttaaaatggaatttcatccaggtataattttagtcattctttatcttaattttaaatttaggccagcacagctgaaaacatttgccatttacattccaggataaactgaaatgccaggatgacaactgcatttcatgatacaatatagaggcatttcagtgtggcttaaacattcctattcttctttggctattaggtgttggcagcctcatgtactatcacagacttgtgattagtaaatcattactttaactagtaaaaaattgaaaattcattactgactttatgaatagcgatatcacaaacacctaaggacttcttggaaataagtaagcttaaagttgatttcactaccccagcttttagactcctttgccctgtcccacaaggtacgactgacagtgactaggaggctgggcatgggaagcatggggatgtgtgtgtctgggtatcaggttaaggctgtttaagttggggaaattctttttcctctcattattactgaaactcatactttctattcaacctcatcactgtttcattttcagccatgactgacaacataaaaccaaaaacatgtgtatgtaacactggactctaaaactatgaggcccctaaagttttctcttcaattcctcggtaatgttagaattttatatgggacttggaaaaataaaatttaaaaagaagaaaagtaaagtggttccagagttacagtcttatccttttaagccataactgaagtttatggagatgagaatggtatatacttttgttggtttatttacctcactcaccatcagtttatgagtgcatataagtttgtcttttgttttagttagtttaagatatataccaaaactctgttaacagagaaagatgttttcagtgtagcatattctgctcctcccagagtcagctggccactggggaataaaatcaatacttaccaggtaactaaatgtctcaggaaactgcttgtaagtagtcatccctcttcaatccagggaagttgtaagttgctctcaggaatgcacagccaaattctggttgaatttagccaagtgaaatcacagatactaacgttttaaaagaaacatgattagtgatacatcagcataataataatactagcaataatgatagctaactcaggcatagcacatagcatagcatactttacataagtaaagtgcttagaatagtttaattcatttaaccctcacagcaacttgtgaggtaggtaccatataataataatcccccacctgcgtttttgagttataggcatttgctaataatagaattcttcctttgtgtttgttcagttgttaacttcctagtttccaaggcaatgtgcttcattccaacagactctggtattttatttcgtctatttttaaaacattgaatagttatttttgtttcttggtaaaaagacttagactattcacatatgtgcaaaaattaagtcatttaaaaattccctcttcctagtattatagtaagtcagatggatggtggcagctacatcataatttttttttgtacctggggtttgaagctttgaggttaataatttatttacttttttacttggctaacctcacctctcatttatcttcaggactttccttacaaaaagcctaggttttcaccaccttagtttgaagtatagatccatctctaccatctatgatgaatctcggcctttttcttttagtatactgtcatatgattctgtcagcatttatttttctatcttttattatcaaaaatttcgaacaaaaatagtagagagaatagtataatgagctcccagcttcagtaacacagacaatcttgttttatctgtattcaacatattattacattattttaaagcagatctcagctgggctcacttgagctcaggagctcaagaccagcctgggcaacatagggagacctggtctctacaaagagtacaaaaattagccaagtgtggtggcacacacttgtaatttcagctacttggaaggctgaggtggcaggattacctaagcctgggaggtcaaggctgcaatgagccatgatcacaccactgcacttcagcctgggcagcagagcaagaccctgtcttcccaaaaaaaaaaaaaaaatagatttcaaaaaaattatttcatcaccttggtggttcttttttgagacagagtcttgctctgtcacccaggctggagtgcagtggcacgatcttggctcactgcaacctccccctcccaagttcaggtgattctcgtgactcagcctcccgagtagctgggattacaggcgcatgcaccacgacacccagccaatttttgtatttttagtagagacgggggtttcaccatgttggccaagctggtctcaaactcctggcctcaagtgatccacctgcctcggcctcccaaagtgctggaattacagctgtgagccaccgcacccggccacatttcatcaccctaatggttctgagcaaaagaactattaacaaaattcttgatctctatggatattttaaagaaaagtttgatgacaccttttaaatgcagtactttttttttctttttttacctccagcagttgcaaatgtgagaccacattagaaaatactgtttcactggagtatatgctaacacttaacctcaattaacttctttgtaaagggcaaaaatatatttcccaaaccatatataagaagtgtaatgtcatatcattattacagataaccagttagtatatacacagcaagattctaagctgctatgggtttggtattcaaataagtaagattgttttatagccttattttgttcccccgtatagattcaatctccccaatttgttttagctactcttctcagctgaaggaatagaaaatcctgtgttggactgtcttgtaaaaaggacaagggagtatccttctaaacctctactcatttcagaaatcttaccacccctttcagatgatttctcaaccactttgtcaaggaaaaattattcagactttaaagagcacattcgctccaggatagggagaggaaacaagtctacccaagccctgtctaatcacttacctcatttcaaactggtcagttgaccacaatttcactaggatgaaaagtgtgggatttcatccctcccaaagtgtgggattacaggcatgagccactgtgcccggctggataatgataattaaacagccttatggcattagtcttaatgggatttgacaagcagaagtggctactatttgaaattctgcctgttggggggaaaaatgaagcacacttcaattttaagggctatccccaacataaagacacttttcactccccatcttcaagtacaaagtctcacattagtcagagctaatgctagcccttgctcaaattgtgatgattcatttatactgcagtgcaagtactgcagtttcatttggctttaaaatgttgtggagtttattcttcatctttcttccttagaaggtgatgtaggtctctgcctgttaaagccatggctttgcttgaaggtcctggcactgggtagctcacataaactcaccccatcagtaaacctgttgatattgaacaaggaatgagaccctactctgtctctgtctcctttccccacttgccttcccaaccccatgccctaaccactctgatttttttttaaatgattctgggtctcagacatatcccttttcccaggagccttctagcacttggctcacagatccacagcctttctcataagtcctgtgtcttttgaacaattcataattatttttgtttgattttaatcaatataccatgtggcttagttgtctcatctctaaaagagacaaaagtaacttcactgaggacagtattcaagcaaatctgttattctgtgggacctacggtagtagaatactttttcctaaacaccgaagttgatatgcagtgaccaaaatatcctattaaaaactttgcacagttcacaattattgctaacctcgattttttaaaacatatcttaaaaatatttctttaaaaattttaagttttattttagttctttctggatcgatgtattctagtctccctagctaaggatctaaagatagaaactggaataatgaacattctagtcttcaattattgaaaatattatcacttacataacaagaatatgggtatggaatatttactaacacaaattcttatgtagtaaagaacaacagaagaattgcatttgtccttttcttagaatgcaagcctttagaatcaaatttctgttctttgctctcagaattttattcacattgaagcaatataggaatattaaataatagtgaatgttaatgtctcatttaaggtaactatgtagttttcctttcctcctcctcagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttctgtcttaggaaaacggcaggtttttttttttttttttagacaaggtctgacaacattgcccaggctggagtacagtggcaccatctctactcactgcaacctctgctcctgggctcaatcgatcctcccactttaacctccccagtagctgggagcacaggcatgcagtaccacacctggctaatttttgtattttttgtagagatgggggtttcaccatgtcgcccaggcttgtctcaaactcctggactcgagcgatctgcccgcctcagcttcccaaagtgctgggattacaggcatgagccactgcgcccagccaaaaggcagattttaaaagttcattttatatcccatcttgccagtgagtattaaggaaaattataacttgggacagcagtgaaacagtactttttgattaaaacattatacagcccaataattccaggcaattttcattttagatgttagaaagactaacgcttggagaggttaagaatttgcgccaagttggccgggtgcggtggctcatgcctgtaatctcagcactttgggaggccaaggtgggtggatcacaaggtcaggagtttgagaccagcctggccaatatgatgaaaccccatctctactaaaagtacaaaaattagcctagcgtggtggcgggcgcctgtagccccagctactgaggaggctgaagcaggagaatagcttgaacccgggaggcagaggttgcagtgagccaagatcgtgtcactatactccagcctgggtgacagagcgagtctccgtctcccaaaaaaaaaaaaagaatttgcaccaagtcacagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatctctactaaaaatataaaaattagctgggtgtggtggcaggtgcctgtaatcccagctacttgggaggctgaggcaggagaatcgcttgaacccaggaggcagaggttgcagtgagccaagatcacgccatagcactccagcctgggctacaagagcgaaactctgtctcaaacaaacaaaaaaaaaagaaatataaaagaatatataattcaaaagacactgccacattactagaatctcattcaggcattgataattagttcagtccatcatcataatgtatgaataggtctcccagcatgaggccactcaggtttgcaggctttccattgatcttgccaggttctaaaagcaggaatggtcttggtttcaccgtttcagacacctgatataattgagctaagaaacagtatcctttcttgctctgagtctctttcaaggtgttaatgtaatgtgataatggatttccctgaattcataacacatttatttattcctttactctcagctgttaattttttcctcactttattaataacctttggaagaaacattagaatcaacatcgtgctggtctagatggcagacagcaatattagtctagtaattacctcctcctcagtccactcccatgcagggagactaaggttacataggtgccaatttagtggaccgtttttaccaccaggcaatatagctgcattcacaattaacccgttttgcacaacccacccccatcaggtccttaggaattctgacacaaggtttaaaaacatagttacaatttcttgtttaggaatcatccctggttctaacactggtagttatggctctggtcctagaaccactgcatagggaggggcagggggagtttagatgatatgggaaagaaggaaagaaaaaagtatagtcattatatcagcatactcccctcttgtcaagaattgcatagtcataacagcatcctctaccaccccccttccccagatcaatcagaaaaacgaaagaatatctagtggggacactcctttagccccactcatgttgagtgtgagtacacactggtaaaggcaagtaagccagcccttcctgctttcatctccccctgttttagacaaccaatgttttcattgcccattttagtctctatcaaactattactctgagaagaatatctctgcccactgctggaacattatgggctgtaccgtgtgttctttggcctaaagaaatggtgttcagctctccaaatatgtgcaatatcttctgttctggcttttttatggtattctcatcattcacatcttccaccgggcaagcaaagcccagtccagaatcagtgtctactcctgtcaaaacccatctgtggcctcccagggttaccagcatcagcctcacttgccagcttgttcagggctttcccaccagggaaatctgccccacagccatgggcagtgtctgtctcttttgctggcagacagaacagttcttattggcattttgtgcctgaaatgatacaaaagaaacctgtctagatgcagcccatctctgcactgttgcagtacccgtttatccactcatttgatggacccaggtggccacctcgagggagcacacagggttctctgcttgtcaatgtcaatcattttccaaacccagaaagaggctcttatgatgggcatcaacatattctacttattgcacccctcaaatttccatagggccattctccatatgggcatccctttaataaataggccaggtttccactgcccttctgcctgaccatgtgaccaggccactggtgactgtccatgagtcagtaaaaaaccaaacacgggagcttttgttattgttcatttcttcagaatgcaattcaactgccaagctaatgtgatcttaccttctttgatcaagagtggcatccttccaaacaggatgctgtcgattcaccttggaactgtcatccacacaccaagcagctcttcgttggtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcccatagcaaggtagtaaatgcaccgagatggaaattctctagtgcaaagtcctagtggttgtcactgggagatgctcacagactttggccataagccccagtaaacatcctgcaaagggcgagcagatggagaatttgtccctaccagcactccagcttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatctcatactcctatcaaccctcacttttaccctttcttgtttaaaaaaaaaaaaaaaaaatgttgagtccccaacagcaggttgagccaagggaccttgccccttttgtcagtctttgtattgattaacctgcctcaacattaccccaagtaactgttggtcagctttctcactgtaatctctgccttctgactttttcaatttctccaaactggggtgaatacagcaaacctgtttggaatcccttaacattgggagaacagcagaagctccctaccaacctttgatagtattatattgagatctttgttttaaccccatcgatttccactttattcatctcatttctttttatttcttttttatttttttgagacagagtcttgccctgtcacccaggctggagtgcagtggcgcaatctcagctcactgcaacctccgcctcccaggttcaagccattctcctgcctcagcttcccgagtagctgcgattacaggtgcccgccaccatgcctggctaatttttttgtatttttattagagagggggtttcaccatgtttgccaggatgctctcaaactcctgagctcaggtgatccacccgcctcggcctcccaaagtgctgggattacagatgtgagccacagcatccggccctattcttcccatttcttattagccctctaaagattccaccctgctgggatgagtcccatgattctcctctttcttttttctcttagtttcaccccatcactgttttcttcattcaccttatttattaataaccatttaaactttccaccttcctgggatgagtcctgtgactctcctctctgcctttccccagtcttttgttaattacgctcatgttttcattggtgcccatacaaaagaggctccctcagccatagcatttactacagccagagtaatggatgtattcagtgagtgaatatctcagtcatcataaagccagtcccacatggcctgcataggaaccaaatgagccgcttcacctggggtactccacttggcattgataggtagagttggacagtctctaccttctcagggtgtacagaccttacagtggcttttattccattcactaggctgactgttccctcaggaataactccctgtgtgtctggatcacattatacccattgttgattgttcagtagtgagctgtgggtcctgcatcaacccaaacatgcctgtccactctgcagcatttaaaaccaaagaaagtgccctaaattagttattctcacaatccattttagtaaaggattttcagtaaactgatgataccaatctatgaaatgagacaatttcttcacactgtaccctctggtttcagtagtttcttggttttgcccttccctcacatcaactaccttcgtggtaaccacaggtcgtagaggtactgtcatccctgtataatttttcctttgggggtcagcttgaaggctagtggcctgggctcagatagactgaaatctgagcttggtctagcatcaaggcctcatccagcatttgtttcatttctgttcagctattacagacaaccaccaccaagggagtgaatatttcatctttttcttactagtttgcatatccttatgcatccagtgaaccaactccctgagttggatccatctctaaattccactggtaacttttacctttagcaattgattgcgacacagttgcagctccaaaccatggaagaccacgataatgaaccaggaatcaaaggttcctcatctcccaccctttcattctttctcttcccaaaccacatatttctgtgagccagggccgttctagcaaaccctacttcactgacactaactgaaggtggaaaaactcagaactgttttcctctgctctcgcaccacacaacaacaacaatcaacacacaagacttctttcaccaaatgtgtggggatttctccccattaagaagcaagtaatcagccctgctgctgggtattctctaattcaattctgacactatagtatcacatcccacagtttgagggcttggtccccaaggcctccccttcccaccctttcagacaccagtcacaagtccaggcctccagaatgtcagactgactggctacaaatcagagatcctacacctgctctttgggttccattaatttgttagatcagctcacagaagtcagggaaacacttttaccattgtgttataaagaaaattacaaaggatacagatgaagagatgcattgatggaggtataggggtgaagtgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaaggtgatgacatggaatagtattacaggacaattttgagatttcagtggatcttgattctccttaagaatattacttctcagcctgggcaacatagggaaatcccgtctctacaaaaataaaaattaaaaaattagccaagcgtggtggtgcgcacctgcagtcccagtgactcaggagcctgaggtgggaggactgctacttcaaaaatatgcattcacctctctgatactcagtgctagttattcctgatttcccctagaaaagagtagtgaacaatttttagatactttctttgttttgttttgttttttatttgtttgttttgccctcccagatatataatgaacactttagaggtaattcctatttctcctttacttttctcactttctccataacggggatcttttgttcattcaaagctggtttaaatgccaaataacaatgaaaatggcaggcattttagtcatttttcaaatctcttagaaggtggtttaacattataccatacctacttacagtgctttcaaagcttatcttggctaatagcatatttatttttggaaacctttgttcctgccaatgattatagttctcgttctaagtaatttgagcttaatacataataaatttctagcacaagaaagacaaaaaatgtcagtaacttaaatgaaaaagtttaagacggctctttgagctgagtatcgcatgccatgtctaaacaacagtttaacttcactacttatgtcatctgaagatggaaaaactcaattagaatgttatccagctggtaagagcaggcttatgttatatttcagtatttgtccatgtgtatttataaatcattactgtggatgtaagaggtatttttttagaatggttgaaatttaaatatgaaaaacacctggataccttgcaaattgaagaaataaaatgatactggttgcagtggcttgagcctatagttgtctcagctacttgagaggctgagtaagtaattactgagtaattactctaagtaattagagtaaggtgggaggattacttgagcccaggagtgaaaggctgcagtgagctacgaccatgccactgtactccaacctgggagacagagcaaaaccctgtctccacaaaaagaaaaaaaaaaacaaataagatgaagaaaaactttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatggaaaacaaaaaaaaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacctagattcaaaaagcaggtccttagagacctaaaaagagacttagactcccacacaataataatgggagactttaacaccccactgtcaatatcagacagatcaacgagagaaaaagttaacaaggatatccaggaattgaactcagctctgcaccaagcagacctaatagacatctacagaactctccaccccaaatcaacagaatacacattcttctcagcaccacattgcacattccaaaattgaccacacagttggaagtaaagcactcctcagcaaatgtaaaagaacagaaattataacaaactgtctctcagaccagtgcaatcaaactagaactcaggatgaagaaactcactcaaaactgctcaactacatggaaactgaacatcctgctcctgaatgactactgggtacataacaaaatgaaggcagaaataaagatgttctttgaagccaatgagaacaaagacacaacatactagaatctctgggacacatttaaagcagggtgtagtgggaaatttatagcactaaatgcccacaagagaaagcaagaaagatctaaaattgacaccctaacatcacaattgaaagagaactagagaaacaagagcaaacacaattcaaaagctagcagaaggcaagaaataactaagatcagagcagaactgaaggaaatagagacacaaaaaacccttcaaaaaaataaatgaatccaggagctggttttttgaaaagatcaacaaaattgatacaccgctagcaagactaataagaaaagagagaagaatcaaatagacgcaataaaaaatgataaaggggatatcaccaccaatcccacagaaatacaaactaccatcagagaatactataaacacctctactcaaataaactagaaaatctagaagaaatggataaattcctggacacatacaccctcccaagactaaaccaggaagaagttgaatccctgaatagaccaataacaggctctgaaattgaggcaataattaatagcctaccaagcaaaaaagtccaggaccagatggattcacagcccaattctaccagaggtacaaggaggagctggtaccattccttctgaaactattccaatcaatagaaaaagagggaatcctccctaactcattttatgaggtcagcatcatcctgataccaaagcctggcagagacacaacaaaaaaaaggagaattttagaccaatatctatcgggggacttgccccgataatcacgtaggttcttttctatttttcttaagcgtcggccggcatgataaataaagggacagagtacaaaagagagaaattttaaagctgggcatccaggggagacgtcacacgttggtaggatctgtgatgcctttcgagccacaaaaactagcaagtttttattagggattttcaaaaggggagggagtatgcgaataggtgtgggtgacagacatcaagtacttaacagggtaatagaatattacaaggcaagtggaggcagggcgagatcacaggaccacaggactgaggcgaaattaaaattgctaatgaagtttcaggcactattgtcattgataacatcttatcaggagacagggttttgagatcaactggtctgactaaaatctattaggcgggaatttcctcttcctaataagcctgggagtgctatgggagactggagtctatcttacctctgcaatcttgaccataagagacaggtacgcctcggggtgggcgggggccagttcaaagacttactcctaggtgcgcattctctttctcagggacgttccatgctgagaaaaagaattcagcgatatttctcccatttgcttttgaaagaagagaaatatggctctgttctgcctggctctccagcagtcagagtttaaggttatctctcgtattccttgaacaattgctgttatcctgttcttttttcaaggtgcctacatttcatgttgctcaaacacacatgctgtacaatttgtgcagttaatgcaattattacagggtcctaaggtgacatagccttaggctgacaggattaagagattaaagacaggcataggaaatcacaagggtattgattggggaagtgataagtgtctatgaaatctttacaatttatgtttagagattgcagtaaagacaggcataagaaattacaaaagtattaatttggggaactaataaatgtctataaactcttcacaatccacgtttttctgccatggtttcagccggtccttctgtttggggtctctgacttcctgcaacatctctccctttctttttatataaatgtgccatggcgatgaaggcttgttcgttctctcgattttgacgcaggattctttgactggtccagcacactaaaaacaaaccgattaaacagagaaacttaattctaaaatttactacagtggagcccccaataggcttaatctaagtcgtggggtttaatctataaagattttctgccacctgatctaacgcctcagctccaggcagaatggataagtgagcttgagaggcttcaaaaatttgtttctttaattatgtctaatgataaattatcttctttacctagaaggtgtcctttgactttttcctatgaattatcagtctcattataggaatacggggtgatgcagaaatccgaagtattccaatcgcactgcatttgcaatgcgatgttcgagactcactacttgatctctaagccaaataacagactgtcttaaatcattaatttgatttgccaatttttgatcgatgccttgttgagaattccacatttgggtggaattggcttgccaatcattaacaaaatgagccctttgaatagattggtgtaatgccattctagcagtggtggccattgcagtgacagtaattaggcctatgataacagcaattaaagtgaaaacaaatctcttagatctttttttagaattcgctgtagcacttcattaattaaatgtattgagggggaggatacctaaggtctaggtaaagttaccggaacctagattccttcttgagctcgaaccaacattacacttttcctggagtcaaaatgggagttaatacaagtgtatagatgacaattgatgcatcggacggtttgattattcgtctaaattttgatatttcctactaacagtgtgtaaggaggcttaacacaactctgtatgggaatagtcaggttggaggtaagtaaagcagaatgtctgggtctacgttgatactgagagagtgggatggtaatgggaacaacagtcgaaatagttttcttttcctatactggcagtccagacatggcaatagccaatttttaaagttctgggtgttctgggctcagaatggggagtatcatacgaggcctgggggtgggtaatgcctttatcttcctattttaagagaaagaatgagctgatcctcgtatgcacagtagaatgatgattctcattctcctgataagaagtaaaataagtagcctccaggcattcctttccaccagaggagcaattgttttttaaatagccttttggtgcctagtctattactagaccatatgagtcattttttagtattactgcatgtgagttaacacagtcttcctaaattaaagttttagatgggccctcaaaatttttagggcatggttttcctgcaggtttatattgaaagtatggggtatctcctattactcctcctttcatttgttttaaaggagaaagggagagaccagagactaaatgtcctgttttatctgtagctgatgtttccggaagataagcagcctagacttgagttcgtagatggatgcaactaggtgcatgtccgaggcacagaggggggtatttataacctatggtaacattaaatgcagtgccttcttctcctggttgagcagggcaacggtcatctgtggctctaggcatccacacactatcgttagtgtagatttctgcaggagcatctatctaggtgagaggtcgaataagtggaggaaaaggcacataagcctaataagaataattatgtgtagcaggtaaatcagtgtgagaggaaactggtgagacagaaagtataaggaggagaatcattaaataaaacctagtgtaagcgagattgagtgctgaaggaggaagagaagaacagagggatgttattttcaggctaatagaaatggtgagatttttaggtttgtaaggagaaaaagaaaagtaatcaggagaagtgggattagttagatgggtctccattgccttcagggaggattgatttacacctattgtgatttgatgtgcctgtttctgaggaatcagcacagatctcatcatatctgaaggcagtctctgacacagacgtcttttctctgtggttttgattgtcagtattcacctgaagcttgagtcttctggtgggtacttagacaggggattgatgatctcctggtgaaacacaagcatatcctcttcctcatgttataattgtgccaggttcctaggtattggtttgggagtttttccataacactggcttgccttcgtttaaggaaaattttttgcctgtataatggcattcggctgcagttagagtattatctttaggaacatttaaaaaatttaaagtaaacaatgccaaatgtaattgggagtggggagttgttaaatcatgttttggttgttcagactgttgggacaattgggtttttaaagtgcgattgtaagggattctagtagtaggatctgtgatgcctttcaagccacaaaaactagcaagtttttattaaggattttcaaaagaggaaggagtgtgcgaataggtgtaggtgacagacatcaagtacttaacagggtaatagaatattacaaggcaagtggaggcaaggcgagatcacaggaccacaggactgaggcgaatttaaaattgctaatgaagtttcaggcactattgtcattgataacatcttatcaggagacaaggttttgagatcaactggtctgactaaaatttattaggcaagaatttcctcttcctaatgagcctaagagcctataggagactagagtctatcttacctctgcaatcttgaccataagagacaagtacgcctcaagggggccagttcaaagacttactcctaggtgcgcattctctttctcaaggacgttccatgctgagaaaaagaattcagcgatatttctcccatttgcttttgaaagaagagaaatatggctctgttctgcctggctcaccagcagtcagagtttaaggttatctctcgtattccttgaacaattgctgttatcctgttctttttttgaggtgcctacatttcatattgctcaaacacacatgctgtacaatttgtgcagttaatgcaattattacaaggtcctaaggtgacatacatctttctcggctgacaggattaagagattaaagtaaagacaggcataggaaatcacaaaggtattgattaaagaagtgataagtgtctatgaaatctttacaatttatgtttaaagattgcagtaaagacaggcataagaaattacaaaagtattaatttgaggaactaataaatgtctataaaatcttcataatccacgttcttctgccatagtttcagccagtccttctgtttaaggtctctgacttcctgcaacaaatatccctgatgaacatcaatgcaaaaatcctcaataaaatactggtaaaccgaatacagcagcacatcaaaaagcttatccaccacgatcaagtcagcttcatccctgggatgcaaggctggttcaacatatgcaaatcaataaacataatccatcatataaacagaaccaacaacaaaaaccacatgattacctcaatagatgcagaaaaggcctttgacaaaattcaacagcgcttcatgctaaaaactctcaataaactaggtattgatggaacttatctcaaaatagtaagagctatttatgacaaacccacagccaatatcatactgaatgggcaaaaactggaagcattccctttgaaaactggcacaagacaggaatgccctctctcaccactcctattcaacatagtgttggaagttctggccagggcaatcaggcaagagaaagaaataaaaggtattcgattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaatagagagccaaatcatgagtgaactcccattcacaattgcttcaaagagaataaaatacctaggaatccaacttacaaaggatgtgaaggacctcttcaaggagagctacaaaccactgctcaatgaaataaatgaggacacaaacaaatggaagaatattccatgcttatggataggaagaatcaatatcatgaaaatggccatactgcccaaagtaatttatagattcaatgccatccccatcaagctaccaatgactttcttcacagaattggaaaaactactttaaagttcacatggacccaaaaaagagcccgcattgccaagacaatcaatcctaagcaaaaagaacaaagctggaggcatcacactacctgacttcaaactatactacaaggctacagtaaccaaaacagcatggtactggtaccaaaacagcatggtactcgtaccaaaacagagatatagaccaatggaacagaacagagccctcagaaataataccacacaactacaaccatctgatctttgacaaacctgagaaaaacaagcaatggggaaaggattccctatttaataaatggtgctgggaaaactgggtagccatatgtagaaagctgaaactggatcccttccttacaccttatacaaaaattaattcaagatggattaaagacttaaatgttagacctaaaaccataaaaaccctagaagaaagcctagacagtaccattcaggacataggcatgggcaaggacttcatgactaaaacaccaaaagtaatggcaacaaaatccaaaattgacaaatgggatctaattaagctaaagagcttctgcacagcaaaataaactactgtcagagtgaacaggcaacctacagaatgggagaaaatttttacaatctacccatctgacaaagggctaatatccagaatctacaaagaacttaaacaaatttacaagaaaaaaatcaaacaaccccatcaaaaagtgggtgaaggatatgaacagacacttctcaaaagaagacatttatgcagccaacagacacctgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaaaacttttacactgttggtgggactgtaaactagttcaaccattgtggaagacagtatggcaattcctcaaggatctagaaccagaaataccatttgacccagccgtcccattactgggtatataaccaaaggattataaatcatgctgctataaagacacatgcacacgtctgtttattacagcactattcacaatagcaaagacttggaaccaacccaaatgtccatcattgatagactggattaagaaaatgtggcgcatatacaccatggaatactatgcaaccttaaaaaagggtgagttcatgtcctttgcagggacatggatgaagctggaaaccatcattctcagcaaactatcagaaggacagaaaaccaaacaccacatgttctcactcataggtgggatttgaacaatgagaacacttggacacagggtggggaacatcacacactggggcctgtcgtcgggtcgggggaggggagagggatagcattaggagatatacctaatgtaaatgacgagttaatgggtgcagcacaccaacatggcacatgtatactataagtaacaaacctgcacgttgtgcacatgtaccctagaacttaaagtataataaaaaaaactataacatgaaaaaaataaataaaagtaaagttttttaattaaaaaaaagataggaattatttctttgataaaaccaccaaaaaaaagttctattcacttatttcacatcaaaaaagaatttgagtgttagaccaagtaatatgttaatgtcttatgactgttaaatgatacctatttaacacctttatctctctgaattaatgatacttggtgtgaatatttattccaacaaaagtaggccatctaagattatattttcctcacagatggttgagctcttctcacaccctctatagccttaatatatagactgtaaagtatactgtcattttaaaaaaagtgaaaaggatatttatatcaggctaatcaatttgaattttgggtaatgaacacaccaattacccgtgttttccaaatctcatgtgcacaagggactatgaatcatgtacttcattaaagtgcaaggcacattactattgaattttttctgaattcatattacattattattattagtgtcaggagatactatttaattcagaaaaaacagcctggacaacatggtgaaactccgtctctactaaaaatacaaaaattagccgggcgtgatagcgcatgcctgtaatcccagctacttgggaggctgaggcacgagaatagcttgaactgagaatgtggaggttgcagtgagccaagatcatgctactgcactccagcctgggcaacaagagtgagtctctgtctcaaaaaaaaaaaaaaaaaaaaaaaaagacgagataccttaacagacttttttttaaatcttgtgattttactagcttagaaaataattgatatcataattgaagcataattttatttaaaaaaatacattttgactctgtcctcacctctctttccacatcaccttagtgaatggtgagcagaaaaggtgtttgctaaaaatagagttcacagtcagatatgtagtaaacttaaacatatttgcaatatgtaaagaattctcaaaactcaataataagaaaacatacaaacaacccaattcaaaatgagaaaagatttgaacagatacttcaacaaagaagataatacagatggcagataagcacaggaaaagatgttcatcattagtcattaggggaatgcaaattaatgccacaatgagatacctgtaaacatgttttacagtggctaaaatcaaaaagactgaccataccaattgttgacaaagatatagaacaatggaggccaggtgcggtggctcacacctgtaatcccagcactttgagaggccaagacaggcagatcacaaggtcaggagatcgagaccagcctggccaatatggtgaaaccccatctctactaaatatgtaaaaattagccaggcgtggtggcaggcgcctgtagtcccagctactcaggaggctgaggcagaagaatcgcttgaacccaggaggcagaagttgcagtgagccgagatcatgccactgccctccagcctaggcgacagagcaagactccatttcaaaaaaaaaaagaacaatggaaactcataacactgttagtaggaacgtaaaatggtataaccactttggaaaacagtttggcagtttcttaaaagttaaacatactcctatcatatagcccaggcattctactccttagtatttacctaagaaaaatgaaacacatcttcatacaaagacattaatattcatagcaactttatgtgtaatagccaaaaaatggaaacaactcagggtccatcagcaggtgaaaggataaattatgatacatgcatacaatggaataccactcagtgttaaaaaggaatgaactattgatacatgcaacaacatggatagattcaaaatcattatgctatatgaaagaagctggacaataatgagcacatactatatgattcaatttatataaaagtctagaaaatgcaaactaagtgacagaaagtagatcagtggctgactggggatggggatgggggctacaaaagggcatgaagatacttttgagcatgatggatgtgttcattatcttgatcatggtaatggttttatggttgtaaatatatgtcaaaacttatcaaattgtacattttaaatgtgcagcttattgtatgtaattatacctcagaaaagctttttggagaaaacaaaaaaatatatattcagagtctatctctctttcaccctttttattatttccagctggtttcatccaccatcatctttcacctggattactgtaaaagcctcctaactagtcttcccgctttttttttttttttaaaccctcatctccttccaatctattctcggcaaaactactaatgtttatttacagttcagggttgaaggctgggcgtggtggctcgcgcctgtaatccgagcactttgggaggccaaggcaggcagatcacgaggccaagagatcaagaccatcctgcccaacatggtgaaaccccgtctctactaaaaatacaaaaattagctgggcgtggtggtgcacacctgtagtcccagctactcgggaggctgaggcaggagatttgcttgaacctgagaggcagaggttgcagtgagccgagattgcgccactgcattccagcctggcgacagagtgagactccatctcaaaaaaaaaaaaaaaaagttgagggttgaaaatttacctattagttctgtaattgctctggcttggatatcttgtactgtgttgaataaaagtgagggaaaacaagaaaaattacctattgaatacagtgttcactatttgaatgatgggcacactagaagccaaacctcactgttatgcaatataaccatatagcaaacctgcatatgtaaccccagaatctataaaaataaagtcagatcatgtcactctagctcaagaccctccactggcttcctctcctactcagaataaaagccaaaggcccgcatggcctaccccagccttgtcatctctctgatctgacccgctattctccttgaccccttcacatcacttcacacacattggtctcctggctacttcttgaaaattccaaacatactccctccattgggcctttgcattggttattttctctgcctagaccactccctcacctcttctaaatgtcactttctccattgggcctactctgaccacccaatttgtttttgtttttgttttttagaaatggggtcatgctctgttgcccaggctggagtgcagttgcagtcatggctcactgcagccctgacctcatgggttgaagcaatcctcagcctcccaagtagctgggattacaggtgcatgccaccacgcctggctaattttttaattttttcatagagacaggttcttgctagatcttgaactcctagcctcaagtgatcctcccatctcagcctcccaaagtgctgggattacaggtatgagccaccacacccagccaaccaccctattttaaatatcaaggtacccaatccctcttacctgctttacttttttgccttattccatagtacttttgacatactctacaatttaccttttttgtgttttctcatcttcttgcactagaatatgatctacatgagggctggaatctttgttggttttcctcatgtatgccaaatgcataggacaatgcctggcatataatcagctcttgaaatatttatgaaattaatgagtgcttatagcatatgaatcctcaagatacattggcaaattagagtaggaccaaagtggggagaagagtaagaagaggtttaaaatacacatgagggaccaggcacagtggctcacacctgtaatcccagcactttgggaggccaaggtgggaggaccccgtgtgagtccaggagttcaagaccagcctgggcaacatggcaaaaccccatctctacaaaaaatacaaaacttagccaggcatggtggcacttgcctgtagtcccagctactcaggaggctgaggtgggaggattgcctgagccagggaggtcgaggctgtggtgagccaggatctcaccactgcactccagcctgggcgacagaatgagaccctgtctctaaaaatatataaataaataatgggggattcatttatttttgagacagggtcttaacgctgtcacctaagctgcagtacaatggtgagatcctagctcaccacagcctcaacctcccaggctccaacaatcttcctgcctcagcctcccaaagtgctgggattacaggtgtgagccaccacacctggcttgcagtgagctatgatcagcccactacactctagcctgggcaacagaggaagaccctgtctcaaaaaaaaaaaaaaaaaaaaaaaaaaaaaaaagcgtgtcctaattagaagagtctgtaattgttatagtccatgacaacgtagaatgctgaatcagttgtggaattgatttttcaaatgcttgttttacctggcaaatcatgtcaaaggtaacctgaggccaggcagagtggcttacacctgtaaatcccagcactctgggaggccgaggcggaaggatcgcttgagctcaggagtttgagaccaacctgggcaacatagcaatactccttctctattaaaaaaaataaaattagccaggctggtgcacttatatcccagctactcaggaggctgaggtgggaggatcactttgagcccaggggtttgaggctgcagtgaggtatgattgtgccactgcacgccaacctgggcgacagagtgaaaccctgtctcaaaaaaaaaaaagtaacaatgcctttataataattacgatttgttattttagccacatagccatatatatgaaatttacgtgacctattatttcagccctttattgctgaaaatgaaatattattttattactatcagtttaaccttaatatccctcatttcagattgcttaccagtatcatggaataaaatctccaatctaaaattcaatctgagttttatatttaagaattttagctttattatttgttttagattaagcttctgcacttttttaaacggttatatatgttcattatctttcatcttacataggagcgggatcgttacgcctacaagattcatcttccagaaacagtagagcagctgaggaaattcaatgcaaggaggaaactaaaggtaaattaaacaaatcagcaaaaaagccaaacagatatagttaatgatcatgtttttattctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttttcaaacttaaatattttgacaaatgtatgtttagttcaatggaaataactttgaattagaattggaattaggggccgggtgtggtggcttatgcctgtaatcccagcactttgggaggccgaggcgggcggattgcctgaggtcaggagttcaagaccagcctggctaacatggtgaaaccccgtctctactaaaaatacaaaaattagctgggcctggtggcaggcgcctataatcccagctactcgggaggctgaggcaggagaattgcttgaacttgggaggtggaggttgcagtgagctgagatcacaccattgcactccagcttaggcaacaagagcaagacttcatctcaaaaaaaaaaaaaaaaaaaaaaaagaattggaactaggattgaacaactatcagaaagcagtaaataaaatcttacactaccttgatctactagaaaatattttcagctcagatcacttttctcaccttctttattcttcctaggtgtctttctccctcttactactctccctatcctccacctcaccaaaaaaaaaaaaaaaaaagaagaagaagaaaagaaaactggtaatcaccccatatggggagtccatttgactttaaaaggttctgaaaaagaccagacataaagtaatggaatcttttcagcactgagagaaaatgctgagagaccatcccccacccaaccctccagagtaacaaagggaaattgattatcttaacttcttagaattaatttatgtttgacttacttttgatactgaaaaatgttaactgttctctaagtggttgattagatagtagtcttccttagtcacatgactcctgccaactataaaacttttcttcttaagtattttcagatatgccataaattctaataataccattttatttttcaacccctgaaattagtgaattattatgtataactctagacttataaaaacatttatatgaattttgaggaaactattaggctacaatattatcctatagacctgaaacttttaacatggtacccactggccacatgcagctatttaaatttaaattaattaaaattaaataaaattaaaaggtcagtttcccagtcacactagcacatttcaagtgctcagtaaccacagttggctagtggctactatattagacagcacagatgtagcttgggacatttccatcattacagaaggatctattcaaccatgctactatagaacaagggaaatattaacatatcattgttggtgttgattattcccattttagcctttcttctcactgattttgcagtcaagggttcaaagtgactcttctctatttgctttaaaaatccttggccaaaataattattaatgataagccattattgagatggtagccaaagaagtttcccaaaacttttattctttttgccttgatatccacctaaacctgtgtagcctacaaataaaaaactcttttattattcaaagtgaaatttggtcaactgtttttgaagttagtttcctccccaaagaaactattattacacttttttgtcaacttttctataagtcattctaaacctaattgctttggcctcatgtgacattacgctgtatggggttgaacctttcattgcccaaatacaaacatttcaccagagagcttgggcttgccccatcacaagaaacacatgctgtacttctcccggggccacagaatcagacttgggcctaaaatagccaaagtggtgactaagattcatttggacagggccaagctgtcaaaacagagaggggtcatgtggatttaccacatccccttgcagggctatttaaagttttaagacccaccaaacaacctagaactaggaacatcagcagggtcattagtgaatgtgtttggcttctgataaggctgtattcttttgagtagttcagccaccttgttaaaacatgttacacctaccatcctcaaggaactaattcccattctgcctcttcagtggacttctagaacagagattgcaacttccttggctttcagagtccaccacacactttattttcacacaactaggtgctcatcctacccagacactattcttaacctcctcagtggtgggtgacagtttaatttgtaatgactcccttggaagtgattaaaagggagttcacagaaagcggtagaaaattacttttgtggccaggcacagtgtttcacacctgtaatcctagtacatttggaggccaaggcgggcaaatcgcttgagctcaggagttcaagaccagcctgggcaacatggtgaaaccccgtctctacaaaatatacaaaaattaaccaagtgtggtggctgtgcatgcctgtaatcccagctattgggggcctgaggcaagaggatcacttgagcctgggaggcggaggttgcagtgagccaagatcacgccactgcactccagcctgggtgacaaagtgagaccttgtctcaaaaaaaaaaagagaaaaaagaaagaaagaaaattactttggtaacttagtcatgatggaatgatggaaaatgtattttccccattttggttaccacatgtttcatgtgtcgagttttttcctcctaattcatactaagctctggaattgtaatacttcattaaaaaaaaataaaaaaaaagaatcctctagataacaatactttctttaataaactacatcgttctgagcacagaactgaatatgaggacattttctcaaactgaatattaggatacatgagacagactgcatgatctccaggctgtgtggaaaatctgtgctctgtggtctggggcttttgagggggcacacctgtactctaaccctggctgtcatctactgaaggaggtactgaggaaagtggtaactgttgttatctgaggatgtctatccagagaagagactcaggagggaatgtattctgaagtcatccctattgcttcttcaattatttctacccctagaaagcaaattccccacagtgaagtgtgttgaagaaattctatacaaatagaagcaatattctatgtttgggtaagtttattgcagtccatttaagaaatggtgagtcgagtccacgtgattcagttaagaggataaaatcatttatttcctatatatacagaaagcaaggatttctaataactttctacagtttttctttattattattattatttttttttttttttttgagagagtcttactccatcacccaggcttagagtgcagtggcgcaatctcggctcactgcagcctccgcctcccaggttcaagtgattatcctgcctcagcctcccaagtagctgggactacaggcaccaccacatccagctaatttttgtatttttagtagagacgggatttcaccatgttggccaggctggctttgtactcctgacctcaagtgatccgcccgcctcggcctcccaaagtgctgggattacaggcataagccaccgcgcccagcctttattaattttgcaaattgcaaaagtattctctgacttactgattggtcacttgtgttcctgaactgtgcataactacgaaaggtttgtttaggagtgccattttctaatactgtataaagctgtactatccagtacagtagtaaatagccatatgtaactgtttacatttcaattttaataaattaatattaaataaaaagtaaaatttggttgctctgttgcgctagcacctttcaaatgctcaataccacgtgtgactgatggctactgtattagacagcacaggtttagaaaatttccttcatcacagatagttctattgtatggtattgctatagagtcttggtaactgcagagtaatgcttatacataagcagcactttttgataggtcaaccaggaagctataatagatattttttggcaattttctttctgttagttcaacaaaaactaacttaaagatttatcaaagacctttgtaccgtaatgaaacccagcatttacatacagtcctctctgtagtaagggtttgtacaaaggcagtaaattgagatagcagtcgttgtgggcttcagctaatcagagcattaaatctggtatccaaaaggtaacctttgagcctgagcaacataaggagaccccggctctacaaaaataaaaaatttgccgggtgtggttgcacacgcctgtggtcccagctacttggaaggctgaggtgggaggatcacttgagcctgggaggtcaaggctgcagtgagctgtgatcacaccactgcactccagcctgagtgacagagtaagactctgtctcaaaaataagcggggtggggaccttaattctaaaaactgaaaacttattctggtatgagcagttccgcaaatattctggtatgaacagttccacaaataataagtgaagtgattttgatcttacatattgattttacaaatcaattaatttgtgattttttttaagaaatacatatataggccaggcacggtggctcacgcctataatcccagcactttgagaggctgaggcgggcggatcacctgaggtcaggagttcgagaccagcctgaccaacatggagaaacgccatctctactaaaaaaaatacaaaattagctgggcatggtggcacatgtttgtaatcccagctactcgggaggctgaggcaggagaattgcttgaacctgggaggcggaggttgcagtgagccaaggttgcaccattgcactccagcctgggcaacaagagcgaaattctatctcaaaacaaaaaaagaaaagaaatacatatatagatatatgttgttttttcttttttaattgagacagggtctcactctgttgcccaggctggtctcaaactcctggactgaagcaatcctcccaccttggcctcccaaagtgctgggattacaagtgtgagccaccatgtcccaccagtttatgattctgaaatgtagaatatattacttcctgttgggcaatagattttgaaaattatgtacatttaagaccatctctataaaatacttttacatagacccaaaagaatttctaagatatctattctgtgcaattactcttaaatataactatatctagtacacttacaagtctcatttttcattttctctagagaaaatactgcagcctcttttagtcatatatcctgactgaaaattatgaaattaaaggttttagacctatgtttaggttatgtttgagtattatatatgtataggctatgctgactaaactgaatgataactctggttttggctatatggagacatatcaaaagttctgatttaattaatcatctcacctaattatcatctaggacctaattattaagtataatcaacccaaattctttaacatctctaccttgaaatgattttcttgacttttggtcatctctgttcagcctcaacctctccaaattctccaccctttttagggcttttgagttcagtcgtctgaattctaataggatgattatctttcaaatttctttgtcacactcctattggtatgttctggtgatacactttctcccctcagtatatttccctgttcactcaggaatatgactatatattaccttgttatttaggtacaaagccaattattctatatctgatacttgtatattttgtatttagatgttttaaaatgtaccctcctgccatgactgtgtattgccttgttatttaggtacaaaaccaattattttatatccaatacttgtgtattttgtatttaaggtttaaaaatgtacccttctgccattgtgcctatcaaacttcatgatgcgtgtttctgagctcaggaaataccaaaaagggagtattcggtttttggtttttgtcttcaagtcagcaatacatctttgttcagctcttgtgttcctcaataactttgttccctccttaagtgcattcagtagttaaacttagcagaaatctgacctaaccattttcttgttttccacttccttaaatgccacacagaatcatctagccagaagcataccattttgatgtttgacatattgacatttcaagaaaactataattatgattaagaattatttctagttcttaactacaaattaaaaacttgtggtgctctttttctctgaatttataatctgccttctcctttctaggttaatttgcttgatagaaaattacaactttaatattatttatcttaacagattgtgaatagtctaattaactcaaaagtattatgtttcgcccttaaaagatactaaattataccttctaaattaaagcaggtagaaaacttctttgtcaagggtttaataaaccagaaagtttgaagaactacttgtataaaatctgattttttaattgttgtattacattattgctatcgatgagcaatattacattattagcaatcagtagcaataatgtaatacaggggttggcaaactatgacctgggggtcaaatccaacccactgcctattcttgtatataaagttttattagaacatagcaaagtacattaatttgcatattgtccatggctgctttcacactacagtggtagaactgagtagttgcaaaagagatcatatgacctttagagcctaaaatacttactgtctgattatttacagaaaaaaaattgctgacccctagtatagtagaaatccttgaactggggagagtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattatttaaaaaaaaaacaaactacgtaaacaaaactgctagtcataagacagataaatttaaagcatactactattgtttcaaaagcatttgcatctcagggctcttttagatactgttttcctagtagtataggtatttattacagatctttgacaatagtagcaagaacaggccttgaagcgtataactaacatcttaagaaatacagttgtacttcatttggaaataaaaataaagcatctctaaaagcctagtttccgtgtgtgggaaacgtgatttgatatataaaaattccattcccacccagcttttaggaaacatgtataatacgtaaagtaaaataagtttttataaaaagaagaactcaacattcactactgttttttcaacatggtaactataattctgcataagaacctttcatgcgtaactttagactttcagaaatctcaaaagttacctggaatgttaacatcaatatcacttctctctttttgcccttccctttctacagtaagtaaactttgtggaaatatattttattaatgttttctggccaggcgcagtggctcacaccagtaatcccagcactttgggaggccgaggtgggtggatcacttgagcgcaggagttcaggaccagcctgggcaacatggtgaaaccccatctctacaaaaaaatacaaaagttagccaggcatggtggcacacgcctgtagtcccagctacttgggagactgagatgggaggatcacttgagcctgagaggttgagactgcaaagagccgagattgtgccattgcactccagcctgggcaacagagcgagaccctgtctcaaaaaaataataataatgttctcatattagcagatacctaaacacaaacaagttttatctttccagaaaaattcaagagttaatatttaaaatttagacttagactacttaggtgatttgataaactaactaaatgagtgattctacatagaccagcaaaaggctgtgctcatgttctagatctttattagtagagttagtaatgatatgcacttacagaatgctttacaatttgcaaagcactttcattaatacattatgacttttgccaatcctgtaagataagtccattttaatattctttttttttcttttttgagacggagtttcacttttgttgcccaggctggagtgcaatggcacgatctcggctcaccgcaacctctgcctcccgggttcaagcaattctcctgcctcagcctcccaagtagctgaaattacaggcatgcgccaccatgccgggctaattttctgtatttttagtagagacggggtttctccgtgttggtcaggctgatctcaaactcccgacctcaggtgttccacccgcctcggcctcccaaagtgctgggattgcaggcgtgagccaccgcgtccagcccgttttcatattcttactttacagataagaaagcctagagaggttaaatgatttactcccaaataccacatgttctcccttataagtgggaactaagctatgggtacacagaggcatgcagagtagtataatggacactagagactcagaataggggagggtggaggggcaagggatagaaaatcacctgttgggtacactgtacactactcagaagacagattcactaaaagcccacacttcactactgtaccatttatccatgtaaccaaaaaccacttgtacccctaaagctgtttaaataaaaaataaaataaatatgatttactgaagcagtaactcccaacatttttccactctacagtcctaagggatgtcatgcactcaaatggcagtgatttccaactaggaataaggggaggctatgcatatagcttaaaagagtcatatgtagttgattctgttgtgtggcctgatggagaattactatacaaaagtaagacattgtcattgttaaaacaaaaagagggaaaaaagattttaaaaagaaaaatgacacataatcctaccacccagagataattaataacattctggtgtatatgcagtcttttatatccatattaacttttttacccaaaaatgagattataatatacattgattttaaacctttttcatgtaattaatcacagacatcttttcattccactaaacacccttctacaacatcattttataataactgcagaatattccatcctgtgttacatgtttgaattcaagatgtaagtggtttcatatacttctacaattcccgattagtgttattctggtatatgcatatgtaatttatttcaaggaatctgaaataatttaaaaactacctctcttctagccatcatctcctatatatttgacttaatggataatccttaagataaataatttgttaaataacttatttatatttgtgtatttgttttaataatctattttttcatctctttgttttagggtgcagtactagccgctgtgtcaagtcacaaattcaactcattctatggggatccccctgaagagttaccagatttctccgaagaccctacctcctcaggtaattggataattcacttattcacctgtgtgggtcatttggcatttacatccattctctcccattgtgaataaacttttcctgtgcatttagttaaatcctccaacggattctaaggaagtttgtcagcaaccaaatcctgtctacatgtgtcttgttccttttcattttaataccaaagttgctttctcctgtggctccaaaaccaacacttcatttttttttcttttcacctcagtaatacttcttcccctttccacactctagacccagcattgcactccatccaatccaacatcctagtcagtcttttgggatctttctgattaccttctctctcaacaaaaacttctaatataagcttttccccaggtcagtcgtattagatcagactgtgggcagcactgctttgaatggaatctttcagtgtagagctgtcttgtgagttatctcctgaaacagttaccaagttcttctttctgtataaaaatctataacacggccaggcatggtggctcatgcctgtaatcccagcactttgggaggccaaggcaggcagatcacctcaggtcaggagttcgagaccagcctggccaacatggcaaaaccccatctctgcaaaaacacaaaaatacaaaaaaaaaaaaaaaaaaaaaaaaaagccaggcgtgctggcctgcgcctgtagtcccagctacttgggaggctgaggcaggagaatcacttgacccgggaggcggaggttgcagtgatccgagatcatgccactgcactccagcctgggcgataatgcgagactccatctcaaaaaaagaaaaaaaaaatctgtaacacatgcatacaagtatccaaaggggaagaacacagaagagttatttgttttgatgaactgtatataagtacccctgaaacaacctgccagtgttcacaaaatcattttataagccagtgcagtggtgtgcatgtgtagtcatagctactcaggaggctgaggcacccggctcagggggatcacctgagctcaggagtttgaggatgcagtgagctgtgatcacaccactgctctccaacctggacaacaaaatgagacctcgcctcttaaaaattaagagataaaaggccaggcacagtggctcacgcctgtaatcccagcactttgggaggccgaggcgggcagatgatgaggtcaggagatcaagaccatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgctgacttggtcattatccagagcccttcccacatgaaaggcagggatctagttgtgtttataggtgtggtccccagtgcttcttattgtttcacgtctgtcttttcttccactccattttgttccctccacctgtaacttcttttgttagctgaaacctctgtcttctctcctcacactcagattacagtggaccctatttaaggggagtggatccagtaatggtttgtattgtcatactgtggctgtatgatataatcacatgcttataatatatttaggataaatctctttgagattttaggtcaagatctctactaccattttcatctttagaaatggagctaaaggctgggcatggtggctcatgcctgtaatcccaacagtttcagaagccaaggcaggaggattgcttgagcctaagagtttgtgaccagcctgggcaacatagggagaccctctactttgtaagaagtcaaaatattagccaagcgtggtagcacacacctgtggtcccagctactagggaggctgaggcaggaggatcacttgagcccaagaggtcaaggctgcagtaagccgtgagtgcatcactgtactcaaaactggatgacagaacaaaactctgtctcaaaaaaaagaaaaggggccaggcacagtggctcatgcctgtaatcccagcactttgggaggccgaggtgggtggatcacttgaggtcaggagtttgagaccagcctggccaacatggtgaaacccccatctctactaaaaatacaaaaattagccaggcatgatggccacgcgcctgtaatccacctgaggcaagagaattgcttgaacccaggacacggaggttgcaatgagccgagatcgtgccactgcactccagcctgggtgacagagcaagactccatctcaaaaacaaaaggaaaggaaaataaaaagagtaatactctatgcatttaggaaaatatgaatatttaaaataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctcaaaaaaaaaaaaaaaaaatcaatgttgaaatattcttttctcatatttcaaatcaagtaattcagaatcagaacccaacgtttgatgtctgaaatcccaaacagttccagtgattgtactcatggaacatgagggctcactttggggtcagctgggggaccatgcttctggtggctcatgtagtgggccgaactgtggcttgataacctgcttgttctaaaatcatactgtttgttgtttgtccatatgctgccttcctcctaggacttctagcagcagaaagtaggtatccctttgttttcctttaaggtgtatcttttatgcaaaagtgtttggctttgcatggttcgtaatcagcttgactttttccttggctgtttgtgtgtagttgtttaagtattaattttaacactgcctggtcataaaattaaaacttggatatattgatttttgaggcattgttgcacaaacaatattaagttctcacttctttcataagaggaaaaaagacagtgttaaaatttcaacggcatttaatacttcacatctgaatttcacatacgaatacattaattctggggaaagagtaacatttattttagagtttgctttcaagaaaactttcagggtaagtgaatttttctttgacaattacatcacctgtaagtggtctttattgcttcctgttactgagtccattttcagtttatttggacctgtgaaataaattctgaaatcatatctcttaacaacttttaccatcagatagaacatttataaggaataatgtaatagctagattttaattacaaaggggcataatttgagtttgggagaaaattaaaatgtaagaaatgtacacacagttgagtacatgtaaaactgaggcaatctgaataagatgggtggattgtatcaatgtcagtattctggttatgataatatactatcgttttgtaaaatgttaccaatgggggaactgagcaaagaatacaagggatctctctgtattatttcttacaagtgcatgtgaatctacaattatctcaataaaaattctaattaaaaaaataaacctttacctcaaagataaatgagaaagcctgggtactaatgattgaattcattttcacattttcttacattagttatctgtagctcaaattgcagctgatttaatataaatcttatagtatattagttacctattgttgggtaatgaattaccttaaaacagcagttgtcatctcacagttcctgtgggtcaggaatctgggcgtggcttagctgtgtgcctctggctcaagatctctcatgagattgtggtccagtgctgctatctcaccggaaggcacaactgcaggaggaatcctcttccaagctcactcacatggttgttgccaggcttcggttccttactggctgtggtcctcttcacagggctggctgttcacagcatggcagctcacttcccagcacgaaagataaaagaggggggcaaaagtgagagacagtgcccaagactgaagacacagtctttacagcctaatctcatagtgacgtcttatcacttctgcactattctgttcattagaaatgagtcagtaagtccagcctgcactccaggggaggggactgattacacaaggctggaaataccaggagaccaggttactggggcccatcttagaggctgcccaccacgtacaaattaataactattaaaatgtaagattcttcccgtctagatttagcgctcctcttttttttttttttaaatcagccaacctgtcatgttatttgagaatgggcatcttggatgtatcagtagtgattttccttagttgtaaagctttacacgagtgggtacttaatagcagaatgttattaaagtactttgaaaaatctgtgctcgaagatgtttctatatggaagcataaactattttaataatcataatggcattagagattataacatctatacgctgacagaatacatatgcagagtttacttcctttaataaatttcaaggtatctgtaccataatccacatatggagaatctaaagcatgtatcaccatatgtaagttctcataacttgagttggatatggcacagatgcttatgtccaaaatacagtttccattacaggattcattattgcttataacttgattgataacaaagaatttgctttgtgcagtgggaataaaaagtgttgaacagggtgtggtgatagagggaagagattggctgcaaagggacaagagagaacttttttgaagtgatgacagtgtacacttaaatggcgacttttaacttaaaacagtataccttagtaagcagattttttttaaaaagtattgtgcttgcaaggaggggctttgattgagtaggtgataatgtgtgtgtgtagtaatacaatgtattaattgatcgctaatataatagaaaaggtattgattactcttagaagaagctaggctaggttcagattctagatttgctcagtgatgctgagtttcatagctatacattgtaaattaagaaatacacacacattgagaatttaatgtgttattttgtgaaaatctgagaagcaggaatgggatttaatgatctcaactgtcatccatctgaaaaacctaacttgtgattttaaataagatggcatactgccttccactattcccttttaaaaacaggaaatgtccctgcttttatctttatgaagttttatttatgaataaagtttgtactatttaaaaaaaaaagaaatacacaaatctttattgaaacaattacagtgaaaacttgggtatatcaaaactcattgaatggtacacttaagatttgtgtatttcattctatgtaaattttacctcagagagaaaaataagcattgcaatctttgctgaagtctttaagggtgaagtgtactaatgctggccactgccatttaatttgaaatgaatgaaaaatacgtgaactgatggatagatgggtagacatgtgataaagcaaatacagcaaactgtcaacatatgtaggatctaggtggtgggcacgattctttcaaactttctgtatgtttgaagcttttcgtagtaaaatgtaaggggaaaaacttttaagacatactcagcctactttaacactgagaactttttagtctaaacatttgactgtttatttttctgtcctccttttggtttatttttacttggtcaacctttttatgagacttccactctcgtaatgagattattctagactcaaagcttttattgaccttaaaagcatatttctctttaaagaaatagaaacattttttaaacagttgacatatttatgctttttttgactattatttcataatagtagcagaaaacttttgaaaaacttgtttgtactggtgagattatttgaaaaagtagaagtattcaaagttaaaatgtgcaggccagtcatggtggctcatgccttgccagcactttgagaggctggggtgggaggattgcttgaggccaggagattgagatcagcctgcacaacatagtgagatcccatctctatttaaaaaaaaaaaaagtatgattataaacctgatttttagatacaaactttattgccaaatgaattatgaaaacaaaatactattctgaaggcagggcattatagtatctaataagttcatgaatgtggaagtttggaccaagggctaggaaaaaaccttatatggtaaatcaaattgagattaaagagagaacagaaattaggcatcacgcctgtaatcccagcactttgggaggccaaggcgggtggatcacgaggtcaggagtttgagaccatcctggctaacacggtgaaaccccctctctactaaaaatacaaaaaaaaaattagccaggtgtggtggcgggtgcccgtagtcccagctactcgggaggctgaggcaggagaatggcatgaacccaggaggcggagcttgcagtgagccgagatcacaccaccgccctccagcctgggcgacagagtgagactctgtctcaaaaaaaaaaaaaaaaaaagaaattggacatcacctcattaccaaatgcaaatcattctgatgcattgctgaggataaaacatgattttgtgggtgggggacagtctattatggaaggaacactgaattaggagtgagacctgggttctaggatttgatcttctgcttattgcctgtggcccttggaaaggttatttaaccctactgagcctctggtttttcaaatataaaaacacttgctgaccaagcatggtggctcaatgcctataatcccagcactttgggaggctgaggcgggaggattgcttgagcccaggaatttgagaatagcctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctactttaaatgcctgctaacagatgcctttgtgctttccagcaaagtatctgctggtcctgtcaacacagctttgatcctgtgtgggggtggtgaattcctgctcatccacctctctgcggctccccaactcctccctaggcagcctgtgtgtcagtttgtttttacctcttctataccgtttacttcagggtataatatgcctacttcacacaccagtctgagagccccttcctcagggccggtgatcatatctctgatttctctgaagcccttgcctagtacctagcaaaaagcaggaatattcaataaagattttggggccaggcgctgtggctcacgccagtaatcccaacactttgggaggcctaggcaggcggatcactcgaggtcaggagttcaagaccagcctggccaacatggtgaaaccccgtctctactaaaaacacaaaaaattagctgggtgtggtggtgtgtgcctgtaatcccagctacttggaaggctgaagcaggagaattgcttgaacccaggaggcggaggttgcagtgagctgaaatcatgccactgtatgccagcctgggcaactgagtgaaactctgtctcaggaaaaaaaaaaaaaaaagattttggttattgtctgacccaatagggcattgttcaagttcttttccaacctccatattcatgcataaaccacacaacttcttgttgaaggtttcctgtatgtttcctagcatagcctattagtgtagtaagttaggcaaaacatagactttgaagccaaacaaacccaggattgagtcctggctccaccatttactagttatgcccttccatgaaccttctgaagctcagttccctatctagaaggtgggataatatatctgccttactgtgttgtcctgaggatgttcctggaacataataaacactcaagaattgggagctgctgttagtgtttccttaagtacttaattcagtgcatactttgtagatattataaaatgaataaaataaagagctgccttaaggaccttacagctaagggaaaaaaagagtgaacaagcacgcacataagtaactcatggagtgcgctggtggtacaggaatggcatggagcacttgggaagttcacagaccaacaaatgatacatccctggtctggtacagccaaaattgcttcctggtcttgagactgaccatcttagtattcacttgataaaaggttgtttttgctttaatcttatattattaataaactgctacataaactgtatatcagcatgagcaatgctggtaaaaggccgagcacagtggctcaggcctgtagtcccggcactttgggaggctgaggcaggcggatcacttgagcccaggagttcgagaccagcctggccgacatggtgaaaccccgtctctactaaaaatacaaaaattagctgggcgtggtaacctgtagtcccagctgcttgggtggctgaggcacgagaatcgcttgaacccaggaggcagaggttgcagtgagctgagatcatgccgttgtactccagtctgggtgacagagtgagactctgtctcaaaaaaaaagaaaaaaaaaactcagtaagatttcagtaagataactgagtgaagatgataattaggtttctgtggtatcagctgaattttttaatatacaaaaaaggcacttgattagtatttttgttattgtggtttcataagtccagaagtttagaactggctttagtaacttgataaacctagcatcatttaattctgttgttgatgacatgctggggtcaggggttcagtgggacatttgggactaatttcttcacatcatctcttgctttccaaggctttcagtaaaggatgaagagaaaattggcttttaactaatttccagattttttgatggaggggggggcactctgaacaaagtaaatcctgagaagatcaggtagaaggaagtggattgggttaatacctctttaggaataacagaggagatgaggactgatttctgccatttatctcttttatcccacttaatatccacttaatgttttcagtgaaaggataccaatagcctggcaggcataattcaaaatttaatattatccagccgggcatggtggctcacacctgtaatcccagcactttgggagctcaaggcagaaggatcgctttagctcaggagtccaagaccagcctgggcaacatgacaaaaccccatctctataaaaaatacaaaacttagatgggtgtagtggtcccagctactctgggggctgaggtgggaggatcacttgagcacaggaggtcgaggttgcagtgagccgagattgtgccactgcactccaacctgggcaacagagcaagaccctgcctcagaaaaaaaaattatccaggccaggcgcagtggctcacgcctgtaatcccagcactttgggaggccaaggcgggcagatcacgaggttaggagtttgagaccaacctgaccaacatggtgaaaccccgtctctactaaaaatacaaaattagctgggcgtgttggcacgcacctgtaatccccgctactcaggatgctgaggcaggagaatcgcttgaacctgggaggcagaggttacagtgagccaagatcatgccactacactccagcctgggcaacagaacgagactctatctcaaaaaaaaaaaaaaaaattatccatagttccttcaacagacgaatggtcaaacaaactggtacatccacacaacaacctggatgaagccccagataattatgctaagtgaaaaaatgcagtcccaaaaggttacatactgtatgatttcatttattctttttattttattttattttattttttaatttttagagggactcctccttgcagaccagggctaccccataggcagtatgcccagaataggagcctcatttattatcaaaatgacaaaattgtagaaatggagaacagatgagtagttgccacaggttaggaggggatagggtaggaggggaatgagcatggctataaaaaggcagtatgagggatccttgtggtaatggaatgttttatagctcgactgtatcaatgtcaatatccaggttgtgatattgtactacagttttgcaagatgttactattggaggaaactgggtaaagggcacatgagacctttatgttattttcttttacaactgcatgtgaatctacaattatctcaaaataaaaagtcaaattttaaaaaatagctacagtaatttccacgtggacagccacacagtatgtggcttaagacccaaatctttaacataattaaatagagctacaaaaatcagtagcttatatagcattttgttttgttttgctattgtagaaaaacttggaaagtatggataagaacagaatgaaatagaaataggacagtaaagataacaactgtaacacttttgctgtgtttcattctgttttttgtttttccggagtttgcatatatgttttgtttggttttttatcgtaactgggaatatacagtttatttagttttgcattctgctttcttgaattcttttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcctgttctcaatgagctgttgggtacacctcccagacggggtggtggccgggcagaggggctcctcacttcccagtaggggcggccgggcagaggcgcccctcacctcccagacggggcagctggccaggcggggggctgacccccccacctccctcccggacggggcggctggccaggcagaggggctcctcacttcccagtaggggcggccaggcagaggcgcccctcacctcccggatggggcggctggccgggcggggggctgacccccccacctccctcccggacggggcggctggccaggcagaggggctcctcacttcccagtaggggcggccaggcagaggcgcccctcagcttccagacggggcggctggccgggcggggggttgacccccccccacctccctcccggacggggtggctggccgggcggggagctgacccccccacctccctcccggacggggcggctggccgggcgggggtctgacccccccacctccctcccggacggggcggctggccgggcagaggggctcctcacttcccagtaggggcggctgggcagaggcgcccctcacctcccggacggggcggctggccgggcggggggctgacccccacctccttcccggacggggtggctgccgggcggagacgctcctcacttcccagatggggtggctgccgggcggaggggctcctcacttctcagacggggcggctgccgggcggaggggctcctcacttctcagacggggcggttgccgggcggagggtctcctcacttctcagacggggcggctgggcagagacgctcctcacctcccagacggggcggcggggcagaggcgctccccacatctcagacgatgggcggccaggcagagacgctcctcacttcctagatgggatggcggcggggcagagatgctcctcactttccagactgggcaagccaggcagaggggctcctcacgtcccagacgatgggcagccaggcagagacgctcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccatctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctaaggcaggagaatcaggcagggaggttgcagtgagccgagttggcagcagtacagtccagcttcggctcggcatcagagggagaccgtggaaagagagggagagggagaccgtggggagagggagagggagagagagagggagagggagagagagagggagagggagagagagagggagagggagagagagagggagagggagagggagagggagagctgctttcttgaattctatatcatgaagatttctctgtgtctttgaaattcttcaaaaacaattttcatttggctacatattccattatatggatattctataacctacgtaatcatcctctattagatttattttccattttgtatgataatatcattatatataaatcttccatttttttccttaaggtgggtttttgtaaatggaattactaaatcgaagtgcatgaacatttttaaggctttttgatatatgttaccagattgctttctggaaaagtggtactgatatatattctcaccaataattgcatgagaatggataaggtctaagtcaggaagaattagaaacagagttctggagcataaagatttttatctttatcaaaaatataatttctcaaccacagcactactgacattttgggccagataattctttgttgtgggggctgtcctgggtattgtaggatgtttagcagcatccctgacctctacccactagatagcaatagctgccctcccgctgtagttgtaacaaccaaaaatatctctaaacattgggaaatgtccacctgggtaacaaaattgcccctggttgagaaccactgatccaaagacttaaatgtgcaatgagacacttattcttagagtttctctactgtgtactaatgttctgaagcttagctccttggagctctttttttgtggagtatatatgtgtattctgcatattgcctgcaatgtaaaagaggctgatcttttttttaaggctgtgtaaatggctttgttactcctcattgtgtatctttccctactgacatctgcctggtttcctggttatgagaagaaacttaaagtgatggcacttccatttgctttgccctacaaaaatgatttgccttgaaatttaatatggtatttggaagtgtcagtcagcgtccctatactttgtctttatcttctgagtaagaagggtaagagtaaaacagaatgagaatgactttggatctcttgagtctgtatgtaaaggaaaaaaaaaggagtggactgggatttttgttaactaaagttcaagtcttaaaaactaagaagcctattttaagcagcaggagttcccagttgaaggtctgttccctgtatctacagctggctttaccttcagttcttgatggaatgcacctgggtaaaaggccaacctcgtttctataatatttcagaacatcttggagtcctgaaacccatactctcttcctgacataaaacttgctgtgtccagatcttctagtgcttaggttatacttgataaatttcattaattcaaagaagataagctgcagtttcctctgaaaaatgaagagcacacaaatacattaataagaacatgaactctctgaaaatactgtgtccttaaattatatgaaactcatttaagtctatccttcagtaaagacactagcctttgaagttctgatatgaattcattgttcttaagtgtaagatttaggtttaaaaagttagtttgacattgactttctatactggctgtttcttttctgtttgtcccccttaggagcagtctcacaggtgctggacagcctggaagagattcatgcgcttacagactgcagtgaaaaggacctagattttctacacagtgttttccaggatcagcatcttcacacactactagatgtaagtctgtctttttattattcttcttttttggtgaattgaatattggccgggcacggtggctcatgcctgtagtccaagcactttgggaggcagaggcgggcgtatcaggaggtcaggagactgagaccatcctggccaacatggtgaaacgtggtctctactaaaaatacaaaaattagccaggtgtggtggcgcatgcctgtagtcccagttaggactgagctgaggaggcggaggcacaagaatcacttgaacccgggaggcggaggctgcactgagccaagatcacaccactgcactccagcctgggtgacaaagcaagactctgtctcaaaaaaaaaaaaaaagaaattgaatatttagcatacctttttactttacatgaattctcagatgtctatcataacaattcttttcagttgccttaagcctatgagaaatgtgggaaatcatccatcaaaaattcatgattgaaatacagtatatggccgggcaccgtggctcatgcctgtaatcccagcactttgggaggccaaggcgggtggatcacctgaggtcaggagttcgagaccagcctgaccaacatggggaaaccccatctctactaaaaatacaaaattagccagttgtggtggtgcatgcctgtaatcctggctactcgggaggctgaggcaggagaatcgcttgaacccaggaggcagaggttgcagtgagccgagatcgctccattgcactccagcctgggcaacaagagcgaaactccatctcaaaaacaaagaaaaaagaaatacagtatatgtacagtacaaatgcaacagagcctagcaggctacaatgggaaaaaatttatatatctttatatttataaattatatgtacataatgcatgcaagtggtatgtgagttttaaaaaagagtagagtacaatcctactttactgaattatcttgtatttctgttaaaagaatccattgaggttagctgtgattactttttattgctttgcacattactttaaaacattatacctccagcatgagtataggagagagaaaagcaaatgagatactttgcaataggctgtattcccacacacatttcatatttaacattgttttgttccatagattcaatgtcttctccttaaaacataagcatatactccatctttaaatattacaggctccactgacagcagactgggatacaaaggaaaaaacagaagctgaccattttcatttcagtcacattttaagtaaaatacctttcttagagaacttggttcacttcagcaatgaaaactcttgggtggtttcgatggtatttgaacatgttagtctttttacaagaaaaatcttcccttaatgagagaatcatacttgctttggggtgcctagaactgtttggtgctgaataattcaccatatgatgtaaatgaagctaaagcaaaatttcccagaatgtgttctacagagcatggctctgggaggttgctatgggtgttgccatggtgggagggggaagtagatcttaaatttattggttaaattatttattgactaaataagtttgggaaatgctacattctttagtctttttatacagatccacaatgggtgttggtatattgatagctctgagatgatctaaagcaaagaaacctttttaactttctttatcagcatttctcaaactaatttgggcacagaacttttattcacaatcctgttgagttctgttttgatgaggaccagtttgggaaaagctcagctaagagtgtttgttgcattatgcttcagctttacactaaatgcagccgtaggtatctaacagttgcttctttccccaaatgtggtcagttcaaattaattatcagattttcatggctagtttggcctttgtatatagtgtacatattaattagggctgactaactgttataacatgtgattctaaaatttgagtggcttaacagaatagaagtttacttcttgctcacttcacagtccaatgcaggtagatgagggaggtcttttccacaccgtcattcagagacccaggcctcttccactaggtcacactgctatttcccagggtcttggaatcttctactgtatcctttgtacctagccagcaaatgagagaagagagaacatggagaatcttgcagggtcaagcttggaaatgggtttatctcacattctttggcaactgctagtcacgtgctcacctggatgtgagagctgaggaacgtagtttagaaatgtgctcaggaagataaggaattgggtcttctctttagtgtaatttatcttaagtagtatctattcactgtcattgctgcagaaagttttcacaattgtgtatttcccactgaagtttataccctttactagaactagttagtgcaatatttagaaaaggctacagcagtgtgtggagattttgtttattttattgtggtcagtgcttaggtcattgccaggtagatttactgaccttcttttgaatcaaggactttttgtaacaaagactttttgtaatttaaacactgagagaagcccaaattggtttcaaagttgtattttttcttactgatatagcaaggtatctgagcacatcaagcttgagattgcaggggagaagcaggaacattactggcttacacaaggaaaggggcagctattcagacacgaataactgctgcactgtttggtataaattgtcacaatttcagaagagattcttagatgttagtgagaaaaacatacttaactttcctttgcatttgtttacattataaagaagtatctgccttattggcatctgccctgtcagtgcaggtcaatttgaaagaggagctgttggactgaaaatgaaccatgcctattaaaaaggtgcagtataagaccaggagtagtggctcacacctgtaatcccagcactttgggaggtcattgtgggaggatcacttgagcccaggagctcaagaccagcctgggcaacaaagcaagaccccatctctacaaaaaatttaaaaagcagctgggcatggtggtgtatgcctgtggtcccagctactccagaggctgaggctgaaggatcacctgagcccaggaattcaagggtgcagtgagccatgatcacactactgcactccaacctgggcaacaaagtgagactctatctctaaaaaaaaaaaaaaggtgcagtatcttctgaattttgtaaacaggtgccatacatgagctccagtcaaattaatgactatgaggccgagccctggacaatatttgcatgcatgtggttctgaatctccaaactgagctatttctaaatgaaagtttaggccaggtacggtgactcacgcctgtaatcccagcactttgggaggccaaggcgggcggattacctgaggtcaggagttcgagaccagcctgaccaacatggtgaaacccatctctactaaaaatacaaaaatgtggtgggcacccataatcccaggtacttaggaggctgaggcaggagaatcacttgaacccaggaggtggagattgcagtgagccgagatcgtgccactgcactctagcctggtcaacagagcgagactccgtctcaaaaatgaatgaatgaatgaatgaatgaatgaatgaatgaaagcttaatcatcatgaatgaaataaaccatcattagaatgtgccctcataccctacatcccataaataaggcttattaagctcatttcacagctaacaggctacattttaataatataatcaatgaagaattcaagtgactgccatatagagaaatctaatcatttaaaaaattttaatatttaaatgtttgtggtatacattaaggaagaaaaatggctatgacgaactcttgaggagcagctgttaaaatgttggattttcagtctgggtgcagtggctcacttctataatctcagcactttgggaggccgaggcgggaggatcacttgaggtcaggtgtttgagaccagcctggccaacatggtaaaaccctgtctttactaaaaatacaaaaattagctaggcatggtggcgcatgcctgtagtcccagctacttgggaggctgaggcaggaggatcacttgaacgcaggaggtggacgtagcagtgagctaagatcacaccactgcacggtagcctgggagacagagcaaaactctgtcaaaaaaaattgggcctttcatttttctttcttcccatgttccacataccatggttgatttggaattgttttattttgcagaatcaaaacgaattcttctgcctttttttgtttgttgtttgttttttgtttaagacagggctctcccaggctggctcactgtagccttgaccttctgagctcaagcaccctcctacctcaaccacccaagtatctggaccacaggtgcaccaccacactcagcccttttttttttttgaagagacaggtctcaccatgtttgcccaggctaccaggctagtctcaaactcttgggctcaagcagttctcctgcctcggcctcccaaagtgctgagattacaggcatgagtcattgccccagcatgaattcctttttaaggattccaagtagggacacccagggggcatagttttatggaccatgaattaattaaggctaattaatcccactgagccattttaggaaatatctttaccatttttatgttatttctgttaactcaataacattctaaatagctaggtatgaagccataattttaaggctgacaaaaagaaacaggattaagttcctaagaaaaactaaagattatctatgacttctttattttttctagtcatgttcttaaaataataacaagctcaaaatttgaagaagcattattagaatttgtttacaggaaacaaaactgccaaactgaaacatttacattaaaatggagaagtactgtgattctactgaaagggaaatgctttctgaaaacctttgaatttgagtaaaacacatttagtttaatctgtagttagaaactgatacagaaaactctaaatatttgctatccaagtggttccagcctggcacacatatgcagcttctcattttgtgggaagaaatacagaggcatgaggaactgcttggtccagcttgttgcagtatgcctgtatttaaaaattaaaagcactggtgctaagatgatcttcgtatgaaatgtatagatcaattagtaaagtacaatttgacattagtttgctaggactgccataacaaagtaccacaagttgtgtggcttaaaacaacagaaattgattgtctcatagttctggaggctggaaagtcctaaatcaaggcattggcaggggcatgctccctccaaaggatccagggaagaatccttccttgtcttttccagtttctggtggttgcctgcaatccttgtcattccttgacttgtagatgcatcattccagtctctttttccgtcatcacatgtcattctctgtgcgtgtgtgtctgtgtatttacatggccttcttagaaggacaccagtcattggacaccctaatctagtatgacatcatcttaattaattacatctataaagacacttatttccaaataaggtcacattctgaggttctgggtaaacataaattttgagtgagggacaatattcaccccagtacagcatggaaaactgatttaaccctgaattaattcttcacgtgtgagtgcaaattacacaaatctaatataaaataatgaaatgttaccctgtcatccattaattatgctttattgggaattggtgttaaagtgttatttatgtcttgtaatgatattttgaatcagttatggattggaatttgtatgtgatacattggaaggtcagtgggtgggtgagtttttgatggactgaaaagccatgttttttggattaaaaacattttacaaatattatttggtagtagttttcagtcttctcagtttctagtataaattttcctattaaaataataaatgtttagtttgtaaatcaccagtgttacaaaacattgttaaatgacacatctctctgccaaactttgacaactaagttttaaacattaactggccatctgtcatacctctgaacagctgttagcatttgttacgcactgctgtttccatagtaaatgcccccacctaattaagattatttttgtaagaagtcttaaaattgtggtttctgaaaatataatgggtgattagattaatatagcaatttattgatgaatttttaaaattgcagtagcaattaatttaggagtctttataatattaatttataagtagacttttataatagacttagtaacttttaaatattgcattagcaattaactgatacttggaatctttcatattttgtatggccaacatctttattataattttttaccgtttagggagagttagcatttttccatctggcctggagttagccatggaaaactacaattcttgatttactatttcgcttttttgagatgacattaaattagtagccatatttagaagagcttatttttagaactcagaagtttcctaaaggaaaaagatggaacttctacaataatctggagataatgtttttgagcaatttggggtctgagaagtaagttaaatacaatgttaggtttggatatttaaagagattgccaatcaggaaatgccaaagctaagtttcccaagaatttgtagtccagccaatttgcatttaaatgtctagaataataaagcctatctgaggaccttcagaggatgagctactagtaatttctcagggccccatccagtcttaagagtcagctttggcaattatgaaaccagctgcacagtgggcccctgcccagtggtggtggtctttgtgcttcttgcctcctggggctgtagactgaagcgcattgctgttccctttgaatttgagtgtctctccactgttttctaactggaggggcaaaacctcccatatctgtttctctccatgtattgaagtagtattgtcagtgtaaaagtacggcatgaaacaaaatacctgaaagctagaaataccatatgtcgtgaatattctcaaagtatttttccttctttcttaatgtaaataaatgtcaataaacttagcaaaaaaaaaaaaaaaaagccgctaagcatatggttctttgttaagcagcaatagaaaactgatagaaccaggaacaagatgaggattgtccactccccacttctattcaccattgtcccagagactctggccagtgcagctaagacaagaaaaagaaattcagggcatgaagattggaaaggaagaagtaatatcatcctttcccagagttgttatcttgcatgtagaaaatactaaggaatccacaaaaaatctaatagcattataggcaagcttagcaaggtcacaagataccagattaatatacacacattatctaaatttctatatgtgagcaaaaaataacccaaaaataaaattaaagaaatattcacaatattataaaaagaataaaataggaataaattgaacaaaaaaaatgtaggatttgtatactgaaaactaaaaaatgctatgaaagaaagatctaaataaatgagcagagatatactgttggattggaggacttaatattgttaagatggcgcttttctccacattgatctatagattcagtgcagtccctatcaacatcccagtaggatttctttgtagaagtcaacaaggtgatcctaaaatttatataaaaatgccaaaacaattttgaaaaagaaaaaaattggataactgatttcaaaacttactataaggctacaataatcaaaatagtatggtgttggcataaggatagatatacagatcactgaaacaaaaaagagtccagaaataaaccctcacctttatggtcaatttattttcaacaagattgccaatgcaattacatggaaagggggatagtctttttttttcaaatggtcctggagcagttggagatccatatgcaagaaatgaacttagaccctgtctcataccatacacaaaagaaaattgcctcaaaatggatcatagattcactttaagagcttaaaactataaaacttttaaaagaatataggaataaatcttcattaccttgggttaggcaaagagttcttagatgtgacacaagggaatttggggggattacggaaatgttcttaagctggattgagatggtggttgtacaactatataaatttactatcatcccactagatttcacagggccattacactaaattaaaatttagctttgtggctaagaatttaccactgattcaaaaatactaaatatggttttttctcccaagaactgttttattaaccagcgtgtagttgtgccttatggaagaagtccaaattgtgttttttgtttgaaaatgttatgaattacataactttatagattttcaatatggaagacaccttagagcaacttattttagttcattccttctacattcaagtacatatttgccatttccaaaaattcacagctttttgatacttttttaacatcaattttttggtcttttttgttgtggcaagatatatataacataaaatttgccacttgcaccatgtttaagtgtacagttcaatgacattaagtatattcacattgttatacaaccatcatcactatccatctccagaactctttcatctttcccaactaaatgtctgtacccattaaatactgactcccattcacccctctccttagcccctggcaaccacccttctactttctgtccctatgaatttgactactctaggtaccacgtatataagtgaaattatccagtatttgcccttttgtgtctggcttatttcatttagcatgatatcttcaaggttcatccatgttgtagcatgtgttagaattttcttcctttttaaggctgaataatattccatcgtgtgtgtatagtacattttgtttgtctactcatccaatattgatgttttgtggttgataattatgtactaggaaaaaccaaattctcagaataaggctgtctaatcgtagggaattctgcctcgttccatctccacacaattactctttctaggatgcaagttaaatcttatgctatacatcttcgtgaaggaatgtgtgatttccactgaaagtattaatgactacggaagtccctccaattcccttatttgttcagataaattacttcttaaagcagggtttagaatttactctagaataccaagaataatgaatcagcttgtcaccagtatcagtgttacccactgagtgccattctctttttatgacaccatgatcaactttaccaaaaggcaaaggaatttgcagaaagccttctaagtacaataagcactgattcttctttatgctatgctcaaggaaaggaggggtttccccctagaaaggaatgtgatatgctcagttaaagaatgttcgatggagtggcttgcagcattcataatccaagaacatagctgttttcttctctttgtggcccttcaaacatgatctcataaaactcttctgccagactgcctttgtgctattctctttaaatttttcatgacagaaattcatttttgctacagctacaccaagtacaaatgcttggtgtttacctatgcaaaataaaaaaggtagcaaaagccaaaaataattaaataaaatattatctgacacacctaatgtaacataaatgttaccttttaaagcagcacattaataattgtatgttcatttaatgtaaatatcatttaactcttgtagttgcttaagaagagccaagctaggaaatgtgattttaacactttaaaaaaatagaaaggaaattaatatcatagtgaaaatttctcatagttgggcaagctcttgtatctgatactaaaaagtaccgtatttcagaagattttattaaaacaagataaaatctgcctatattatatcatgtaactggtttttttcctcatgctttcttttgctcaagaataggcattatgatttgtgttttacagggcttaattttagagttatttgaccacttgaaaaaggcatagagaacagtcaagctaggtcatctgaggccagtgtttgagtttctcagaaatagctgccaactgaccagaaatctgccacactggcctatgttgttaggccaccaaaggcacagtcttcttggattgaactaggaggtcaagcaagtcttaatttcttgaattcaaaaataaatccctgtaagtgcgatgttctaataggattagaacaaaagcagccctgtatacagacaaataaaacctaaacaaaacaagggcctccttagaggttcttttgctgtcaggatccaaaggatttttgcagctttttcaggaaatcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactccatcctaggcaacacagcaagaccccgtctcaaaaaaaagaaaaaagaaaaaaacttcttcctagtgtttaattgtagctccttaagtttttgaaaatgccattttaaattttgcaatgtttctttcacacttacgttgcccatcatgcaatctttaggccactgctaaatacactgctcttctccaagcttgaactacatgatgtttaatgatgccaaggatctttgaaaggactctgtgtgtgtgtgtgtgtgtgtgtgtgtgtcagggcctcagtctgtcactccggctggagtgcggtcatgcaatcatagcacattgcaacttcgaccttccaggctcaggcaatcctcccacctcagcccttcaagtagctgggattacaggagtgcgccaccacacctggctaatttttgtattttttgtagagacgaggtttccacatgtggcccaggctggtctcaaacacctagcctcaagcagtctgcccaccttggcctcccaaggtgctgggatgacagatgcaagccactgcacctggcctcaacaagtttatatgtaaacttgagcaagaaaaatagatttttagatcttacaaagttttctgtgatctccaacttcagaaaatcagttccagtacagtaattgaatatcagttctctgtgtttcagtattaaatcagctttccctaatattttgctcaatttcaaatgtatatgagaaaatacctgttatgtattgatggctgatctgctcagttcactgaaaagatgtgacattgaaactttgttcctatttacccacgtaattcacagaaactgaagaaagttcttaataagatagtcagtgtttccagaacaagttatttcaatggtcattattgctacacagtgtaattccgtgcacactgttattatctgttttattaggatcatcacagacacattcattaaatattttgcagctaaatatttgattcttgcaaactttcattcttttccagcaggaaacttcttcagtatctataaagtaagtgataagatgatggttgctaatgaacatcaatgttctttgcaaccctacaagcctatgcctacagtatagttgcaaaagttatcaacttgtctgaaacagtatacattctggtccttagatttggttttctctgtgcaaaaaaagttagtgggacatacaactcagtgataattattttatagcttcttaccatgcattccattttaaatgttgatcttgataaatactgcacataaactatgagcaaaacacaggtttctatttgataactaagaaatcagaagataatgtgatataatgagtatgataaaaaatgaaacttgatttagtgctttgaatgtaaataaaaggtgacatattaactgattttatcatctttatgtttgaaagtacaatctcaggagatttgaatttaatatcactaccaagtttattctgcttcatttgaaaacccatgtcaaatgtagaatgtgttctctttatggaactgtggcgacacttcctaagacagaaagatgaatgaagcgtgtcggtgtaggtatgtgtggtcatatctgactcagtaccagagatttgcagagagcaggcctatctgtgagacaatatgagacagtctgtttcccttgcagctgttcacatttccttgttttgccctggtgttgtgtgtacatgttttttgttttttgttttttttaataaaaagtgctgaatttgggtaatgataatttcattagaaaaagagagtaaacagtaacagattcattcttgttttccctctagggataatttattaacattcttccttctctcttcctcccccttcacacctcagctttacaaatacacctgataccttcaaatttcaggaaagcaaatagcaaaaggaaatacattttgtcattccaatataacttgaatttaagcttctagagcagggattcacaaactatggccctcaggccaaatccagctggccacctgtttttgtaaataaagttttattggaacacagccatgctcattcatttatggattattaacagccgccctcatacaacacaacagggtttagtggctgtgacagagatcatatggcctgcaaagcctaaaatatttcctatcttgccaggataggattaggatcctgatattctttttttttttttttttgagacagagtctcactctgttgcccaggctggagtgcagtggtgtgatctcggctcaccttaacctccacctctcgggttcaagcgatcctcctgcctcagctaccttagtagctgggactacaggcatgcaccaccacacccagctcatttttgtatttttagtagagatggggtttcatcatgttggccaggctagtctcgaactcctcacctcaggtgagaatcctgacattctttaacatggcaaggcttgtaattgagtagctaatagttttcaaatcatattgagtgtatttttccctgcagcctataaatagaattttttacagcttttttcccaagtatttgccaaagatatctccctggcacaaggcattgtgtattactgaattctagtaacaagctgaggagatctggatgagagaaaggacagcatatcagcagggcagggtcaggtccctgctactctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttaccttgaaagttgtataaagtaagtcagacttaaaagatacaaaagaaagaattaaatatagtcaaaacacatttcttaattttgagggaaagtttttaactgcacatgcaggatcgaagagaaataatatctggttcctaaagaaacaagctgaaataaatattcctggtgtgtttattttatgttactctgaattttttttaaatctatttacaatttctatgtactagtccaaatataatacttattttttctagaggaagcatttcttaaacactactatgtactcagcctcacgctaggggctattacctaatgtcagagaacccgagtctggtcgtgggaaagaaaaagaaccacttaaacagcatgttctataatgtacctcagacattcagttccctcttggctgttgatgcccttggtgtggcagacaccccagtgttggctctgtcctgagttgcagacgtgtggtttctgcatcgtcagtatactcagcacctggtctcagaaacgttctcgtcccctgcccccaggggttaccacatagctttttacttctgagtcctcttgtcctcctgggcagggctgtatccagatggctccagccaggctaccttctgcagtgtctccttgactcatgggaaacacacacatgcttaactcaacatacactacaagcatggcctgccccaggcggcctccagtcatgaaagaggcaggcaccagtctctttttgcttaggaccccaaatgctacatgtcaagctgccccaaggactctctctcacacagagatcctttctagtgtaccaaggtgggcctataagttgctacaattcagcaagcatccctccagagaatgagatagtgagctcttctggctggcacctccagtgtctaatgcgtggttcttttggggcatctaccatccttcactttgtatgagggagggtgcaatcccctctcctttcctcccgaacaagaaggagaagggaataatcaaatacttgctcttcttagtcctgtgactcctacaaatcccagacttctgcctctataggcagaatgaggggtcctggggtgaatatggaagggccattttgactgcctttcagcaagcccaggagaagtggtctagcagctttatagcaggttcagtgccatttacttcctcttggccttagctttgggctttagctgaaagtccaagactactggtaaggtcccaagtaacattttatatattctttatatatgatagaatggggggtgggtaaagggtaagaaagacaagctgcagtcttcctttgttctcaaaacccagctacctttcatttgccccagaccttgacaaaactctacctagatttgaaatttgagtcctgcatatctttgcaggcagcatataatatgcagatgacccatgagaatgagaaatccaaaagcactatgtttctaactactgtttttaaacacttcaatgttacatcgcattcgaacttttttccattgatgactttttatttacctgctttgccatatttctcaaatgctttgtatatgctatggatatcactaaagtattttgagtctctaagacaaaaatgtagaaattggtgggggaaatgaaggttgacatattatgcatatacatcaagatactttccaacttcgggttgcccactgagatcattgccagttgttattgctggggaccaaactacttactctctggtctccaaagggttgaatccttcatacatttctgggcctttggttatacagatttttggaatttgtgagctctttgaagacagaaactcatctttttcatctctgtatccctagtacatagaaccccacattttagtacctagtaagacttcaataaatattgagtggatgggtatgtggatgaaccaacaaagggtcacttctctctgacagtgacaaaatgagcccattcctcactccctcctgcttcagttcttacttgcccttttggttgatgagccagcagccgagattcacagtgtattctttgccacatggacaccatcctctctatcctgtggctgccttgagaggtgcagtttctaggacttgagagctgcagtttttagaagaagcagagcccaatgcccccacctcaggtagaagccccaccttttaattccttcccattgtatctgcctttcatattaagcatcccacctccccctcatcctgccactacttccactgaactttaggtgagttgaatttaatttaagtgattgaactggatcagaccagaccaaaggcgtggaaaaaaatttggtctgagtattttccttggagcagtgcctcaaaagagattccaggcacttgtgtgccacctatgaagttgtatggatagaacagcggttctcacttgaccactctgtgcctcatttttctcatcttaaagtgagaatagtaggggtaaccaactgcgtaggattgtttgaggttaagtgaatgagtatatgttaagagcttagactagtaactatcatctagtaagtgctcaataaaagtaatattgttgctattagtagtagtactattagtactctcaaaagttagcactggacataagattttcaaatacctaaggagtttattaaagcacagatttctggacctccttcttaaattctgatgttgtaggtctggaggggggtccaggaatctatgttccataagtactacatctgattcggccacacgttcttaagaaattacagatataagacctaaggaactgtatatgacatagtaagaccaggtcaaaaattatctccaatttggggagttgtgggattattttttctttgtgagaaaaattgatgtgcatttattaaatgtttaaatagaaacgaaccataatcatagttgaaaatgttggaaataatagtccttgatcaagaaaaaggcaaaacttacagtttatcatggaattagacattataaagtgatggtgctatcaacttgtaaagcctcaaattaaatttgctttttttctcaaacaggtttgagattttttttttttttttttcgagacaaagtcttgctctgtcacccaggctagagtgcagtgatgcgatcatagctcactgcagccttgaccttctgagtagctgggaatacaggcatatgccaccatgcctggctaatttttgtatttcttttgcagagacagggttttgccatgctgcccaggctgttctccaactcctgggctcaagcaatctgcctgcctcagcgtcccaaagtgctggaattacaggtgtgagccactgcacccagccgggtttgagattttataaaaatatttttatgtattcacttagattatttaaactttgcttgataatattatgacacgtcagggggtgactaaatgtgtttttaaagtgttatgtatttttttaattgtgataggaacacttaacatgagctctaccctctcaacaaatcttaaagtgcacaatacagtattgttggctgggcacggtggctcacgcctgtaattccagcgctttgggaggccgaggcgggcggatcacaaggttaggaattagagaccagcctggccaacatggtgaaaccccgtctctacttaaaatacaaaaaaattagctgggcgtggtggcacgcgcctgtgatcccagctactcaggaggctgaggcaggagaatcgctcgaaccgaggaggcagaggctgcagtgagccgagattgagccactggactccagcctgggagacaaagcgagactccgcctcaaaaaaaaaacaaagtgcacaatacagtattgttaatgatagacacaatgttgtacagcagatcactagaacttattcatcttgcaaatgtaatgtagtgtgtgtgtatatgtgtgttttatggtttcttagtttttttggttttgcattttgtttgggtttgggtggtggttttttgttgttttactattttttattgcatgcatgcagtgcaattcatttctataggctagtctggaaacctaatcactatttataacattatttttctgggaaaatatgatcccagttacaacattgacatttctttagagatagaaagcattcagaagatggagactgcccacatatattttacagggatttgggcaaacttttgtggacgagccacaaatcaccatttccctaaaatgttaatataatgttttaaatagagcagcattttactagtctacttatactatttatttaatctctgatttagtagtgctttcttaattaatacatcatttaaaaaattgtccctgctctatcttcacattgcttttgttaggcatttttatgtatgatgtggcccaaatatttataagtcataaaaatttatcttgcattagtataagcaaatctgactataatctgaagaatgtttatagtcagtatttgacttctcaactagcattggtgtacagagtaggtgaagaaaaaaaaaagaataaaaccgaccacgaaaatccccacctgttttagagaagttaggaaataaaagtgttcacaacagccgaggtcatctttaacttttcacttttcaaagcagactgttgactatgaaacactttatttgaggtagaaattaatattttaattgtatttctaaaataattaaatgtatgttcttcagaaagctgaactttggatcatttaggtttgtggaattttagaaatatatttagtttctttcttttttttttttttttttttttttggagacggaatctcgctctgtcgcccaggctggagtgcaatggtgtgatctcggcccactgcaaccttcacctctcaggttcaagcaattctcctgcctcagcctcccgagtagttggggttacaggcgcccaccactatgcccggcaaattttttttgtatttttagtagagacggggttttgccatgttggtcaggctgttcttgaactcctgacctcaggtgatccgcccaccttggcctcccaaagttctggcattataggcatgagccatcgctcccagcgtatatttgctttcttttcagtgtcttctccactctgaattggcagagtcaaaagaaaaaaagtttatgtccttgacttcctgctgaaggataccagcactgattctgttaatgaacagccctagtaaaacaaccataagcctttgtgagaacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtttggaaaataaaaatagatccataatctcatcaccctaacacagtagtttccatttttatatatcgttttctagtcactctccatttgcatataaatttttttatagttgtaatcaaaatgtgtcttttttaacctaccgttatataataagcatatttccatgtttctacttgatctttacaaatataacttctaatgactgcaatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaattagtgaagaaaatttgagtggaaagagaaaataaggctttaaaaaattgttctcttaggctccctggcatttaaccctaagagccattagcagaggcatgactttctctgtgtgggcagatgactatggggaaaaacattgatccggcaggcatttttgcattttctacattacttaaagaaaaattacttgtgtattcttaattaagtagtctaattaattagttctgttcttgaaatcgtttctatttgtgcctgtgtcattttgacatttctaaagggaattggcagtgctgttaatataaaagaaaacttcttattaactttttgtccatattgatttttatggtgagtttggaaaaggatattcagagatactcttccgttaagtttcataaatctgtaataaatatatgttgcagccttgtcattttgctttatatttttcaataaccttttaggttatagttgacagacttttagaacaatttgcttcatttttattaccatcaatactgttcttctatgtattaataacatttgaataaaatgaaaagtttttcaaaataattgttttgcctgccataaaaatccactcataatttttaacttaaaagaatttaacattttgtaaatcttgtgtcatgtttgtattattgtatatcttgtttattttttaggtattggaagaaatttcatgttaccctgagaataacgacgcaaaggaactaaagcgtattttaacacaacctcatttcatggtaagtaataattaaacttccatagaactgaaacctcactttcaaaagaagtttttaaactaccctcataaaatgtagccagcttcatctcatgcatttttatccatatcatatgagactattaagattacaataccaggtaataccaaatattttaagactgttttgtttactttgtgtcacaactgtaaagatactcttggtgaagtggcttttcagggactgtactcatcagacaagggattttctttcttatggggtagtcctttagtcactggaactgtttatgttacttaaaccacaaagaactaaaattagagacagttttcaataataaggaatcgtctgaatctaggtgatatattggaagaattacatctcttttgacaatgcaaaactgctgcactttcttggttcatttctactatatggaaaatggggataacacctgtatttagccaaatataaagctaaatagctaaacaaagctcaaagctcaaaatagataagatactttgctgtggaaaaaggtccatgcttatctacctaactgcaatacaaaaacacaattacagatggaaattcatgttgaatataccattttaaaagcattagccacatcagtttatgtgaaaaatatgtgaaaagtggaaaatttacctcactgccctttgggagaaaatctgacttaaaagccttgttcttataactactattacagatgatactttgaatttttatttatttatttacttttgagatggagtctcaccctgtcacccagggtggagtgcagtggcgcgatctcagctcactgcaatctccgccttccaggttcaagcaattctcctgcctaagcctcccgagtagctgggattgcaggcgtgcaccacgacacctggataatttttgtatttttagtagagacgaggtttcactatgttggccaggctggtctagaactcctgaccttacctcctgcctcagcctctcaaagtgctgggattacaggcatgagccaccatgcctggccacaggtgacacttttaaaataatagtaacagtataatatgtgtatcaaagcaattacctgtgagttattatatatatgctgttttatgatagtgtttctttttttctttttcttttttttttttttttgagacggagtttcgcactgtcgcccaggctggagtgcagtggcgcaatctcggctcactgcaagctcagcctcccgggctcacgccattctcctgcctcagcctcctgagcagctaggactacaggtgcccgccaccacgcctggctaatttttttgtatttttagtagagacggggtttcactgtgttaaccaggatagtcttgatctcctgacctcgtgatctgcccgcctcagcctcccaaagtgctgggattacaggcgtaagccaccgtgcctggccctttatgatagtgtttctaaacttttaaccaagttattgaaataaagtttttttcctaaaagtaactacctggaaagaagcaattaccatattcatccttcctaactctcccacccaagcattaaaggctgaattcaagtataatccttgagagtatttgactttattctatggtaacagcactgtccagtgaaatacaattaggatacaggttctaatgcctgtagatgagtgcatttttacaacctaggtgtataaacacagaacttcgttcaaatctcacctcttttatcaaggtatcttgtaacctctctacccttctcttgaactttctcttctctaactcttttccacttgtttgtattcacctgcataacattctaatgcttgctggcctgccagagcaggtctcttcccagtgaatgagccagggcaatttttctttgtccttccatatcccagcccagttttgttgttctcattgagcttatctcatttagtcattgtgattatctctatttcacagagcaggagaataaagaaactatatgctttattaataatcctcaaatgtgatgaatcacaaatatctgcagttaaattaccgttaatattaccttgttcactgtttcatgcatatgtgctgtgtttccccagattataattcattcccttttagacagcatgtcttctatagcaggggtctccaacccctgggccactgaccagtacccatccgtggcctgttaggaaccaggccacacaacaggaggtgagcagcaggccagccagcattaccacctgtgtccccctcctgtcagatcagcctaggcattaggtcctcataggagtgggaaccctattgtgaactgcgcatgcgagggatctaggttgcatactccttatgagaatctaatgcctgataatctgaggtggaacggtttcatcccaaaactattccccgacctctatcccccacccccacccaccctgccatccgtggaaaaattgtcttccacaaaatgggtccctggtgccaaaaaggttggggaccactgttctatattataaaagtggttaaagatgtgaattcagatgacctggggttgaactccatccttgccaccgtaactttatgaactctgactctgagtcaacctcgtggagtcagaataagaattaagtagctgatatatctactgtgcgtagcacaatgcttgacatatgcttagtgcctaatagatgttatctgatacctattattagttgctccatagtatctatcatgtatagggcacatagtaagttatcagtaaaacattgaatagattaggaacctgcccgtttgcagataggttaggctctccttggctgactgctctgtgcagtgttccatagctagaaacagatatataataaattttggaccaggcacagtggctcacgcctgtaatcccagcattttggaaggccaaggcaggaggattgcttgaacccaggagtcaaagaccagcaacattgggagaccccatctctacaaaaaattaaaaataaactagccagacatggtggcacatgcctgtagtcccagctacttaggaggctgaggtgggaggatcacatgagcctgggaggtcaaggctgaagtgagccatgatggcaccactgcacttcagcctgggcaacagagcgagaccctgtctcaaaaagtaaaaaatgccaggaactgtggctcacgcttataatcccagcactttgggaggctgaggaatgagagtcatttgaggtcaggagttcaagaccagcctggccaacatggtgaaaccccatctctactaaaaatacaaaaaaaaaaaaaaaatagcctggcgtggtagcacacacctgtagtcccagctacttgagaggctgaggcacaagaatcacctgaacccaggagacagaggtttcagtgaggcgagatcacgcctctgcactccagcctgggtgagagtgagactctgtctcaaaaaaaaaataaaaaatgaatttggacagacatgtctttctataaattgctaagtaaactcagctcaattcagagaatgatatagggccgtatgagaccaatagatctttcagatttgaagtaagctaaataaattaacatatacccaaataggagccttttttttcatcaaaatcattacggctcatatagcccattgtatgacagcttatctgtcttctaagtctcgatatgttttgcttttctgaagtcagagagaagttaatatgtgcattgctattagtaaacattttcagaaataataagtaatttttataatttattgaatacctagctaggtgcttaaaagacattttcattcatttatcaaataagtaaatgcctactgtatgccaggcacactatgccaggcactaaggacctagtaatgaataagacaaacaagatccctgccctcatggaacttccactctagtggaggtggggtgggaggacaggtaggagaggtagaggtagacaatgagcaagtaagctaacaagataatttcatatggcaataataactatgaagaaatgaaaggataatggtgcagagattatagtaaagtgggagctgctttagataggggaaagcccctctgaggagtagacatttgggctgagactcctttgaggaagagcaaatgcaaaggcccagagacaggaaagagctttgtagattcaaggagcagaagtcctttgtggctgagatacagttaacaagggagagagtggtacttcctgtaccaagagaggtcagcagaggccagaccaatttatttatttttttaatatataaaataaggccaggcatggtggctcacgcctgtaatcccagcattctgggaggccaaggtggacggatcacgaggtcaggagttcgagaccagcctggccaacatggtgaaacctgtctctactaaaaacacaaaaattagccaggcatggtggtgggcgcctgtagtcccagctactcaggaggctgaggcaggagaatctcttgaacgcaggaggcagaggttgcagtgagttgggatcgcaccactgcactccagcctgggagacagagcgagactccatctaaaaataaaataaaaaatataaataaataaaagccttccaggccattgtaaggagtctgcagttttctcctgattgcagtaggatgacactaagtgatggcacgcaggaaaatatctaatctgtgccttgctggagctgatgtgtagagaacggactgtaggggggataagagtttagggagaccaattggaaggctgttgtgagaggttgtagaggcttggagaaaggtgaggatggtagaacatgggcagatggggtttctgtgttggagatggttacatacaagaggacttgctgatggttgggatgtaagctggtgtaattaaacccatttcacaattccgagaggaaattgtgccctaacaaggtaaagagacttgcttaaggtcactcaccaatcagtggcctcaatgaggttcaagccagatcctgctagcgccaaagcctatgctcctaaaagtcagttgatttataatgctaatcagatttctaataaatttaagttgagctcattggtcattcctaaataagcttttgtgtagataatatcttatgtgggaaatataattctgagatatatatatatatatatactatattaaataagcttttaaatgctggggctttctatcttataagcgtttttaaaatcatggcttcaaaatcttggtatttttaaagaaatattaatagctaaggggaaatatgttaatacttacaatttttttattatgccaaggtttgggagttattcttggcatatttataatttcacacttatttgctcagtcatccgaatttttctttgctttctgattattataacatgaggatttaacattgaattacccaacactgaaaatccagatacttgtagatatttacagtaactaaaggaagaggaaataagggtaaatttaaacgactttaaaattctgtgttttttttttttaagagacggggtcttgctctattgcctagataggagtgcagtgacaccttcttagctcactgtagccttcaactcctgggcaaagcaatccttctgcctcagcctcccaagtagctgggactacaggcatgcaccaccatgcctgtctacttttttttattttttgtagagacgggggtctcactttgttgcccagactggtcttgaactcctgagctcaaacagtcctctttccttggcatcccaaagtgctgggattacaagcatgagctaccacacctggcctaaaatctgtatctttagaggtcatcataaaagaatattatctcactgattacttttttagttattccatttgaaaggctgactttttaaaaagaatatttcctttgcttattgcagctgtaaaatatgaaacattaaatagtcagattttttccactctagtctgatgttgttagttgtcttatacatatccttactatagtacaaaaagtgaaagtgtttttttcctattacacgattgttacgtagttaaaactgacagctatttcagcttagtgacaactgctcactcatacgtcttaacatatttgaagaaaaatgttcaaattttggtttccctattttttattttatatactcttttaagcttttaaaaagatagtctgtaagtggccccctttttctgtttggatatgaattagagctttaggttaagtttcgttttgtggtagcaatcatttacagtgccaaattgtggttaatatcgagtatgaccttatttggtgacatcatttaagcatttttcttttagagtccagtttgagtattattttatgattgtgggcttaatccttccttgtaaataatgcattaaatacaaatgtttgcttatataatttaaaagaatgagtagaggcctgtaatcccagcactttgggaggccggggtgagtgaattgcatgagctcaggagttcaagatcagcctgggcaacatgatgaaaccccgtgtctacaaaaaatacaagaatgatctgggtgtggtggcacatgcctgtggtcccagctacttgggaggctgaggtagaaggttcacttgagcccaagaggtcaaggctgcagtgatatgacgaacataattttagcaaatgaaatgttccagtttttatgttactgatttttgctttttgccctaaatcttggtttcttatgtgaccacaattaaatcagaaaaagagggatttgcccacataggacagcctctatacttgggctcaggagtaccagtacaaggtgcagttagggcactggtgaggaagccaaggtccccagggccatcatggagcactactttcaagctatatattgcttagtgccccttggtgctcctcacccaaatcccagtttagaccagccttctgagattgtgaaaatatctgccatttccattagaaactcaactgtgtataatgctcaaagcatattctttactggtaacaaatcagcattatcttctttatgattttaccagattgttaccttttttttttgcctcgtatgcatgcctttaaaattaaatagccaagtcatgacttttttaagccttttaataaaataacttaatttcagatgctatgagttattatttttaaagcaattttaactgcatttcattatctgcagatattaccgcacagatcccaaattaaaatagaaccaaatttatagttagcacataagaaaatataatctttgtataaagctccagacattttgatagctgtagattctctttgaaatagaaatgttcaaatatttatgcttaatagaaagggtttattatgatggcacaaaaagtgtggtgagtagaaggacattcttttttagggaaacaagggacattttattgttgaagttcaccaagctgacaaatagagatgtcagttcaaagaaatcactttctctttgttaataggctttgcaaaaagaagtcataataataattctcaacttattttttatttaaacaagtgctccaaaaaatataatgaacaaaaaaatttaacatatttagagtttgagttccatatcatacgtgatattttggaagattacgtttttaaggtacatctgtgtgtatttttttctttttctaaatcatatgctataaattattttcatcctttgggttatataaaagcgtcattgtaaatgccattgatgaaagatacttgctcaatactccaattattgcactatttctttttaaatttgtttcaattctaagccccagcacaaatttgccaactctatttatagatgattcttttagctaaattacttgaaattgtaccgtctaccttcatttgaacaagttagttgataacacctctgacccagataatcatcaaacacatctcttcattgattcactcatttattcacttacgttttaaaaaatctatttatcatgattgtcacaaaaaaattgagatagttggatgtcgatattacacactttatgttctctttagatgaatgatacctttgagaggaaaagaatgagatatgtttatagaataaatttgtcagccccatgtctacaaagaaaacatttaaaaattagccaggtgtggtggcatgcacctgtggtcccagctacacagaaggctgcaaaggaaggatcgcttgagcccaggagatgaagcctgcagtgagctgagatctcaccactgcactgcaccctgggtgacagagtgagaccctgtctcaaaataaataaataaataaaataaatttctgctgaaatagtaatgttattaataatttttttcttcataaaacactaggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttggagagccctcagcttagacatttctggtcctaatcctcatttagtaatctttgccagttatacaatattatcttgcagcacatggggggcatgcagatcacctcaccccttctggtactatccaggcaactctttggcttaagagcataggctacagcaggttttgggtgtcttgggcaaatcacttcatgtcagtggacctcagttggctcatctctaaaagcatagttgactaaatgaatgatccccaagatcccacctagctctgaaagtctaatattccattcattcattttatatattcattcatttattcaccaaatatttttgaagtccctactaagtgcaaatcactcttattagatgccagtgatctattgtcagataagacactgccccttactagagctcacgttccacagggctggctacattaaacaagtaaatttgtagcttagcacggtttacttaacaagcccagttatgacagagctggagaggagagaaagctgtgttggagaggcaggaaggtgtgatgttcagccaggcaaagcaggcaagaaggtagaagggaccacaagaaggaggcctcagagtgtcttgggatcattaagttctcaagcagtccagtgacagctgcttgattgtttgtgtgaagactcactacatagaaacatagactgaattggcccggtgcagtggctcacacctgtaatcccagcactttgggaggacgaggcgggtggatcacgaggtcaggagttcgagaccagcgtggccaatatggtgaaaccccatctctactaaaaatacaaaaattagccaggtgtggtggtgggtgcctgtaatcctagctactcaggaggctgaggcagaagaatcgcttgaacccgggaggcggaggttgcagtgagccgagatcgcgccactgcactccagcctgggcagcagagtgagactccgtttcaaaaaaaaaagaaaagaaaagaaaagaaaaaagaaacatagactgaataaaagcataaaactacatccctgagttactttttcagaaagcgtaaaatggtcttgagtctcccctaaaagtctccttccaaaagcttttctgtcttcgatgatcctagtgaagatgtatatttcttctccttttgatgggtttccatgaaaacaggaattattttatgtgaaatataaaatatatattttcaataatagagtgtcaatctctaatgcatttaatacaactttatttgctttcttagttgtcttattcaaagcattatgttactgtgcaggatattcctatatgatctgttttgtttttcagaccctctgcaatgtgtccattcctcaagggtgacatactcctgttacacacctctgttttcccatttgtagcatcatactcataatttttttttttattgattggaattcccatagttgcaagtgacaaaaatcaagcttgaactagcttacaaaatagaggaaaggcttatataaacagggaaaggccaggagtataactttcctaatatctcccctcaagctggtaggttcaggagtaggcacctaacccaagctatgccaatgccttccctagaatttgtgaacttgggaacagagagaaagtgaatcagttcctctctacagagaaatgtttgggacctacagaataataaatgttaactacagttggtttgaggtgaacttctcctggccatgggagaccctttttgtctcatttgctactgtacctagcagagtgcctgcctcatagtaaattcacgttaatgttagttgaatgaatacatacatctattagtttcaagggtggaagctgtattgtactatcatttcccttatgaaattagatttgacttacacactaatttacagcatttttccaggaacacttttcttagtaaccatacaagctgattgaatgtacaagttggaaatgaaacttgaatattacaattgaatcttaggactggaaatattttgataaaccagtttttcacattgctcacctaccacttctgaaaactgcaaaataggaacaatgcaaagttatagtttgtggagtggtacaaattaagtttagagtataaagtctcagatatttttatcaagctttctgacagtgttattctctagtgaaaaataaaagacacagtccctacccttaactgtctcaaattcaaggccactttccagcaagggagcctgttaaaaagtacagatttccgggctccattcgaggcctcctgagcttaaatctaaagagtgggtttaagagtcagcattatttaaaatttccctgtgtgattcttaggattaaccagatctagtgcaaaaaatatgtttatgaatgcttgttttttttaatagtggataatcagaaaacaaaaagtaatccactctgtagaatagtattctggcattaaatgtgactatagaactttcatttctgtccaagatagagtaactgggaccagatttatcctctcatttgaaacaacccaacatataaaaaacaaaatatcatgaaagaacagttttcaagacattagacatcaggcaactaaggacagtgatctcttgtgagacaggaaacaaggtgacccatatgaatgccccaccatgctgccttgagagagtttccaggccacagcacagggaggggaactaaggcagagtaggcagactccctaaattgaggggacagagctgagagtctggggtgaccaaagcaactagagttcataggacagagtactgaagaggagagagctgcacacagacagaacctcagatctgcagaggatctccctcaagtattcagcagagtatcgatcagtgcatgtctaataggaaattccccaacactgagaaactccccaacactctccactttggatggaaaaaaaaaccatccaaaaggattggaaggaacagcgcctgcactacctgttcccaccagtcagactagaaaaatttctaattcatggctcattgtgtagagcgctcagggaagtcttatctctgtaatgagaagtaattagccccaaactgacaactgctccagacctgcctaatggatcatgaacgcaagacccaaaggatcaaactatgtccgagtaactgatctaagtctcagaacaaaacataagaatatttttaggaatacaaaaacatcaactatgcaacaaattcacaatgtctgacatctaatcaaagattactaggcatgtaaaaagaccagaaagtgtgacctataatatggagaataatcaatcaaaaatgacatagaactgacagataatagaattagcaggaaaatacactatgggattaatggcagattagacatttcagaagagattagtgaacttgaagacagagcaataaaaactatcaaaaatgaaacacagcaagaaaaagaatttttaaagatgaaaagagcatcactgagccgtgggacaacttcagtcagcctaatacatggttaattggagttcatgaagaagagaggaaaagaaagaagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaaaaaaagaaaaaagaaattttacacacagaggaacaaacataaggatgacatcaatgtcttatcggaagcagtacaaacaagaacagtgtcataaagtactaaaaacaaacatttctcaacttagaattctaaaccaagcagaagtatctttcaagaacaagaaggcaaaataaaaatgtcttcagacataccaaaactgaaagaattcagcagacccacactataagacccacagtatatttaggacattcttcaggcagaaggaaaacgataacagattgaaatctgaatctacaaaaagggaataaagagcactggaaatgatagctatatgggtaaatctataagttctttttcttattacttcaatctcttataattggcaatttaaacaaaaataacaatgtgttttagagtttatagtatatggaaaaataaaatgtatgacaacagtagcacaaaggtcaggaagaaagacatagaagtactatatactattgtaaggctcttatatgatgtaggggggataagggttatatgtgaagtggtataatatcacttgaaggtacactgacaagttaaagatagatgctataaaccctaatgcaaccactaaaacaacaaaatgaagagttgtgagagaaaacacaggagagaaaacagaataaaaaataatacaaagaaaggcagaaaaagataacagaacaggtggaacaaatagaagtcaaatagcaagaatatatatttataccagactgtatcaatcatcatgttctgcttgtaaaacatgcacttcatacacaaagaatagtttcaaagtaaaaaggtagaagccaggtttggtggtgcatgcctgtagttccagctacttgggaggctgaggcaggaggatcacttgagcccaggagttcgaggatgcagtgggctatgattgcaccactgtgctccgcctgggtgacagtgtgagacttcatctcttaaaaaaaaaaaaaaaagtaagaagatagaaaaagatatactgtgataacattaatcaaaaggtagctggagtagctttattgatatcaaaatatattctcagaccacactgggattaaattagacatgaataacagagagagataaatcgccaagtacttgaaaattaaataacacaattctaagtaacccatgaattaaagaggaaatcaaaagggaaattaagaagtattttgtaatgaattaaaatgaaccacagtatgtcagaatttgcaggatgccactaaagcagtacttagggagaaatatgtaccattaaacacctatattagaaaagaagaaacatctcaaatcaatgacttcagcttataccttaaaagtaactaggacaaaatggagtaaattaaacccaaaatgagtagaagagaagaaataataaagatcaaagtagaaattaatgaaatagaaagcagaaagcaatagagtatcaataaaacagaaaatactttttctttggaaagatcagactgatcaggaaaaatggctatacaatcacggggaaaaaaaacatgaattaccaacatcaggcatgagagaaggggcatcactacagagtctacagatataaaaaggatgataaagaaataaacagatttatgccaataaattcaacaacttagataaaatggaaaaattccctgggagacagaaactactaaagcttatttaagaaggaataaactgaattgccctatactatctgaaaattgaatttgtagttaaaaactattcctcaaagaaaactccaggtcaagatggcttcactggtaaattctgtcaaacatacaatggagaaataataccaattctatacaaactcttttcaaaacattgaaaaaaaaggaatttttcccagctcatcctagaaagccagcattgccctgataccaaaaccagttaagacattacaaagaaagaaaactatagactagtattcctcatgaatgtagatgtaaaaattctaaacaaagtcttagcaaagcaaatccaacaatatatgaaaaggttaatatgttctcacttcagcagcacatatactaaaatataaacagtacagaaaatattatcatggcctctgtataaggatgacatacaaatgcatgaagtgttccagatctttaaaatatatatatgttatgatcaaatggtgattaacccaggaatacagctttacttataatagcccaaaccaggaaacaattcagtgggtgagtggataaactgatatgtccatacaatggaataccactcagcaagaacaaagaacaaactactgatacatgcaacatcatggtggaatctcaaaataattatgctgagtgaaaaaaacaacaaaaaagagttcatactgtatgatttcatttatgtacagtgcaaacaaatctgtagtcagcaaaagttgactgtatcagcctttggtcgacaactatattatcagctttttgattgtcacattagtagttgcttagggatgtggtggggagggtatggagggatgggagaatattaccaacgagcatgaggaaacttttgggaatgatagatatatcactatcctgattgtggccatagtttcatacatatgtcaaacttatcaaattgtacactttaaatatgtgtatgtcaattatatatcaatgaaaactgtttttaaaaataataggcaacattaaaaatggagcaacagggaaaataatcataattagaagatttaaaagcactatcggccaggcatggtgactcacacctgtaatgccagcactttgggaggccaaagcaggtggatcacttgaggtcggcagtttgaaaacagcctggccaacatagtgaaccatctctttccttaccctcgtctctactaaaaatacaaaaattagcttggcatggtggcaggcacctttaatcccagctactcaggaggctgaagcaggagaatcacttgaaccctggaggtggaggtagcagtaagctgtgattgtgccactgcactccagcctgggtgacagagtctcaaaaaaaaaaaaaaaaaaaagaaaaaagaaaagaaaagaaaatagtgtgttaaaagcattatataaaatatatgtatatagcaatcaaaaaatcaaaaatagtatttttgtcatggagcaattttgtgtgcgtggcatactggatggtcttctccattttccatattttctttaattttttttaactggtaattaaaattatctaccgcaaaatcacaaatattaagagaagcactgtcatagtaattctacttttgctgaactttttattttttttttaacagggaatcactttaaaaatgaatgaactaaatcattgtattgttgcaagaattatgcatgggggcatgattcacaggcaaggtaagtttcatatatatttctttctttgccttccttaattttttttccctgtagcctagtgaagaaaatgtttttgtttgttttgtttttgagatggggtctctcactatgttgcccagactggtcttgagctcctaagtgcaagcaatcctcccgtctcagctttccacaggtgcatgccatcacacccagctaagaaagtataaaggatacatataaagaatcttttaaaatcatctttgattttaatcattattggcctccattgtttcttattcatctgcacaggctccagcatgtagataatgaagggagaatatattagagttctgttagccagagcatctctgtattagattactacttacggggaccacgggagataaagcaaataattacactgggcctcacgatgtaggagagacatctgttctagagtaaaagatatatgtaaataaataaccatttaagaagtgttctctcattcatttaggaattagatatgctatttataaattaggacatcatagagttaaataatacaaaaattaaatggtaagagatgtcaaatcgatgattaaattattaatacctgccatggtgagtgcagtcattctgtggagagaattcactaagaactggaatagacaaagaatgatgtgggggttttttttgagacaaggtctggctcagtcacccaggctgtgcaatggcacaatcttggctcactgcaacctctcctcccgggctcaagcaatcctcccacctcagcctcctgagtagctgggaccacaggtgcacaccaccatgcctggctaacttttgatatttttgtagagatgggcttttaccatgttgcccaggctggtctccaattcttgaacccaagcaatctgcctgcctcctcccaaagtgctgggattataggcatgagctaccttgcccagctcgaagaatgattttttaagaaggtgcatcttcagttaactctcaaggatgggcagggtttggatatgtggatttaggctttttctttgaaaggattgagttatatgcactagtatttagaggatgttccaaaaatgattcttctggcagactctctgtctttgagatagggttatttttgtacttaacacctctttccttacccccagagagcgagaagtaacactctaagcattttagtgccttattctcctcttgagaataagaggagatcactgtgtacacaacatgatgtctggcatcattgctgctttcagaggaatccttgtaggcgtagagggtgtacagcactcccacaggaggatatttggttttagattccagtatgtgttttttgtttgctatttttaataatttttatatgttcagtaaagccacaacatcattctttcttttttttttcttttcttttttgttttttattatactttaacttctagggtacatgtgcacaatgtgcaggtttgatacataggtatacatgtgccatgttggtttgctgcacccatcaactcatcatttacattaggtatttctcctaatgctatccctcccccagccccccaccccctgacaggccccagtgtgtgatgttccccgccctgtgtccaagtgatctcattgttcagttcccacctatgagtgagaacatacggtgtttggttttctgtccttgtgatagtttgctgagaatgatggtttccagcttcatccatgtccctgcaaaggacatgaactcatccttttttatggctgcatagtattccctggtgtatatgtgccacattttcttaatccagtctatcaatgatggacatttgggttggtcccaagtctttgctattgtaaatagtgctgcaataaacatacgtgtgcatgtgtctttatagtagcatgatttataatcctttaggtatatactcagtaatgacatggctgggtcaaatggtaattctagttctagatccttgaggaatcgccacactgtcttccacagtggttgaactagtttacagtcccaccaacagtgtaaaagtgttcctatttctccacatcctctccagcacctgttgtttcctgacattttaatgattgccattctaactggtgtgagatggtatctcattgtggttttgatttgcatttctctgatgaccagtgatgatgagcattttttcaggtgtctgttggctgcatggatatcttcttttgagaaatatctgttcaaatcctttgctcactttttgatggggttctttgtttttttcttgtaaatttgtttgagttctttgtagattctggatattagccctttgtcagatgggtagattgcaaaaattctctcccattctgtaggttgcctgttcactctgatggtagtttcttttgccatgcagaagctctttagtttaattagatcccattagtctattttggcttttgttgccattgcttttggtgttttagtcatgaagtccttgcccatgcctatgtcctgaatggtattgcctaggttttcttccagggtttttatggttttaggtctaacatttaagtctttaatccatcttgaattagtttttgtataaggtgtaaggaagggatccagtttcagctttctacatatggctacccagttttcccagcaccatttattaaatagagaatcctttccccatttcatgtttttgtcaggtttgtcaaagatcagatggttgtagatgtgtggcattatttctgaggcctctgttctgttccatttgtctatatctctgttttggtacgagtaccatgctgttttggttactgtagcctcatagtatagtttgaagtcaggtagtgtgatgcctccagctttgttctttttgcttaggattgtcttggcaatgcgggctcttttttgggtccatgtgaactttaaagtagttttttttccaattctgtgaagaaagtcattggtagttttatggggatggcattgaatctataaattactttgggcagtatagccattttcatgatattgattcttcctatccatgagcatggaatattcttccatttgtttgtgtcctcatttatttcgttgagcaatggtttgtagttctccttgaagaggtccttcacatcccttgtaagttggattcttaggtattttattctctttgtagcaattgtgaatgggagttcactcatgatttggctctctatttgtctgttattggtgtataggaatgcttgtgatttttgcacattgattttgtatcctgagactttgctgaagttgcttatcagcttaaggagattttgggctgagacaatggggttttctaaatatatagtcatgtcatctgcaaacagggacagtttgacttcctcatttcctaatcaaataccttttatttctttctcttgcctgattgccctggccagaacttccaacactatgttgaataggagtggtgagagacggcatccttgtcttgtgccagttttcaaagggaatgcttccagtttttgcccattcagtatgatattggctgtgggtttgtcataaatagctcttattattttgagatacgttccatcaatacctagcttattctgagtttttagcatgaagggccattgaattttgttgaaggccttttctgcatctgttgagataatcatgtggtttttgtcgttggttctgtttatatgatggattacgtttattgatttgcgtatgttaaccagccttgcatcccagggatgaagctgacttgatcgtgttggataagttttttgatgagctgctggattcgacgttccagtattttatggaggattttcgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaagaatatatattctgttgattttgggtggagggttctgtagatgtctattaggtccacttgttgcagagctgagttcaggtcctggatgtccttgttaaccttctgtctcattgatctgtctaatattgacagcaggaaacatcattatttctttaacttctctttgttatattactgcactggctaggaccggcagtctttcaaggagtggtatagtagacatcccgtcctattcttgtttttaaacggaatctaaagttagccgggcatggtggcgctcacctatagtcccagctactcaggaagctgaggtgggaggattgcttgagcccaggagttcgaggctgtagtgagctatgatcacgccactgtactcacctgggtgtcggagagagaccttgtctctagaaaaaaatgtttttttaaaaaggaacctttccaatatttcttcattaagaataatgtagatttttagtacatgccttttattagggctaaagaagttcctttatattcttagttgctgagcattttaattgtgaatgggttttgaatttaatcaaatgctctttcagaatctgctgagatgatcatttgtttttttccttttatctgttaatgtggtgaatgtcttttaaagatttcctaatgataaactacccttgcatttctcagataaactcagcttagtcattacatattatcttttttatgtactgcccgactgtctgctaatgttttgtttataagatctcagtatgtgcatttatgagtgagactggcccgtagttaattttcctctcttgtatttctctgattttagtttcaaagttatatctacttcacacaatgacttggagagtattccctcttcagttctccgagagattttatataatattggaatgatttgtgtcttgaaagtttggcaggacttgcctgtaaagtatcacagcctagtgttttggtttttagttttaagaaagttttgtttttgttttttaacaactgcttcaatttctttaacattaaaaggccatccaggctttctatttcttgagtgagttttggtaaattacattttcctaaaaaaaaataagttttaaaatattgcagagagcttcttcatagtattctctcatctttttattctctgccatctttgtcattatgcccctgttcatttctaatattgtttatttgtgcctactctttttttcttgatcaaccttgccagaggtttgttcagaaacccactctgggtttggttcattctcttcattatatgtttattttctgtttcattgttttatgacctaatttttattatctcctttttttttaactttctattggttttggctaactttacaaatttgacacatagttcatttatttccagtcttttttttttttttttttttttttgagacagggtcttgctccatcggccaggctggaatgcagtagcataatcatagctcactgcaacctcgaactcctgggctcaagtaatcctcctgtctcagactcctgagttaggactacaggcaaccacactcagctaatttttttaatactttgtagagatagagtcttgctttattgcccaggttggtctcaaactcctggcctctagtgatcttctcgcctcactcagcctccgaaaacactgaggttatagacatgagccaccatgcccagccttcttttcttttctttttttttttttttttttttttttgagatggagtctcgctctgtcgcccaggctggagtgcaatggtgcaacctctgcttccgggttcaagcgattctcctgcctcagcctcccaagtagcggggattacaggtgcccaccaccacgcacagctaatttttatattttagtagagacggggtttcaccatattggccaggctggtctcaaactcctgacctcatgagctgcccacctcagcctcccaaagtgctgggattacaagtggaagccaccatgcctggcccagccttcttttctaatatgtgcctttaagactaaactctccctctaagtactgtcttaatgtatcccaccagttttgacatgacgcatttttataactcagttctaagtatttttatatttctattatgatatttttcattgacctatattatttataattgtctgttacttttcacacttaacaggattttctgtatatctttttgtaatttacttctaacttaattacattgtggtcagagaatgtagtctgtatgacaccatttctttgaggtttgttgagacttgctttatggcatagcactttaatcgtttttataaatggcccacgtgtacttaagatgaatgtttattctttaattgttgcatgcagaggtatctttttgtaatgaagccaggtcagtgtgtacatttctgcacaatttataaataaggaagcaacattgtaaataacactctaagcattggttcttggtcatttctttctagctgaagtattacaagatgctgaaatgccaaccaaaagattaaattatctttaacagaatttgctgttgtgtagatattatcatgtcacaactcttggaaaattgacaaccttcgtatcatatctggtagataacgatagcagccaacactgtcatggtgcttggtatgtgccaagaacagttctaagccttctgcatttattaaatttgtttagttcttaaaacaatcctatgagatgggtactattttcatctccattttacaaatgtgaaaactgaggtatggagagtttcagtaatttacccaagatcttaaagctagtaagcaaggaagctggaatttgaacccaggcagtctggatccagaagccatacttttaaaccactatacataccacctctctcagaaaaatagatttctgcagccatccatcaaaactgtgccttccacaagtagatatatctgttttgatgaggttactacatgagttaaataattctgctgcaaccaaacttgtacctgcctctgaaatattggccctcaatattcaacttagtttttaaaaattacattgatgcctctggattttgttactatgaaagcatatatcatttcatgtttataatgttatataatttcttaggtacacttcatgttggtgatgaaattcgagaaatcaatggcatcagtgtggctaaccaaacagtggaacaactgcaaaaaatgcttgtaagtaaatgaaagtttttcctttcctaaaattgacttttactttgttagcttgtttttaaatatacaaataaggagtattcttctgtaatcagagaatttctggtaccatatttatgtggacttgaacttatataacattcataaaactgacaactagaaaaatgttgaaatacaatagagtttacaaacattttgcctgtctttagcagtgtgggctttaacactctccttttatcctttatctcctgtttcttaccaagcagatgattaaagaaaaccttttcagtgtttgtacatgtgaactagtttctcactgacctcaactctcctgacatcagcagtgtcagaaacctctttcctgttgagctgagtcatagccagctgtcgtggatttctctacagcatagaagggaggaaagccacggtagaccaggccatttttgaccatacatatccaaaatctgtattcaaattaggctttggattttttaaaaaggcaaaatgacagcctttgcctatgttcattgtcatagcaagcagacagaggtgtttggggcctctgatcccttttcccactgcagtgtagtagcacccaggttatgaatacctattaagtatgaaataagcttcacagactcaccaaacatttttttttcttttttttgagacggagttttgctcttgttgcccaggctggagtgcaatggcgtgatctcagctcactgcaacctctgccccccgagttcaagggattctcctgcctcagcctcccaagtagctgggattacaggcatgcgctaccacaccctgctaatgtttgcatttttagtagagacggggtttctccatgttggccaggctggtctcgaactcccgacctcaggtgatccaccagccttggcctcccaaagtaccgggatgacaggtgtgagccaccactcccagcccaaaatttttttttaaaaaaaagccaaaattaataagcaaaaagtggctgggtgcggtggctcatgcctgtaatcccagcactttgggaggccaaggtgggtgaatcacctgaagtcgggagtttgagaccagcctggccaacatggtgaaaccccgtctctactaaaaatacaaacattagcaaggcatggtggcgcgtgcctataatcccagctacccgggaggctgaggcaggagaatcactggaacctggaaggcagagtttgcagtgagccgagatggtgccactgcactgcagcctggatgacagagcgagactctgtctcaaaaaaataaataaataaaaaatttttaaaagtaaaaagcatattctatggggtacaccattataatgtggcatactcaatgtaatttttatgtaattacctagtctattgtctaattcaatgtatattcacttttgaaaggcatgtcacttagaaagttttgtattcacatctataaaaaggtgaccattgaagatctgtgagaccattgctgtatgagcaaaaggcaattggctgctgggcttttcccaggaacttactctactgttaactcgagcagtccctgcttcatgactacatttcattttccggctatgtgctctcagatggcttgtgctaattgcccccatgtgttttgagtggcttcttacatggttttgtgaacaattgtttgtaagaaaacttttctttctttcccaccaccccccctccagagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaaacggagtgtctgagggaaaaaaactaaaggccataattgcagtaatatttccaggaagttcattcacttcccttgttaagaaatcacatagatagttcttctttctaaggatctgagaagtgatctatttctgttgagatacagttgttcatacaattgtgacaggtctctagatggaagttaagtctgcaatgaattgataattgacttcactagagggaaataggcttttgcaaccttttgtaaaactgtttaaatttagaatggtatgtgatctgtaaacaagtaagttttctagagtaatacagccccaaagtttctttcttaaaataggcttatcctgtagaaattatagttcttccaacctatattattcagttttgtgttggttgttaaatgagattcaaaaatctattctttttgtattggaaatataaatgggcataaatgatatcatcctttggtcattgcacgttcagctcgagtgttatttattgaagcttgttctttcatgtgcatcttccgagagtatgtgcatcaatatgaagtacacacttcctaaagtttatttttaagactgacaggtaacttattggatttgtacttaggagaacctgagagagaattgtaatacttctagtctctagtgatggtgtaaatttcataagaaaaatcagaggcttcatattttttaaaagcctattgaagatacatattaaaatgtatagttttgtcaagtatatttttggtgagccatggcaattgaggtgtccgttgtaacgggtcttgagctcctcttggtggctttttatggaacttcaattaatagtatatttcaaaagaaaatgcagaattgcttctgttccaggattcagagtattgaaatttgttacctagaacacaaactttgctgggaaacaaagaatgtcacacttaacattctatgtaaataattttaatattccagagttacagatgtccttatatcatttctcatctgttgaagaaatttagtaaatacaattgacttttgtctttttggctaactaaccagaaggtactgttagttattaatacaacataagtttctctttttttttttaaatggtcgaactagtttggggtggaaccagtatcatagatgtaaattctatgttcttgagtaagaagaacccctcttaccttctttgcctttgaatagtagaaaaaataatgatacttctctcctagctccacctccagcctttttggccctcctgttccctggcagaattcaagcttgtggttggactcttcccagctagggcaatacttcaaaaaaaaaaaaagaaggctctctggccacctgcatctgcatcccccaggtccttggttaaagagtagacccctgcccctcaccctggctctactgacttgagtctctgcgggtggcacctggagatcagtcttgctcactaacatatgagaatgctcttctaagggatctcattacctttaaggctgacaggttctagaaatgctcttaagtcatctggggaaaaaaaatgtcttttaaaaagacatgcacatttctaaggcttaaaagaactctacagaagcaaaaattaaaaagtacttatttccttcctctccttgttcttatcgttaaagttgatttggacactaagggaatggagcctggaaaatattttgagtgtatagaatagtagagagaaagcaagcgatagaggagcctggatataggaagagtggctgtggctcctaggatctttgctggaagtgtaatattgttataggcttgagattattgttttaatcaatctgctaaaatagtcttaaaaaaagagttcttctctgatgtatatctcttttacccttactagtaataatatttattctataatagaaagattctgaggtgattgtaacatgtgaaatcttaggtttgtttctcttcagattgggtcagttagtaactcttgacacaggtactaaaaattattaaatacttttcaaacctaatctttaataaaaattaggcagttgggatcttcagcacgataatttatggtaatgtttgtcatcttatacttgatagggttttaatatcaagtcactcttctgggtctcattaaaagaaagaaaaggtatagaatgttagagataggaaagaattgattaatgaatgacacagtcatcacttaaaatatgtgagccttcgaactgcaaaatttttttcatacttctgtgaaatcatgcaagcaagtcagtatggcacctatacagctcaaacctcaaaggaaatggttgtcagactgtggttgttactgttgatgtaaatatctctgtgtttctgtgctggtgttctgtgttaatgaaccttgtgtcttatttcagagagattccccttccacttccagacagtccccagctaatggtcatagcagcactaacaattctgtttcggtaagaactttagctccacacagcaaagtgtgacaattttgttggtgctcacctgccatgagtgttctagttacatgtgttcagtggaaatagtgtcttctgctgatatacaaggctactacagctacaatgcactttactcctggaaaatctttttcaacatttccttctcattaaaaatccccttcaatagttaaatttgaagaaatatagttcaagactgctttggtcattctaaaaatatttctatgccaccccatttgtatgtatgactttgctcaaacctatgcaaaggatgtaaacggaaatttgtttaaacttctaaatattttttaatttgaaaaagataaatgtaagaattttgcagagtaggcatttgggtattcttgggctttgtagttttctattctgagtgatatcagcaacatgttttagtttccgctatctaagtttacgaattggtgtgccctctgttattgtggtacgtgcacatatttttgtgaattataagccttgcctggatatgaaaagcaaaaagaactggcttcaaactgcacttaagccacgctgttatcacatctttaacacaaagtactttatatttgacttgaacttggagttttaaattttttcagaactatccattttggaatatagaaagaattgtttttaacttatttaaacaaatggaagcacttaacaggtgcagactggcaatattttggttgctaatactgctgtttatgacccagttaaaattattgagagttctaataatgcagcagtattcttctttcctgacttttaatttgccctttgagaatatatcaacttttttatcaggtaaaattgtaaataatttagaaattatctcaaatggaatgatattctaagtatatcgtaagagaaattatgaaagaaaattgtctatgactttattttcaactttaaaataggctaccaaaggaattcattcataacagttaacatttaatacttttaagatgatgaaaagccatatagccattgaatttttcaaaatctaaatggttgcagtgactaagttgaaaagggcaacagctccttttatttattttttttttttaataggctgtttcacttgcagtggcttttgtgttgaagatgctgagttgtttcttaagaacacattttctctctgcttaaacttacctgctttcttcagcttgctgctaaatggcctgggtttgactttttgataactcaacatttctgataaatggaataatgtatattatctctttacaacttaaatctagctcatttttttaaccatattgtaacagaacacacaaattactttgtactcttgaaaaataaatgaaaatttttctcctgggttggctttattctacaggacttgccatcaactacccaaccaaaaggacgacaggtgaatagatatcctctatagaaacttctctaaactgagcagctaatagccaatcctttattaaccctttccatcccataatgtttgcattttggaccataacatttgagcattgagagcttgtaccatttcattttaacacattacacatgactaattctctataaagaatttttcctcacatctttgtagctgtaatggttattgtaatttcaacctgataattttatattaatggttaagaattcagcctttgggggtggctgtgggcctgcctctggcatgcaaaagaattttaaaggttataaaattcttagaattctaagactaactaaaaagttattcttaaaatgctgatgaacatttttaagcaaaaattttctgaagttgaaagctttttcttaaatttgtatttgcatgtgtatttctaaaagccatttgcaatgaaaaataagaaaagaatataaattatcttagcttcacatcctgatatacctgtgttagttcaaacatgaaaagttaagtgctgcctaacactggcaagtaactttcaaattgccagcactttagaggtatagattttaaatgcaaatgcagagacttgtaattttataggctggattgctgaaaataaacagaaaaatcacacagtggttccaaagtcttcaggttggttttacagtgacttaaacattaatattcaattttaatttcaagagatagaatttttatgggatttttatcttgaaatatggtattaaaaataatcagatttagtgttaagatatgtataaattagtacctgatagaattcacccataattttgtcttaagactgtataattgatggaacattgggtatgaattaccttatcttaaagcatttaaaaaataaaataattcataaaatgctgccatataataaacccttgaatgctaatctatttcctaagtaaactcacatatcataaaactcagagccttgaactatgcatgtcttgaagctctgtgctgatttcaagtgttacattgggggaagctagggttcaaattcatttttattctctcagaagagtaaaatacaaacctaaaacctaaattagaaaaaaatgaagctttttttaacttttaaaaaattgtttgagttacacttaactttatcagcaatgtgtagacacactgccagttgtcatataagcattctacagcaagataccaacccagagttcttgctaattttatatcgtgtgctgctttagggttaaaacctatcctgactgctagtatttatggcttaaaggctgccacgcagtcatgacaacgtatccataatgccagcatcaccaatgcaggtttaaaaaagagcgagcatacttttctataattagaggcctattctgttacagtaaaagcataaattaagtctttatttttattaaacaagtatttcaagtgttccttccaaataaaaacagcaaagttttgaagctatactcatcaaagattactagtacattgtttctagcggtagaagttttttgtgtcgtatttccatgcatcgtttttgctttcaccatctgatgtcctgtttgtattgtaactgttggtgtgtggttatgacattagagctaacttctctttcacatcactatggcatcctttcttacgaactcctgttttatagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggtatgtttttatgcgtgttttgctttgcttggttataaaaacaaagccctgaccatccattttccaattttatattattttagagtgtaaaacctgtttgatatattccttcctttacgagccaaacaaaatttaaattagtcatccaagaattctatatcttcagtatctagtgagatcctagttgcagagtcagggcttcattttacacaaaaagaaaggaaggtctggaaagagattggatgagcagccctgagccaagtcatggtctcacagcagagccctccactcctatatgctgttataattgttttagaatggcattaaaaaaatgtacgttctccttgcccttctacatgctttcatgcccatcccattcccaccaccagcaaaaaatgtaggtgcagtgcttcagtgtcactcagagtatttgaagataaaatgtatttcactgttagaaggaggtagtcagaagctttgttctttaccttgccagtcctttaaaaataccttttctgctagaaagtttaagccctaaaagcaggctaaagttaggggttttaggcactgtttttaactgagagaaaaggagtcacagatcactgtatattttgataaaatctatttctgctattattgttaccgtttccttagttgaactgtcttttggaaaatattgatggttttacctttgttggtacttgggcaatataccagattatttctagcacaaaagagataatgtctgagttttgtttcatgtggcaaaaaataacagccattaagcatcctgccagttcctcctaaaatacttgaacccagctaaaagagaccaaagacattgagtccatagaaatttctacctgcttttatctatttttctcactagttaagagatttctcagttaatctcttttgcttgatcgcctctttcagctatcccatgtttccccaaaaaatagtattaaatttagaatgttggagctgatgaggacttcagatgccatcattttatacataaggaaacgtgggcccaaatggagaagcagcagccttccatctggcattgtctttcagtctgatcttcgagaaacagttcaagcataagcaggaggaaagcaatctttaagtcgttgccgtgatgatgccattatattcttactgatatttacattttacagaatgtcttctttaatgttaccatatattatgggcatttattgaaaataattgtgtagattccagacctcttctgcctagtcagatcatctatataaatgtttcaccaatttctagaactctgagtcctctggaggaatcctgagtgatggcagtgcaaaaagcagatttgcttcctatttcctgtaatggtggatgagattatttggataaatcctcctgatgaaaaaaaatgaaaagtgccgcagaaaatatgtttttcaaatgaccttgaaagcactgaatagctgaaaaggtatcaggggccaggcatggtggctcacacctgtaatcctagcactctgggacgccgaggtgggcagatcacttgaggtcaggagttcgaagctagcctgaccaacatggtaaaaccctgtctctacttgaaataaaaaaaaaaaaaaaaattagccaggtgtgatggcaggcacctataatcccagctacttgggaggctgaggcaggagaattgcttgagcccgagaagtggaagttgcagtgagccgtgatcgcgccactgcactctagcctggacgacagagtgagactctgtgtccgggaaataaaaaaaggtactggggagctcagtgaccaattttttttttttttttttttttttttgagacggagtctcgccctgtggcccaggctgcagtgcaatggcatgatctcaggtcactgcaacctctacctcctgggttcaaacaattctcctgcctcagcctcctgagtagctgggattacaggcacccgccaccacatatttttagtagagacagggtttcaccatgttggccaggctggtcgtgaactcctgacctcgtgatccacccactttggcctcccaaagtgctgggattacaggtgtgagccaccacaccaggcctcagtgaccaatttttatgtgaaagcctttaataagaatgataagtggaatatcagagttaccaagtggcccattttgcaaacagggcatttgtcattactgaacacttctgtgccagagaaccaaggttaagatctaaggccagtacaagttggggaatctgttagaagaccctcctcattgttaggagtgcaagaggcagtccccccaggctaaaaggaaacagataagcatacccttatttcccttcaacaccggaggactatagagaaagctgccttgtcactgagcaaagcaaaagatgaggaaattgggaacaaacttccaaattgtggccaccagtccaccttgaatggatttgcacccaggtacacacagcctggggcagccaggggagctgaagccatgtacttgatttgaagtttcccctttctttactaatagtttcagatgtatggtataaacagaaagtctctgaaggcaaacacttttatcctaacccccactaacttcatcctatccgcccgacataaactttttccagggcagtagccagcaagtcaaaattatcaggcacacaaggaaacaagtaagacccaacagaaatgacagatagtagaaacaaacccaaacctactgcatatattggaattaagagacaaagattttaaaaataagcttacgaagttggttcgtttgtttttgagacaaggtattgtgctctcgcccaggctggagtgcaatggcatgatcatggctcactgcagcctcgacctcctggacccaagcaatccacccacctcagccttcccagtagctgggacaacaggcgtgcaccaccacacccagctaatttttttctttttcttttttttttttttgtagagatgaggtctcactatgttgcccaggctgatctccaactcctaggctcaagtgatccttccaccttagcctcccaaagtgctgggattacaagtgtgagctaccacgcctagcccaggtttttaaaaatcaataataagcttgtaaaatatcttcagagagcagaaaaaaaatgttaatgacatagcagattttaaaaagaaccagaggaacatccagggggaaacatgcagtaacaaaattagaatctcagtggtcacacctattagaatggctaacatttttttgaagtttcatcagtgggtaaatagatcaataaattgtgatatagccatacaatggaatgccactcagcaataaaaaggatcaaactattgatatatgcagcagtatggatgaaacacaagatcattatgctgagtgaaagaagccaggcaaaaaagagaacacgctatatgattccatttacataaacttctggaaaatgcaagatgggggtggagggagggaggaattacagaggggcatgaggaaattctggaggtaatgaatatgtttttctttttttggagacggagtctcgccctgtcacccaggctggagtgcagtggcgcaatctcagctcactgcaacctctgcctccccggttcaagtgatcctcctgcctcagcctcccgagtagctgggattacaggcgcctgccaccacgcctggctaattttttgtgtttttagtagagacagggtttcaccaggttggccaggctggtctcaagctcctgacctcaagtgatctgcctgcctcagcctcccaaagtgctaggattacaggtgtgagccaccgcagcacccagccatttttattttttattttttatttttattcttctaaagtcaaggtccctctctgtctcccaggctggagtgccgtggtgcaatcttggctccttgcagcctggaactcctggattcaagcaatccccctatctcagcctcccaagtagctgggattacaggcgcccgccaccacgcccaactaatttttaaattttcgatagagatgagatctcactatgttggccaggctggtctcgaactcctgacctcaggtgatctgcccgcctcaacctcctaaagtgttgggattacctgtgtgagctaccacacctggctaagaatatgtttttcttgattgtagtgatagtttcatgggatgtttacagatatcaaaactgataaatttgtatactttaaatatgttcaatatattgccaaaaaactgaactgttaaagttgcaaaatatatagagggagaaaaggattctaactgagatgataagaaagaggcccactgggcagtgtgtaccccaagacctgaataggactttgggggtataggaagctattcctggcagaagagaaagatcaattttcctttgcttggaaactgaattggcctctgggatgtcagtgggcatccaatactaacaagaaagatttgaaacaattgtatcagccagacccccaaaactttgatcaaatatattgctaccaagtcacattcttcacattttctagatgagaaatcagttttttcggacccaaatgccttactctaggcacatcaatttagcccttcaatatattttagctcccggactctgtcatccctccccttgccttgcctacaagatcctgatctaagccatcaataaattggtaggcatgtgtttgaaatttccttccaggttgaccttaaccctaacacggtttctgtgcacttactgagctaaaagagctaatgtttatttctgcagtgtctggtaaaaatcaatttcattcctctgtcatcacaccacatgagactatgccacaattttttcctgggaacctgtatttttgttttaagcttaagaacatttattataagatactctctacattgtaacataagcttcacaaggtcacacgattttgtctcttaacctgtcaaaaaattcctcaattctgtttgtttccaaagattctatgccttttagttctgactaatagcacatattgacttgcaccaaaagaatccccaaagcaagcctttatcagcctcctctgtatgccacgtgggtaatatatggagatggactttgatactattactgagagttcgcagtattttccaataaatgtctttcccccaaccaaaaataaatacataaaaacttcagtgaacaagagcgagtaagagatatggaagacagcctctttaagaaaatagaaaataatacttcccaaatcattttatgatgtcaacattaccctgataccaaaattcagtaaaggcagttcaagaaaagaaaactacataccagtatctgtcatgaacacagaagtaaaaatcctcagcaaaatattagcaaattgaatccagtaatatattaaaaagataatatattatgagccagtggaatttgtactgggaatgcatagctggttcagcatttgaaaaccaatcagccgatccactagattaacagactgaagaagaaaatccacatagtcatatcaatagatgcagaaaaagcatttggtaaaattcaaaacccaatcagattaaaagtctcataaactatgaattgaggggaacttaacctgataaaggacatgtatagtaaacctacaactaacattactagaaagggaaaaaatttgcagatgatatgattctgtgtgtagaattcaaaggaatctgtagacaattagaattagtagcaaggtttagaaaggttgctgatataaaatcaatatacaagggactgggcgtggtggctcacgcctgtaatcccagcactttgggaggccgaggcaggcggatcatgaggtcaggagatcgagaccatcctgactaacacggtgaaaccccgtctctactaaaaatacaaaaaaattagccgggcctggtggtgggcgcctgtagtcccagctacttgggaggctgaggcaggagaatggcttggacccgggaggtggagcttgcagtgagccaagatcgcgccactgccctccagcctgggcgacagagcaagactccatctcaaaaaaaaaaaaaatcaatatacgaaaatcaattctatttacaagccacaagcagaaaataaaacttttaaagggtaccatacataacaccacttgcaacaccataatattataaagtgttcttgcacacacacaaaacaaaactggatctgattaggcctctaggttttattacctatttgcaggaaatacaaaggacagagagacatactaaagataccacagggacacagtcagaaaaatccagactctacagaaactaaaggacaaactagtttctacaacaaacaaattgtaagaaaagaaaaaggagggagagggaacctatagattttaaagggatttcagaagaaaactgtactcttggatttgttccaaaataatctatgataaggtggtataaataaagccaggcgcagtggctcacacttgtaatcccagcactttgggaggacgagacgggcggatcacctgaggtcaggagttcgagaccagcctggccaacgtggcaaaaccccatctctactaaaaatacaaaaaaaattagctgagcgtggtggcgggtgcctgtaatcacagctacttggaaggccaagacaggagaatcgctggaacccgggaggcggaggttgcagtgagccgagatcgtgccactgcactccagcctgggcaacagagtgagactctgtctcaaaaataaataaataaataataaaaaaataaaataagctatgactaataattgtcaaagcagggttgtagatagctgggtttcattacactatatccttgtatgtgtttgaaagttttagtgttacaaagtgtttcttaaaataccatttacaaagcctttattaaaaaatgaccaggcgtggtgactcatgcctgtaatccctgcactttgggaggccgaggtgggcggatcacttgaggccaggagttcaagaccagcctggccaacatggcaaaaccccgtctctactaaaaggaaaaaaaaatacaaaaattagctgggtgtagtggcgcacacctgtagtcccagctactcaagaggctgaggcatgagaatatgtcaatcctgaaaggtggaggttgcagtgagccaagattgtgccactgcactacagcctgggcaacagagagagactctgtcttaaaaaataaaataacctaggaataaatctaacaaagatgtcaagacatttacagaataaattataaaatttattgagaccgggtacagtggctcatgcctgtaatcccagtacttttggaggccaaggcaggcggatcacttgagcccagaagtttgagactgtcctgggtaacatagcaaggtccagtctctacaaaaatacaaaaattaggccaggctccgtggctcacacctgtaatctcagcactttgggaggctaaggcaggcggatcacctgaggtcaggagtttgagaccagcctggccaacatggcaaatccccatctctactaaaaatataaaaaattagctgggcgtggtggcaggcacccgtaatcccagctacttgggaggctgaggcagggagaatcacttgaacctgggaggacggaggtttcagtgagctgagatcgcaccattacactccagcctgggcaacagagcgacactctgtctcaagaaaaaaaaaatgggtgacatgcacctgtagtccgctacttaggaagctgaggcggaaggatcacttgcacccaggaggtcaagatgacagtgagccaagattgcaccaccgcattccagcctgggtgacagagtaagacttcgtctcggcgggggtggggggggaattatatctcgagacatttaaaaagatataagtaaatggagagacatactgtgtttaaggactggaagactcaatattgcagggatgtctattcttcctagatagatttcatagataagatgcaatcccaacagttttgaaattgacaagctaagtttaaagtctacatggaaatgcacaaggtcgggaatagccaaaatgctcttgaagaacaaggaaggaggtcttgctctaccagataccaagacttattataaagctatagtaaacaagataataaggtatgggtttagagatgctcaaatagaccagaaaggaatagagaacctgaaaacactctcatacgtaaatggacacttgatgtgtgacagaaatagcactgcacagcaatgaggaatggacaggcttttaaataatgtaggacaattgggtatccattaggaagaaaaaaggaattggacccctcctttacaccataagcaaaaatcagttctaggccgggcgcagtggctcacgcctgtaatcccagcattttgggagaccaaggcaggtggatcacacgaagcaggagttcaagaccagcctggccgacatggtgaaaccccatttctactaaaaaaatacaaaaattagccaggcatggtggcacacacctgtaatcccagctactcaggaggctgaggcatgagaattgcttgaacctgggaagcagaggttacagtgagccgagattgcaccactgcactccagcctgggcatcacaaggagaatctgtctcaaaaacaaaaaaaaaacagcagtactagtacattaatacccaaaatgtaaaagacaaaactataaactttgagaaggtaatattggagaatatcttctgggacaaggaaggatttctttttatttttatttattttttatttctctaaagtcagggtctctgtctcccaggctggagtgcagtggtgtagtcttggctcactgcagcctggaactgctggactcaagtcatcctcctgcttcagccttcctagtagctgggactacaggcacgtaacatcacacccaatcacacccagctaatttttttttgtttgttttttgttttttgtttttttttgtagagatagggtcttgttatgttgctcaggctggtctcaaactcctggcctcaagtgagcctccctccttggcctcccaaagtgttgggaaatcccctgctaaggatttcatttttgttttttttttttttttttttttagacaaggtctcgctcggttgcccaggctagagtgcactggcataatctcaaatcactgcaacctccacctctcaggctcaagtaattatcctgtctcagcatccggagtagctgggactacaggcacatgccaccacacccagctactttttgtattttcagtagagatgggatttcgccctgttgcccaggctcgtgtgaactcctgagctcaagtcatccacccgcctcagcctcccagagtgctgggattacaggcgtgagccatcgcacctggctgaggatttcttaagatatcaaaaatacttcccattaaagaaaagactgataaatttgactaaattaaaactaataagttgtgttcatcaattgataccataaagagagcaaaaaggcaaaccacagagtagaagaagatatctgcaacacgtatattaataactaacaaaagcataatatctagactatataaagaatttctacaaatctatgagaaaaagacaactgaacagaggaacggtcaaaagacttgaacagacacttaacgaaagaggaaattcagtagccattaaacatatgaaaaaatgatcagtcttactaatgagtgaaacgtaaactaaaatgtaaattaaaaacacagtggtattccattattcatccaccatgatggctaaagttaaagacagataataccaagtgttgccaaggaaatggaacaataggaatgttcatacactgctggtaggagtgtaaatcagtacaatgtcattgtaaagcaacctgccatttacaatagcaccatatggcattctgatcgtgattttggactcttatatgtgactcacttggggacccttggttggcccccatgagcaaaatcattaggagagcaaagtcttctgtggcaatattctgaaaggcaagtatttgtttagactgaacctgaaagagcaactttttaatatcatctttatgttaccaatgctggatattatagatcaaaattataatttcctgattgtggttataactgtgaatttaatcagagcacactttttatatcttatcttagaatctccatgtagcagtagtgccatttgttaagcatatactgtgtgcctggtactgtactagggacattatttacattttttgttctaaacctttacaatagccatccaaaaggctccaaaagtttaaagacactgcggatagaatattctggctaagatcatgagctctggtgccagaccttccccactctttcacttattagctgtgtgatttggggcaaattgcttaacctttcattctttcaatcccctcatctgtaaaatggtgatgcaattccctgtgttgttagaaagattaaaggagttaatacatgtaaagttcctaggaaagtgtctaacattaagtgctcagtaccagctaacaagtgacaaagccagaattcaaaccaggcctgtgttgaaacattctactgtatctcatggccacatgtttaggcatctaatctgagttgtcagtatatgttcaaggaataccatgccattttaatataagcctatattttaaaaacatttctaggaaattgtcatgaaaaccaaagaatagcctttgtccaaattttttaaaagattaggatgagtatggttatgctgttttatataaattcttcaaatggatgactcttctattttatcaaccagaattataaattcattttattttatttttctttttgtatgtgctaggcgagtagcttgcattgccatggagaagaccaaacaggagcagcaggccagctgtacttggtttggcaagaaaaagaagcagtacaaagataaatatttggcaaagcacaatgcaggtagggaaaagcacaactgttactgaggctgggttaagcatctccaagacctaaaaagatgtaatattttaattcagtcttcagtgttctctatccaaaaaattctaccatatgagatcttcatcaactttcaaaacctttaagaaacccctacctccaattaatatgttgattatttgctagatattttacagagctatactttataggacaaaaatgttattttgaaatagtatcctctggaatgaaaagaatccaacacgttaagtcctcccctgagaaatgaaagcttgagagtttgctgagtagccaggattcttatctatccttggctgggattggtcttgaacagatctcctcccgcctggctcctgcctggcccttgggcgtggccctgagataaacatctgagggtagaggtgtgctcttatcagagaactgtgccacaaatggttctgtggttggtttgagagagtacaaatgacatggacactaacttggttttgtccatttctgtgagtcgtcttcttccctcatggtatttccaagctaccacaagagcaagaatcttatcttggccttccctttatagtatgtatgtttgcccatatggaagtttgtattcaacttaagtcaaaatgttcacttgtcttgttgaaaactggaattaataccaaaaaggcatgatctgttgttgcaatagaatccccagaagattcacagggtgcaacttaagctaaagaaaatgcatggtgatacacaggagtgctaatacaagaagttattttcaataacttcttaatacaactccttttataaggaactttttctgaggaattgaaagtcctgactggcattaggttagttcccaaggtttcagaaataactccaaaaattagaaatgtggcccaaaaaatcaagtgaatctagtcatgcatacccagattgatggcataatgtttctgacaagtatgaaatgcatttttctctgtaaatgttataacgtactctgaattgttcatttctcaatcagagattaaaagtaaacatttcaaactgctgtataatgtggaatgaatgtgagtggccacatgggttaagtttaaatggctcagttaaataaggaatcattcccttcgcattagttacattgtaccacatttttatttccaaaaacagtgtaatttctggttatgtactactacagagcagtagtttcataatggcttttttggttttatgaagggaagaaataaagcagactagttacacaaaatgtagcaactgttaagcaaatgctcaagtatactatttgaagaaatgcactgcagagccaggcacggtggtggtgcctgtaatcccagctacttaggaggctgaggcaggaagattgcttgagcccaggagttcgaggccagcctgggcaacagcaataccctgtctatacaaaataaaaataaactaaatagaaatgcacagcagtatcagcagaatgttgcttcacacaaaacgtcagtggttattaccaagtctccttagttgcccttacttctgtcagcttctaacagtctaacacaatctaataggctcacaaggagatgtgttgacatataaattgagaaatgtatgcatctcaccttgtaatttgtacagcagtgttaaatgatacatagatatagatgggattgaaattaacttacacctagaaaagcaaagaaatggctggttcaggctgtcagtttatcattagatttatgctgtactaatagaggtcatgtaaacatgagtattcagtttgccagtattctttaattcagctctgaggaaagtaagaaattcattgaaaaactagaattctctaaatgctgtcaaagagtcaatttaatcattaatttaagaattttgccagagaatcagcatccgatctggcagccagtgttttcactttttccactctttcaccaccagggtatcactgatcttcttccattgctcccattctctgattcccgttagatggtgcacagtggtcctgcaaacacacctgtaagcttaataggcagctggagataggaccaggaattagcacacctgagtaaccgtgcaatttgggcaaatcacttcgctcctacgggccttgaaatgagggaattaggttagtcaatcaaggagatcttttctaattctaaagatcagtgggtctcaggttctttcatcactgggcctgacaaatggcgatcattcaatgaagccaagtattcttgtactgtctatctcaggctcttgctctctggtagacattgcctatccaggttgaaagctatcacccttgacatagaaggcaggagcctaataggggtagaacagaattgctttttcctctgtcttttgacatttacctcctatcccaaaccattgacctctcttaagttcttgtcaacttagaatgaagaaaggaggggttgagaggacaggggagcctactgccaccacctgtttggtatcatcagtattttcctaaccagcggccgtctgggcatcagaaccttccttgccatgcttaaggggttgttctacatgtcagtgtgtgtcactgtgtataaggccctcctttgaaagaaagtctgagcttcttagatggtccttgcagagccccttaagtgtctttgtagaactttgtgtttaggcctatttgtgattctctagtcaggatatcattgttaggcttccctcacctgcaaaataatcactgtgagctctctttttagtttctctttttgggagaagattcccagcttttttccttgactttctgaaatacactgcctgcaaagcctagcattcctttctgtcaccatctcttcaggtttcttctgtgtcatcaaccaactcttccattttgttcattagaaagtccagaagaaccatttgcttagtattacctttgctttacaagagatcatagggtcaagtatttaatcagctgttctgcttttagctacgatgaaaggtcatcccaatatacagaagtgtccttataaagaattgctctaaaagagtgagaaacaaatactcttgacttccattggtgaggcagttgctttgagaacttagaaatatcatagcctttcataccaaaccagatgggctcatgggccacagatcaaacaatatctcaaaaggatttttctggcttttttagaagttgatggtaaaatacagtactctgttcttctgttactactcagtaaattaaaataagggctgtatgttttgtttcctgcttcaaatctttgagaattcatcatatattgatggcaagatccaaaccttatcaagttctgacattatttgtatttgtggtacaaatgaaggttgggaattttgtcattatctagaactggtgggaatgataatactagaattatttccatttttgtcgttaggaaattctacatagcttgttaaagtggaattctgttcaaactgtgttacctacaactcccatcataaagtgacagcctattcgctgaatttgacccataagtaaattttgtccctctaactcccacacacacagtgtttaagttttaataagtcatcacgtgtgaaagtcaggatatttaacataaaaatttgggtttcagagttcccttagaagaacaaggaatgcagcaataccaggtccactttctcttttagtaactctgggtggttaatatggcctttgaatggacgctcattctccagcacacactgtccgcaccactccctgtttttgcacctggcccacttcattcaaccacattagctacctgacccctgcgggcattcaagtatgtactccttaacccaatgctaccagtgtgcaatgctcttttgaattggaggtctttatagtatttgaagatcttgatagtgtttccagctgagacaaggattcaatgttaatggcttttttatggaaaaaattcaacctggaaagtagttacataaatacttaaaagaagtgtctggaatgttgagtagtttagcagaaaatcagggtaatatgagcaaactatgctagacagtatttctgaatccttgggaatagatttgattatggtgtgtgtagcttttacagcaaatacattttctgtaacatacagaaggtttctagccatgtatacttggtacaaaaagcattgtggtgtggctggaacaactgaactctagaggcattgagattcctcagcccccaggacttccaaaagtcattttagatcaagttactagtgtaaactttttaaaaatgtaggaagtcttcattaatttggtttcttaaatgttagagccccgaaatactctatttacatacacatatttgaacataggggatttctacagtaccattcataggtgtgcttaaattatgcttaataccacaaattagtactattgactttaaaagctattcttttttttctggaatacaagcaactctaaaggaaacaaaaagtagcccataaactcactgccctgttggcattaaaaataataataggctgtgcgcagcggctcatgcctgtaatcccagcaccttgggaggccgaggtgggcagatcacttgaggccaggagttcgagaccagcctggccaacatggcaaaaccccatctctactaaaaatacaaaaattagctgggtgtggtggcacacgcctgtaatcccagctacttgggaggctgaggcaggagaatcacttgaacccgggaggtccgcggaggctgcagtgagccaagatcccaccactgcactccagcctgggtgaaggagcgagaccctgtctcaataataataataataataataataataataataataataaaagtaataggcacacatggttagaaattacacatggtacaggaaggtacaaagtgaaaagcaaaaggcttccacgtctacactctctgaagaggttttcttgtaactattctcgataaaatgtctatgcatatgctagtatataaaatccgctggcttttatataaggatattgtcgaatttctattaaaatgagtttgtttcttaatgtgatttatttgccttgtgtttagaatattgcatgataaagtttattttatacatattatacttttattttactaatatatgaaaagccatatttcaatgacccctgtacatttttcatgctgtctcactcccaatggcctctgtgcatgtaagtaacctgttgaatgactatgcctctgtgtttttggtggttttcttttattaagtcctttttttaatcagcaagcaacttaaaacctttaaaagctcattctttaagtgctttcctaatattatttgtatctcttattttaaaataccctttttttattgtttctcaaccctatgaccgtgtggcaatttcatttagaccagagtaacctcttcatgctgctcatttatggttaagatattgatgtttaacatatctgtttcatttcattttcataacatgtctgtttgtggttttgatggttgacatctaactcattcttatgtgttttttaaaaaaatgacaagtcttaatttggtaggatcacagttagggctctatagagggataggtgtgtgtatataccattcggaaagcttgtgtcatcatcatcatcttgctcttttgtgagatgcttgcttatttttattaaaatatattaaaacatatctgcttgtcaatgcacttcttctgtaagcatactttttcttgatggaaatatcactcagagggcaataggtctaaaaaataatgccatcagcactcctgcttttatttttgcaactctcatcactccattactactgcagtataactaactagccctaccacagagagcctcatgttcattttaattttgtgagtctgccattctgaacacagaaaacatttcttggtttttagctattgctagaggatatgctttaaagactttcaatcaacctttataaatcaagttatcaaaagaaaacaaatgtgcaaaaacccattaatatacactaacctctattttaatatatcgtgtttctttttttatatattgtgataatggtgctttttgtttgtttgtttctgttctattctattcccaagtatcttattttgcattttaagtgattgggcaaatcactaatgttaagaactaaggtgatattcacagtcatttggccatagtgtttctaggagtagaaggttctcttaataaatgattggctaaagtaatgcagatttcggccgggcacgatggctcacacctgtaatcccaacacttcgggaggccaaggccagtgaatcacctgaggtcaggagttcaagaccagcctggccaacatggtgaaaccccatctcaacaaaaatacaaaaattgtctgggcgtaatggcaggtgcctgtaactcaggaagctgaggcaggagaatcgcttgaacctgggaggcagaggttgcagtgagccgagatcgcgccactgcactccagcctgggtggcacagcgagagtccatctcataaataaataaataaataaataataaagcagcccagattcctttattacatcatcaaatcaattttactgaatttattttaacccctctaaaatccagggtttattcaatattctttaaaaaaagaaatgtcagtatgtaactgacagcatttgggtatgaccatacaaaaaatattacaggaaacacagacatacaattttagccctttgtgagaatttccaaatgtgtgtgagaattggaccatgttgaatttcaacaggaatgggcatctgctcaggaaagttttgtacattgcttgaaattgcttttatcatagtgttaagaggcaggtttcagaaaaatatttgttaaagtatttctcctcagtctgtagtgattagagaactccacttttgcaaaggtttctgagctcagactctgcttcatgattctttccatcctgatccaccatacacaggctgcccatgtaatgggcgacaagttttcaggcccaggaaagcatgtaactctccttacatattcaagactttccattgagtggatatctgggttacagtaaagcttgtgagatgctcattgataagcttgtgcaatagttacagaacttgccttagaatctagcatgccaccttcatcaactctgttgaaagaaagaaccatgaagttaaagaccagctgtccatgcatttctcatccatctctagaaatgatctagctggcccctctcctggttaactttagttgcattcatgctatattcatgttggtcactgtctgtagactttttctttttagtattgctgacttcttagaattggaaaaatatgaacagcatgtggtttcaaattaattcatatgatttgttggatactacatgaaaagatatgtagtatcttttagatttggacattttaatgcatgtgttcagcatctttggatgcccctggttctaaagagcattttcatgggcttaaaaatgaaaatttctccctagatgctatatgacttaaattacatgtaagccatatatcataagttggattcatatttttaagacatggttttaatataactgtagttttgccagtaaaattataatttatgtacatgaaatagtcattctacaaatttacctttcttctaaatctttgcgttttagtgtttgatcaattagatcttgtcacatatgaagaagtagtaaaactgccagcattcaagaggaaaacactagtcttattaggtaagtttgattgtgtaagtgagttgcttattctcactttcaaaacattttgtgaacattattaagagttgtcagttttaacattctttttttctaaatgacataggcgcacatggtgttgggagaagacacataaaaaacactctcatcacaaagcacccagaccggtttgcgtaccctattccacgtaagcaatgtctcaatctcttttcattatatttttcctatcacttttttaactctataatttatgtatttttttctgattacataaggtataactgttcattgtaggaaatttgtaaaatcaaaaaaagaacaaggaggaaaatgagttaacagtaatcccaacccctctttccctataataagtgctataaatattttgttgtatacccttctaggcttctctgttgtatacccttctaggcttgtcttagtacagatatgtgtataaagtgtgtgtgtgtgtgtgtgtgtgtgtgtgtgtgtgtgtgtgttttaaataaaattagttttatccattctgtttgtaacaatttttctaacaatatgtcatacacattacctagatgaattattcttcagaaaaataagttttcatagttgtacagtttctgatatgacaatttttttcccttagttaatatttaaattgttgatttcttaccactttttaaacccaatcaatatgctaacagttgtttctgtaaagattttcaaatctgtaagatttttaattctccttattttccgtatcttattcttaacctcttgccctcttcattttctcaattgtaaaatgaagtaattcaggattgcagagaggatttgagatcatgtgtatgaagcacttagcagatggtggataagtagaagctatctaccactatcatttcattattatcatcattattctaaagtttaaaattttaggccaggcgcggtggctcatgcctgtaattccagcactttgggaggctgaggtgggcgaatcacctgaggtcgggagtttgagaccagcctgaccaacatggagaaaccccgtctctactaaaaatacaaaattagctaggcatagtggtgcatgcctgtaatcccagctactcagcaggctgaagcaggagaatcagttgaatccggaggtggaggttgtggtgagccgagatcgtgccattgcactccagcctgggcaacaagagtgaaactccgtctcaaaaaaaaataaataaaattttaaccccagaagctttctagcagctcagggttggaagagctaaaggaaaattattttttaagagcaacaggagaaaatgtgaagattggctccattctatagggccttcacatgccttcctgaagcaatgtcaataccacttacagttatctgtacacctcagagagccaggaggcttcatgagaaaaccttcatcccaaaaccttgtctgatttacacaagaaaagaaatgtatccaatagtgtctcatttggcactactggggttttctagtaaaacactttgaagtgttcttttaattctccttatgtctagatcatgagtacagcaagcttagctaacatttagcttcttcttaaccacgtaacaactgaacttccatgttattaaatggccagttaactagtttggttttaaaacttacctttgatgatgtcaatcatgactagtctttgaaatatttgaccctgtatgtgtatataacatatatctaactactgagatgactgaagatagtacaacatcaatatgttatgtaagttcttggctgggcgcggtggctcacacctataatcccagcactttgggaggccgagatgggtggatcacatgagaccaggagtttgagaccagcctggccaatgtggtgaaaccccatctctactaaaaatacaaaagttagccgggcatggtggcacacacctgtagtcccagctattagggtggctgaggcatgaaaatcgcttggaacccgggagctggaagttgcagtgagctgagatcttgctactgcactccagcctgggcaacagagtgagaccctgtctcaataaataaataaatagtaacgccggttcttcagcttttgatgtgcctagagaaagggcttctcttaaaatgtccacattttgatgaccacgagcactttatgttctaacaaacaggctagcaggaaagggggattccccattagtttaggctcatgtatacagaagagagtagcataaatttgttctttctcaaagaaagaaggaagcaaagaaattgagagagagagggaaaaaaagggaaggaagggagaaaagaaaggggggtagggagagagaatattaaaaccagtgttcctggctcatctagaaaaacatttcctaaagtgtgttttgcaggatactggtcctattagtatccacagaactagagcttattggcatatacttcagttacactcacttaggtgaggggtgggcaagccttttctgtaaaggaccagatagtacacatttgaggctttaaggccatacagtctatcacaagcacttagctctgctgttgtctcatgaaaacaaccataggcaatatgtaaacaaaagcacatggctgtgttccagtaaaactttgtttacaaaaacagacagtaggtggccaggtgcagtggctcacacctgtaatcccagcactttgggagactgaggcgggcagatcacctgaggtcaggagtttgagaccagtctggccaacatggtgaaaccccgtctctgttggaaatacaaaaaatagctgggcatggtggtacacgcctataatcccagctgctcaggaggctgagggcacaagaatctcttgaacccaggaggtggaagttgcagtgagctgagatcgcaccactgcactccagcctgggctacagagtgggactctgtctccaaaataaaaaaataaaaataaaaaaagacagtagaccatgtttggcccataagccagtttgtcacctcctgatttaggtcttccataataattatgggtatgtctggccacagtcattgtgttttcagtgtaacgtgtcttttgctgtatcctaacattctccttttgcaagatgttatagaacatcacttttcaatagaactttctgtgacaatgacagtacttgatgtctgtgcagtccagtacagtggccactaaccatacgtggttattgaatccttgaaatgccactagtgagactgagaaactaaaatttgaattttatttaattttggcttatttaaatttaaccatatgcagttttccatttttttattctccttttttccttctacacaagacccaactgcattaaggcatacagtgagttatattaatcttgggtcatttcacgtcttcctcctgtggtggttcatgaagggataaaatacatctcacctgaacactgaaagtttcaccaaaccagacaattcactggctactatggtgtgatgcacacagataaatatggtttctagaatttagttctgcaaagccactgggggtgagaacaggggatatgagatatacgctaaagaatccacagcttttaggaagagactgggtttgagtaaatctgttgggagtgtagtaagctcatcagctcagccttttaaacctcttgtgccatgcgactttgcagatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggtaatgcccagcctccccgaatgtctgacatcctgcctgcatgccaataagcacagattctgaaatcaaaaatgccatcagaaagtcacaggtcacataataatttcataaaccacagaaaagtatcagtaatggaggcgttgggggttcacagtctagaatgccagctgactaatcgttggactcagtgcacacaccatgtatttaagaagcagagattattctcttaagaggtttattatatgcagaagctcagtaaggttcctgattgtgtctacgcctgccagaaatcctacgatcatctgacctcaggatgaggctctggcactttgttatcacaacagccaccttccctctctgggtacagctcacgctggaccatcagagcctctaccagcacattatgttaatctccagtgagaaactgatcctggggcctgggtctgaaacacagcactagctttatgaaagcaagcatgagtgagcccagatgtcagagacagcagggatggaaacccatggtggctctcagcctctgccatttccttacctgagcacaatgcctgaccctgagcaaaaactaggagagagataaagacttggaagaggactcaaaagagagccagacacagagatgatgaaatggtttctagatatgtcttgcagtaggaattattaaacttgaaaaagagaaagctgaaggctttacatcaaaaatgctgacaagctgttttttcatctctgagtacaaaccaagtagatatgggaggcaaagtatagtaggaaggatttgggagttgtagacatcaaggtgggttataggagaggcttgtgggtgccatgtgactcctgggtctgccatttctaggactgatctgtaccaaatctcctttaacccttagaaatagaaccagtatgctacctgctgaaatagtagaccagcttccctcaagcaggctgtgtttcatcaggaggcttacctggctatcttaggcagggcgaatccctgttcaagggccactgtatgagacttggtcccctaaccatccctaaagcaaggacagaacctatatagccagagtctgtgtgacctgggacctgacagctcagtttctgggctccaggatcctaattcgtggccagtgggttcacccatttccgtttacaacacctgatggggttcttgaacttggaactttggaaaccacaaaaggatctgttcaaggggctagggaggaaagcagcagtagggtgaacactgccgtttacttaacaattaacttggacctatatagaactaaatatatgatgtgtaccacagattgatttttgtttaactactaatccctccttactagggattggaaaaatcttctggccaggggtggctagaggcaaagtctcaatcctggtcctggtcttcgacatcctctccttgggttccacactggtcttcacctgaacgtcgttttctgctggtagtaatgtctctagcagtatgctggctgcagggctcctcagactccctctgcattacctaagtccactttcgagggctttctgccttacctgcctccgctgctgccgccgccaccgccactgctgctgctgccgctgctgctgctgctccacccatagcgtccagctctccctttctccttgcccttgcacagccatgcattgctctgcactgctgagtgggagacacttctctcagcctcctcaggacacccacagcagttacttttacccattgcacttggccccaaagcacctcctcaccccggctgggcactctcctctgctcccctgagtgctggatgagctcacctgcactcttctctcctgcttcctgggtccctgcctctcagaactgtgatctctcagatccacctagccctgagggccggccataggcatcctggctgcctgagtctctttgggccagcggccctggggatagggattgcccaggtcctgctcctcctgttggtctggttgactacactggtcccaggccctcctgcgcaggccagcctcatgccagtcctggtctcacaatgaccattgcataccacagtacagctgagaatgcccgcagtctgcaccgactgggcttcactctcgggcttctctgccctcagcccagtctctcctcagctggacaaggccttcatcctgccttcaggatacccgtgaccatgaacaacttgctttcaggcagagcctcactgctccagggaggctctctccttaggacatttttctccatccccctttcccactccagcttcttagatgacccctctactgtatcttacagacaatttaatccaacaaacttgtattaagcccttattatatgtcaagcacagggtcaggagctaagaatacaattcagaagacaagatggtgaggatgaaattccttcctcattgtacatccaaaactgtccataacagaagggccttgtggcattttttagaatcctctcacttctgccaaactacatgtggaccataggaaaaccacctaacacatgtccagctcttttagtacaggtctaatactttatgccatcttatttcagacaactgaggcccaattgagcacgtctaataatactatatgataagatgttgtggtccaactttaaagctagaggatgatggtaaagacattaaactagaaagaaattaataacctagcttctcataaaatagtaatagattatgttcttatagtgctgtatattttgccaggcgttatgactccttacctaatccttgtaaccctatgagctggagatcagtatctagttttgtagatggagaaaccaaggcttaacataattgtgactcgattaaggctttacagccaattgaaagtgaggtgtgaagttgaactgtgttgatttttaaatttttattcttttacagtaaatccccacttcctttcactgtaccaccctagaagaggtaaccctgggaatccttaagatggttcaccttatccatagtagtacaatgtaaagcctcattttttcttaacattcagaaaaatctgtaattcagtcaaacctaagaaaagctgtagaatttatttctcatgaaaataaagctatggctcagaaaataatctgtgcccctaaagctgaaactgtaatagccccagtgtgtaatcagagcttaatgtgatggttttagattttaactttattctgatgtatccatttgtagcatgaaaaagttaatagtagcagaatatttgtagttttgcttttgcccacagcggaagaggtcatcatcaagaggcagcatacagtcttgttaggaatccatactttaaaacaagagccaggttctgaaccagagactattttgtgaaatcagttatctctcttgagatgggttctggggtcactgcactcttcctaaacccttagatttttgtacaaaatgactcagatgcttgcctctgtgtgccttttaagtttgcaaaccagaatagatatctgcctcttatacacttgggtcaaatgagtttctattccttgaggataataacctgagattaattattggccatagccaagccatagaatcaatttatctccacaaatgttagattaatgttactttgactatctgaatctagcatgctttcagtgatctttctagagcgtgctctttctctccctgtccatatctgtccctgtttctctctctctctctacacacacacacactctctctctctctctgtctctctctctgcctctccccctctctctcactctctgtctctctctctgtccccgtctctctctccgaatcccagagagattcggagagaaatatttgcccatgaacattaaaaaatgtgtgcctcatcctgagtcagaaaggaagagggtttagagttcatctttaagtcacctattaactgcctgagagaggggaatccttgtgagcaattccatttcctgtccctgaagtaactctgaacctcagccaggctaccacagcaccaaaagtggcacccacttgagacccgtaagtagtgcagagtatggcccaaagaccttcaagaacaagcgaggaaatgtgtggtgagtctgctgaaaatatgaggctgactagacaggaaaatctcaatcaggatttgaggcatcttagaatttttgaaagtacaataataaagtatagaaatagaaaaagctacaaaaaggaggagaaagcaaatatgctaaccacagggctactttagttactgtgataaacattaaatttggctctgaacttcctgacaaccagggcaaaaaaaaggaaatcaaggaatataacctgattcgtagacataagaggcatttggcaatgtgaggaacatggccaccattgatggttttatgcagtgagtgcagtctatggatatagaccaagggtgtgaatgcagtgcagagatgggcaatctgcaggaagctaaactaatgttccaagcagtttgttttctgctgttgtaatgtgatagctggaatggaaaacatgataaggactgggtagctggcaggctgggccactgagtgcagaaaaaaaccatttcatgcccagggtgtcattctctacttcatctgtgggttccgttcagcatccaggctgggtggacttccatctagcacttagagtagctttggggatagaagcaaataggattctttcccatctcagttgcccagaagcaggctatgggatgggtatatgtgtgtgaccgggagtaggggtgatgagaaaaccttgtctcagctgaccctgtattcacctgatctatgagcataggaaggaaggaaaaaaggcctaagataatactgacataaaggatatttctaagtgaagatccctgttagcttgcttgagctatatatggactttgtcataatgtttgttcctggcttaagtcttcagccacaaaaggattggcaaagaaattgccagttacctctttcaaaaattaacatatgcaagcttaaagagctttcttaccagaagaatcagagcctaggactttaagagttaaaaaactttgatggataaatacaatgtaccagtctccctcaacccacaagaagatgctgtgtgactaaaattcagaaatataatcctagtgaaagccaaccttgcactaaaaaaagaaagaacctttcatgtcaaatttgtctcttacatgcctgtatacacaaagaggctaagagagtcccttcagccaagagagtagagtgctctgtagatgaacctgccttaaaagacaagataaattctgtgcaaattatatctactatttttacattttaattttttcataagggcagtttatgctgggtgccatattgggcatgagtgagatagctgaacaagacacagtccctcccttcaaggagggtacccgctagtccctggggtcttgggtttcccacgtgatgggtacttcaggagcacatgggagggtctcagagctcacaaaggacttcccaaagaaaagagcatcagtactgagttctgaaggattactcagccaagcaaaagagtgagtggggaaggggaagagaggatgggaggttcaggcagagggagtagtaaatcaaaaggccaggaagccagagagagtctggccctttctggaactgaaagtagttcaggaaggctggtccatggagccaaaggagcagagagaaaggctgaagaggttaagcataggcatgcttgtgagggagagaggtgacattcatgctgaggagtatacattttatcctgaggccaagagggaactgttgaattctgagcaggggagccatgggttttgaatttcagaaagatcattccagtagcagggtagagtatggattggaaagcagcaaaaccagaggcagggcaaccagtctaattactattacaataagctgggcaaaagatggagcaataggaatagcgtgaagcaagcaaatttaaagaccatttagagagcaaaatatgtggggagcaggatagttaaattcttgtgtaagtgacagcaagatatttaccccagcgcatatgaattaatcacatgtcagtcacttgtgaattgggtacctgtatgtgttgggttttgttccttggaagggagtttgtaacctccaagataatcatatcctcctggggaggagctgaaacagtaatcccttagcagaatcaactcccacagcgtctgactgcagcgttgcagtatatctatccaaactagtagctggcatttagaggttttcaatgccttagaagggaactgaaagggatctcagaggcccttctgtcttgagtgcagcattttctcatgggcctatacattgcccacagccacacagtgtctttagcgacaggactaagacacaaagtctagggctcctaactccagccctgggcaaggttcccccttccccaggagtcccagggggcttttctgcagagcaacacacagttacagtggacagatttgctagcaatccttggctagcaatttgaaatttgaaatgtgagggagtggcctccagattagtggtaaaaccagccggcaggtccaagtctccccttaaatgcatttcctgttgattaaaattcaggctaaaactaatagccaggtttaaatgaacattaaccaacataatcagtgttaacttttatgaagaaaaatagattgattcatgagtcataagaaaaatgtccagtttgccaacttttattttctgatggctattgtccatcctttagaaaaaaagtaatataagttatgtataaagttggtaaatttaataataccttgccaaaaatttgagccaagagcttggaattttcagttgtataaaaatttttatagactcatttgaaagttacattagttatttcttcttttaagtcgggattttttttttttttcttaacacaggcactgaaggtcctgagaactgcagagtttgctccttttgttgttttcattgctgcaccaactattactccaggtttaaatgaggtaagaatcaatctgtttttccccaaataagctgtaaggatcaagccttactccccagcacagtcagaagcgtgtcagtctacatttgcagcaaggctgctctgatgaaatgggatgtggaatagaatgctacatgggacagtcttatcagtaagctgacttctaaaatctgaggacaaacaccctcactcccaccaggaccgaggcatcccaggtgtctcacaacctccagggctgccagcctattccctctccggatagggattgtgtggcccctggagtggaacctttgtggaatttctctccaggcccctgaagactaccaaacctagaaatcagctctgtccactgtcaagccagctcaagtcagaaactgccacagacatggtgctcatgagacttggctgctgacttagaaggttttccattgctgagcagatcaaagggtacttaccatgtgtctgctaagtgtagcagtgcctatcttctgtaggttccttagttaaggggagactcttataccaagttatcctgaagaccattgctttcacagcttctagaaatcatcagaggactcttgattgactctgttcagtcaacactgacctaaactcactcaagcttaaaatctaattaaatcatggcttggaaattttccctttgtgtacctttaaggaagattcaggattttgatttacctatgttactcatattttccgtcattatgtttttgtcatttcatctgcaagaggtatattcctttgtaaaattctaccttcccatcttatttaatacataagcatgtttgaaactccacattgtggttagcttttatccttcagttgccatgtatttttcttgaatcatcatctttgctttgtttttgttttgcctgttttcctgcccttttactaattttccatagctgccaaaatggtgcagaaaattgcctgtaagtaccagctaggaggtggtgaaatacagccgtgtttcttttaatagatttagaatgtagacactttgttcccacaaatccttgcttttgctgttagaataaaggcattttgttttcactgagttaaaccctgctcacgtgtgagtcaagcacacagacaagctgttgtcgaggaagagactgacaaatatagcttcgtcttaaaagattcttaagagggagctttatttttctgtaaagagacctacattaaaaatgtgatactttcagccataaattttcttgaatattttcatcagcccagcttgctgagcaaatcataaaccctgctagtggtttttgaagctcaggactatatattcaaatagaatcccgtgtgccagagagtgatgttgtaggaattgttccttttcatcctggtaggaagcactcctgtctttgggtgaatgcacatttgctaaaatggcgttttttgcattgtgttgattatgaagtaaagccacagtgaaaatactatgctttttaagtgcaagccgaactagaaggtgatgattaactggggtcttatctacactgtagtacttaacactaacattcaaagcatgccctgtcctgctttgaaatgccagtaaaagaggacaaaacaggtaggacattcttggttcagagtgccctgagagaaaagattgagttcctgtctgctgtggtgtctgcgcatgcccactgcagtgccaggacagaatcaagcaagtctctttatctcacttctagtcccctttcttgagagctgtacccagagagctgaggcttgcctggacctcccagcagcctcccaggaaaggtctcttgccaataacagaggggctttagagaagaggagaggaggggaggggccctaagccagtactgggtactacggctcctaggtccttgaaggtaccgcatcttttattttctctggagatctgtctctgtcacccagggccccaatttcctggaagaattgctcagtctcttgattttagatttaatacttgtaaaaccctataatgactggcactagtcagacaagtgcttgttcttttgacagcatttattaagcacttactatgtgtaaggcactatgcctaatgctggggcacagcaattacagggcacacaagacaagtttatgccctagctggagacatagccactaatcaaataaagaggtatttcgttatctctatgtatatttaagactcagcccaagagctcacccacctagtgtttggcaggtagggggtggttaatttgactcacaaagttccctagtgtcaaggttgaacttgccctttgggagttcagcatgacaaatatgacttgcgaagatatagaggcagacttctttctggtggctcttaagagacccctgtcttgaaagaactgccactctgtagcagaagctatacttgcatgacaaagctgggaccctaaactccctcctcctgttggatccctcttacaagagttcttaaaatctgtggcaagctgcagcttagggaacatcctttgttgcagcaaacctccctagagttcagtactccctagagttctcttccttctgtttttttcataagagatatgaggacctacgaacagtgacatttgtctagccacttctaatgcagaccaatttggggggattcatcagatgccaggtgctgtttattggggaaacagccttattccagccattatttgtaacactcaaagatcttttgcctctggcatcagctgctattgagtgagggccattatatgtaattgaattcctagaacgtgtggcacctttaagtagaagaggaaaaaatacaacttaatttgtcatccaagggcagggacttgttggtgcaaacacagctgggccctgaggcctggctccagtgagtgtggaggaccaaggggacgggggcaaagagctccagccttgccaccgtagccctctcgccaattgggagagtggcttgaggctagggcggggggcttcctgctggcctgtttgggccaccatagccactgtaacccacacctggcatggccctaccaagcctgactctggggacaggcacagctaggcctgagtgggggtggcatgtttcctgaagagtatctgttttctctggttcgtctgctttgtcatggaccctctgttgcatgttgagcaatcactgtctcctctgtcatggagcggacttggcctcatgctggcatatggcatatcagggtctggccttgactgtttctgacactgggatgaacaaaaatgtgaaaagagaacgaatccaactgatttctctcttctgtttgcttttccctcctctcatgcccacccctacctccatctcatcaccatttaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatag

SEQ ID NO: 5659 - DNA, 402671 bp, human
ccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgtataattacgctggggaaaagcagggaatcagattaatcacagtgctgattgagaattaaatctgcagttcctcatctaattgtccattccttaaatctattttgaatagtttccttttcattcttgtcaaacagtactccaagtgcacaatcctgctaatttgcttgtgaaggaaatgctggcaatctgaagttgatttcctaacacagcgtgtattctgcggctttagaagttgaggagataagatttaagagcaaatttttgcttaataaggatcgctagagctaacattgaaatatcttacctctttttttttttttttttttttttggaagcggtgctttattgtctattttaaggtccacagttgggaaatgaaaccaagaccttaaagcagttggccctatctcttttaagttgtctgcagtactcaatttcaatttgagtgctaatttgtttccttttctttccatattgaggtattacagtgttgcctcacatggtgaaattgtgggtagagcttgctacacactttactcagacccaattgatgtgaggacatgttactccttgccctattgttacatgaccagccagacttaaaaggaaagtatccaaatgtgtcctgttaaagtgcttgtggaagtgttctagaacagcactgtccaaaagatatattatgagccacatttgtaatttaaaattttctagtagccacatttaataaaaacatacaggtgcaattaattttaataaaatattttatttaaccctgtagatccaaacttaacatttcaacatgtaatcaatatgaaaaaatattaatgaaatattttacatcttttatgctaagtctttgaaatcccaatgtgtattttacactaatagcacatctcaattctgacactaagctacatttctgatgaaaatcagaaatacttaatctgtatttaggtttcataaaatttgcgtttgcaaaagtatattcacatacccaagttgttcccaatatacataaaagttttccaataaccgaatcaagtacctttttctaaatttaaattttaattaattaaaattaaatacaattcaaaattcagtttcccagtcggaccagccacgtttcaggtgcccagtagccacatgtgaatagcacagttctagagagaaaaatgcatcaaaaatctccttggtttcctcattcttaggagcacccagtgaagataaattaggtgtttcccaaaagcctccaaatgactgtatgtgtgggtgaatgatgtttgttgcatcttagttatagctgatgtaaatgaactaacaaagtcataattggaaaatgtgagattaaaatgttaattatattgtgaagatgtaaaatagccatctctgaatcagttttggtaactagttctgattccttaaagtctggaagggtgatgatgtgatctctttggatatcaaaaagaaatggtcagaatcacattaacacagtccatattctgctgatttgtaattgatagaatatttttcaggaaacacccctgggagaaaaaaattcatcttttctgactgtttcagagctgcataaagaggggcagcaagctaattttgaggtgataggtactctatggctaccttaactactatgaactgtgaaatctcattcatatcctacaaaatctgacttggtcagtgccaattataaaatgccattatgtgaaataatgaattcaagctagccttattgttaaagaatgtaataatagtgttcctcaatctgagtaaaggttgaaggtttctctagtaaattgtcttagtatatattgatctggaaattgaaattagcttgagattttcttgcagggaccttgacagcatacatttttaacttataatttgttcacctctgaatttgaacagaaagcccttgaagatattcacatgtactgaaaacctttttattgatttctatccaagttctatggaattttgattttcttttttaccaaattagtatcacaagttgtttttcaccactagatcttaataggttttaatttttactaaggtactttaaaatagatttcacttttcaagactaattgactacccactcactcctctacctacgcaaccacctactcactcacccactgtgtacttggccttacttgatggcataaatgaaagttctcgtttaatttagacccttcagtgtgtttttttcccccttggttgagaaagataacttacagagttaatgaggttttgaaatataagatcattatttggaatatgttttctttccagtggttgcagcctttacccttgttaaagctgtctttgagggaacatgtgcccaatttgttacaaatattggaaggatgccgtttccctttttaaaaattaaaactcttttccctgtgtttctcatttttgaaaatcttgcagaaactcctttgagtgactgttggttctataacattttctatgtaactatcttttaaatgactgaaacaaatctccaataataagaccttatcatagtcccaaaacttcttgtcttagcaaatgtagcgattactggaaaggaagggcgttatgcaaatgaggttaatgactaatttttatgtcatgatcatttactgtatcttttacaattataagtaagtgtacaaccggtaatactacatgaaggaaatttaagacaattcatcgaaattaaaacatagaaaaatgcctactttcttggtacagcagtgtgtatgaaagggaataacaaaatacataccatttttaccttgtgttaggtgaatacttgccctgtttagtagcctgtagcttcagactttcctgctctggtaggacatacactaaaattggaatgatgcagcatgacccttgcttaaggatgacgtgcaactttgtgaggcatgctgtatttgcttactcctcgagagcacttttatttaattacagttacttatttatggatctctctagttcactaataaggagcttcctgagggcagggaatgtttcttacacatctttctccattaacacagtgcgtgcaatgtaactgcctttcattagctgtggaatgaattgagtagttttaataaaatctcattaaaaggcaaaaaagcatgtttgtcaacctcagagcaattattgtccgaagagcctgcattagtttaaagtagtggttctccacctggctgcatattagaatcatccggggagcttttaaaaaagatcaacgccagagccctgtgtcaaagcagtgaagtccgagtttctgggactgggtcctggtcactgacatttttttaaagctctctgtgtgattctaatatgcagctataatgaggaatcattggcttaaaacttagattatgtatgtaatattttgggactggcttttcagaggcttacaattcttacaaagtagaataaattctttttggaaggtattgaagctaaatggctaaaacatggattttatcttctatgcacttgtgtttctcagccttattgtgtaaaaatttagttttagcttgtgtttggctttgatttcttgggccttttaagatccacattgatttatgacactcatctaatgctaacatggcgattgtctgacgtttggaacaacacagaacaaggattgcttcaataacagttgatgatggttttccactataatggcttgatttaatatgaagaaatttatcagtttagtatggattgtgtttgtacatacactctattaaaagagtatggttaagttgcttgtatgctttaaattacatacttgtgattccagtaatgctgttagctggagaattgagttaatgcagcctttatgtaaatactggattaataatacgtaaagtatataattcagcatacagaaaaattcagctttactaatttgtactaattactatgactttcacatgtattgattcatgcagtgatttgggtttctagtaccatagggagaatttcgcattgtgttgaaaaaatgtttcccggaaattttaactagactttgtaggtaaactagtttttaatgttaggaaaagatcaagtgtttgcctgaaggaaccgagaattttccagaaatgagtagatattccagaaataccagtgatcgtgaaagcagtgcatgatcacagtgacagccaagtaacaaggtaaaagaagtgatcagcagctaaattgttggtggcccagaaagaatgcaagccatgggagttaagctgtacttctacagaggaaaatccttttgaactcagggtgtggatgctacagatagcaggcctcaatgggagtggggaagcaatattgattcctgatgatcctaggatcatttggagggagaacagagctactccgttgcttttctgcatgtatacaaccttctctagtctcttcctgtctgctttttacagattgctttagggtgtgttgtttgaagttgtcttcataaatacttcctgtggactcccttaatttttatgtccgtaacacgcttctatgtacttgacatacgcagttcagctctctccattttttccttgtatctgcaacagtttcacctgatgaactacgtctcaagtgtccctaaattgtgtacctggatatttcctttaaactgaaaattctgtctccagctgtagttctactcaataaattgaaggagcagatataccttgcttcttgagattattcttgaattattacattttcttaaacgttttcacattttaaatgtggtaggagcactgcatttaaaggaactttgacataaggttgtttaaaaaacttctataacttaaagcttactttataaagggattgacatttatccctctaatgttaggcattttggatgtattatttaatcatacccattttacagagaacactgagattcagagggggtgatcagtaattcgcctaagatcacacagattccaacgcggttccatggttttaaagtctgttcatttcatgctgcattctgctgctaattcaagttgtgaaaatactgtgttggattttcttaaagacacgtcttcattttcagagtttctatactgcaaattttagttgtttgactttctggttaaatttcttatttcttcagtagaggttccatatactattcattctttcatctgtttcttttttatttttgtctttctctttaatgaaacatcagcatttgttaccaaactaactggtaaatctagcaatggaaatatagactcttggccatctgtccaaaatataatttgttttggaactttctctacttcttttactctccaaattttttcttccatttcccttgccccaacagacaggatagttgattaattacccctaacttgccaaaccagaagtaataaggtttcagaggtagatgtttgttggaagtggggtggagtggtttccaaaggatagttattcctttatcctgtgataaaaatacggagattgttctctctgattctgaaaaccgtgtagtgagctgcagccgctgagtctgtgagcttctagctgtttgccagcactgtacaccttaaataatcaagagactgagttaactattgcagagcaggtaccggaccccagccaacaagctgatgggatgtgctgttctcacattttttggttttattttttagttgcaactgacagtgaagattctagaagcaccaaatatggctctggatttatgctgtgggatttaagatgctacagaacttgctctccttcctttctgtcctggagccactatggtattggttgtagagcccaagtcagtatagagtctctgacttctaccctgggaaaatttcatttccgaagctagtttgttttgaagttaatgtttatttccaacattgagatttaataattttgtgttacttttctttattaattagtttttatacagtaaattataaaagtaatgatgcacgtagtaaattttattttctttttttgagatggagtctcgctctgtctcccaggctggagtgcagtggcacgatcttggctcactacaacctccgcctcctgggttcaagtgattctcttgcctcagcctcccaacaagctgggattacaagcatgcaccaccgcgcctggctaatttgtgtgtgcgtgtgtgtgtgtgtgtgtgtgtgtgttttgagacggagtctcactctgtcgcccaggctggagtgcaatggcgcgatctcggcttactgcaagctccgcctcccaggttcacgccattctcctgcctcagcctcccgagtagctgggactacagacgcccggctaatttttttttttttttttgtatttctagtagagatggggtttcaccatgtaagccaggatggtcttgatctcctgacctcgtgatccacccgccttggcctcccaaagtgctgggattacaggcgtgagccaccgcgtccagcctagttttttatttttagtagagacggggtttcaccaggctggtctcgaactcctgacgtcaggtgatccacctgccttggtctcccaaagtgctgggattacaggcgtgagccactgtgcccagccatacaatttaaaatataggtgatacaaagataagtagtgagtctgtctcaattctcctaccatccatatccccattctctagaggtaaccattgttcagtttcttctccatctttctggaagctttttgtttaaaagtgagatatttgtatactatgctgaaatattgatttttcatgaataatagtatatacttgatgatcttgtcatatccatcaatgtatctgtctgtctctatctcctctttagctgctgcccagtattctgtcatatggattgttactttggctttggattgagtgcaagccaattgtaattttacattgcttgaaatgctgagctggaatttgggtgagaggtatggaatggcagtgaagatttgggagtcatctgtgtggaagtaaaactgagtgaacaagttcttgggggttgactgctctagggctcgtggtttggagtataactcatagagttagaagaatcaggataatgggctgcacagaagtttaaaagaggggggaggatcaataatgtaaaatgccaatatactctgaggactaagaacacatgtggctataacagagaaacaatttaaagcacttatcaaaatgaatattatgtttaatagtcaattcatgatgtgtctgaaaagctaggtctggcttcttttctgtggatactagtaattttatactatctctctgtaaatctatctcagaaccaacatatttagggtaaaaacaaagtagatttctttttcactctaattgtgttttgcagatttctgatgactggcttttaggtaaaatcatttggttttcctaagattatgtccttttcattcccgagcttgtgcatgactgtcaattaaatggaagcctttcatgaagtgacaaagtaagttttagatactttacatttactttaagttcttggtatgtgtcaaaccactgttattgtcttatatctttctactataggaaactgaattctttctagcctcaaggatttttgtccacgttggatgaatgtagtactgtcctcctctttcacatttcttctcccatcacctcctaactaaatttgttcattggctatttttggttgtccacatccattcacaataagaaacgattgcttcgttgtacataagccagttttttggtatctaagtgcgtgctatttcacttcagcttcttgtattctatttattactgggctgttgtacattgttttttctcccaatctttgtgatttcttttaatatactttctttcctttttgctttgtaatcattgttttgagtatttgaatcatttgcaggtaagaatgtggattgttctgtctctcatgtagtttaataatatccaaaatatactatgttcagtctgtatttcaggcttttaacacttaagttagagtattttggtatatttaaatctaggatagaagtacactgtattaccattcaactacatgcagattttaatgttttcttaaattaaaggatgatgatattcattcagttacagaggtctctctctctagtccttccatggtgtgcagattaccattatactactgctatttcatagattctaatttgtgtttttagaaaacatcatcaattcttggccttctttcttacccttggtatgtgatttcccctaaaggtatggaatgcggttgctctgtggcttgttaggcagcccccttctgatctggtaacctttgggcacagtgtggctattttctccttatttataaaaggaatgatagctgcttcacaaaccatttgtgtggattagtgaattgtaaagtgcagcataagtattttttatttctagaatgtctctgagatactcaaattacttttggcagttatgtacgtaagtttcaacaatttccaaatgtgcacattctcagtgctaaacacaggctctattacataaataatatggtgaaatgaacattcttttctaccatgtgtgtaaaattgttagtggtgctaacttttattcattgttcatttatgtattcatttctagctatgaggtcctgggcaagttagttagcctctctgaccctcagtttctttatctgtaaaatgtggttaatggtatatactttgtaaggttgttgtgaggattgaatagcatgatctatgtgaaatgtctaaaggttgttattttaattgccattgtcattattattattttttaaattttattattattatactttaagttttagggtacatgtgcacaacgtgcaggtttgttacaaatgtatacatgtgccatgttggtgtgctgcacccattaactcgtcatttagcattaggtattgctattcaccaaacacttgagttctctggcctcagggagctcaaatgagttattcacacactcatgcacatatcctctgcgtaacttggtaaccaacagacacacatagtaaaatatttggtcagcagttgttgaatgagtgagtacattaactgagaaatccagagactgtgtgaccacctagtaggagaaggaagttggggaaatcattacagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaaagcgctgcgattacaggcatgaaccactgcacccagcctaagaaatatattgaagagtcctttctgtctttttaaaaactgtccaggccgggtgcagtggcttatgcccgtaatcccagcacgttggaaggctgaggtgggtggctcacttgaggtcaggagtttgagaccagcctgactaacgtggtgaagccccgtctctactaaaaatacaaatattagctgggcatggtggtgcgtgcctgtaatcccagctacttgggaggctgaggcaggagaattgcttgaacccaggaggcggaggttgcagcgagccaagattgcaccactgtagtccagctggggcaacaagagcaaaactctgtctcaaaaaaaaaaaaaaaaaaaaaaaacagaaaacaaacaaaaaaactgtccagtgagctgtaatcactgcactccaacccaggcaacagagcaagacactgtcttaaaaaaattcttttaaaaatgtcattgctctcattgttcaactcccacttatgagtaagaacatgcagtgtttggttttctgttcctgtgttagtttgctgagaatgatggtttccagcttcatccatgagaacatataggcacagggaggggaacatcacacaccggggcctgttgggggttggggggcaaggggagggataacattaggagaaatacctaatgtagatgatgggttgatgggtgcagcaaaccaccatggcacatgtatacctatgtaacaaacctgtacgttctgcacatgtatcccagaacttaaagtataataaaaaaagttaaaaaaaaactgtcattgcctcttatgtacatagaaaatacagtattgagttacagattttcataatttgtttccaagtctgttctagattataattccgtagtgttgtgaaaaactcccaagattgttaaaagaaggaattttgtatcacacttcttatgtttgcatttagacaattgacagattaattaattgttcataatgtgaaatttcaagactgaaaaaaggaaaatcccagaatatatatttcagaaacacccatatataggatttatgaatattgtagtgttcctttatgtaacttcccaaaattttattacaacagcaatttctacatcttaacagtgagcaaaatgaggtggaaagattctgaagttgtagtctctgacactactgggcactgaatctaaataacctaaaaccacagaacagtatttcatcttctagttcttattacattgtcaggtgtaagaatgatcatgttgaaattgagtggttggtctgtttagatcacttctatggaaatactgcttagattggtttcagaaatccttggacagtattatttatattgcattatttaggttagaaatttttgctgacttccatctgagttattagttcaaaagcagaatcatcagcctttatatggaatctctgctggtgctcatcttaggcttagtatcttcttaactgggtttttgttagcagtatagtgtggcattaaatttgagactatctttttaataaattttttaaaaattttgtcagttgtagaataattagatacttgtaaaacaagcaagaagctgttttcactgaggactttctttaattacatttcatataaatttaagagaactgttactagaatattaaaatcacaggttaaagtgagaatgtatttcacataatcaacatacataacatttttaacagcatgctaaagatggaaaaaacctttaccaaccatacatattataggcaaagctttaaaaaaaacaaaacattttgctcttatggatgtgaaagtaatctgtgtaaatatgtatttaaatgaaaatatctattcattatcattgcagaaggagtgtgggtatctggagagggagcattctaaacttgctgctctactttttggattatctacattaatatttctcccattgctgagtatttctgttatactgctggatcatcatacttccataatctgtgacccacttgctctaatggtagagtgggctttaaactgccatctgattaaagttcaggtttcttagttagacttgcctgggtggcttcagaattaggcccacaaatatgaatatggacttgaagatcttactagaacaatattttccccgataaagacacatccataaacatggtcctaaaaagatatgtgtaagttggatttgaaaaatgcaatttaagagttactaggaaaaagggattttaaggaaacattttaagtaatttgtgtgatatcaccagttggtttttcttcagtttcttcatcttgtaaaagaaggatagtaatggctatattatctacctcatgagattctcatgcacataaaattacataattcttaagtcttaaactaccttacgtatattattatttcaattttattgaaataaaacactttttttttttgtgatggagtctcactctgtcacccaggctggagtgcaatggtgtgatctctgctcactgcaacctccgcctcctgggttcaagcaattctcctgcctcagcctcccgagtagctgggactacacatgtgcaccaccacgcccggcttagtcttgtatttttagtagagacagggttttgccatgttggccaggctgatctcaaactcctgagctcaggtgatctgcctgcctcggcctcccaaagtgctgggattacaggcatgagccactgtgcctggcccaaactaaaacacttctaatggacttgtactttggctgggcacggtggctcacacctgtaatccctgcactttgggaggccaaggtgggtggatcatttgaggccaggagttcaagaccagcccaggcaacatggtgaaacctcgtctctactaaaaatgtcataaaattagccggccatggtggcgtgtgcctgtaataccagctacttgggaggctgaggcgggagaatagtttgaacccgggaggcatagtttgcagtgagccgagatcatgccattgcactccagcctgggcgatagagcgagactaagaaaaaaaaaaacaaaacaagaacatgggctttgttgacttttctttgattttgtaagaatcatttacctttgtctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaatcttcatttttcccaattcttactgcctttttacttcctcaagagaaaacccaccttgtgactgccaagtttagggattcatgtgagctgtttggaatgtttgtttgtttgtttgtttgacagagtcttgttctgtcgcccaggctggagtgcagtggcacaatctcagctcactgcaacctctgcctctcaggttcaagcaattctccctgcttcagcatcctgagtagctgggattacaggccaccacgcctggctaatttttctaatttttgtattttttagcagagacggggtttcaccatgttggccaggctgatcttgaactcctgacctcaggtgatctgcctccttcagcctcccaaagtgctgggactgtttagtgtgttctaagccaggggtccccaacccttgggccgctgaccagtaccggttcatgacctgttagaaaccaggccgcacaacaggaggtgagcagcaggccagccagcattactgcctgagctctgcctcctgtaagatcagtggcagcattagattctcatagaagcacaaaccctattgtgaactgcacatgcgcgggaactaggttgcatgttccttatgagaatctaatgcctgatgatctgagatggaacagtctcatcccgaaccccctacccccaccccggtccccatcgtccatggaaaaattgtcttccacaaaaccggtccctgatgccaaaaaggttaggtaccactgttctaagccattgaaatagtgccatcccttctggaaaattgttacccttgtcctggagtgctgtagtcactggtatttcaccaggatgttagggtatttcaccaggatgttagtgagcacatagatattgaatatttcgggcaatcttagaatgtttactgggagagttttaaaagttagccttcccacatccctccaagaatagctgtttctctttgtagctggaatgtcatgttgtactcttgattctcctttgtacctgttcttagccattaaggtgattggtggtcaacttcgtataaaatacaactcaattttaccattgttcttattgatgcacatgaatgtttctctttatgcatatcactgagggaagtatagtagcctttgaaagaaaggccttcttgtagtctcccctggctctggtagcaaggtcaggcaaaagtgttgtttttgcagttgtgactccatggttgtgtttttctttacataactgatgttttaagtcaggaaatatgactttgccaaatgatactgagctatattactggtgagtttgtttggttcctgatttatttcagtaaatctgggttgaatagtttagtagtagatgctggggaagatacaggaaatagtgagtttgagactagaaatgattgagttagacatttaatttaggctttcccaatcaacttacttcataccttttgccctgcttactcatcccagaggtgaggaacaatgagaagaggggtcaggcaaaggccatccctcagaatgtggttacttaggtctgtcgccaaaggcaacctatctactggaaaatttgagctttactgtcttctgcagtatagtgttggaaatgcagtattttaaaaactaaattgttatttatagcagtgaataaaatgtgaactctttaaaaaaagagcagtgttactgtcccagctagcacaatagccacccacatgaatcatctgaacaacctcctcatttctgttttatctacctgaaataggggtcagcggtaggtgatgatgaaagcttgggaaatcatgccatgcattaggcaggagaaatgctgtggtgactctttctgtgttgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatattgtagccactagccagatgtggctatttcaagttaattaaaattaaaatttaaaattcactgaacagacatttctccaaaaaagatttataaatgaccaataaatacacggaaaggtgctcaacatcaagtcattatggaagtgcaaatcaagaccaaatgaaataccacttcatgtgcactaggatggttagaatcaaaaagacaataacaagggttggcagggatgtggagaaattggatctctcgtacgttggtgggaatgtagaatgttgcagccaccttgaaaaacacactggcagttcctcaaaaagttaaatatagagtttccatacagcccaacaattccattcctaggtatgtgcccaagagaattaaaaatgtatatttacacagaaacttatacatgaacattcatagcagcatttcataatagccaaaaggtgaaaacaaccccagtgtccattaatggatgaatggataaacaaaatgtggtagttgcacacaatggaatatcattcaactataaaataaattaagataaagacgcatgtgtatgttcatcacagcactattcataatagcaaaggcatgtaattgacctagatgcctgtcaacagtggactggttaaagaaaatgtggtacatatatactgtgggatactatgcagccataaaaaagaataagattatatcctttgcagtaacatagatggagctggaggccattattctgagtgaagtaacacaggaagagaaaaccaaataccacatgttcttacttataagtaagagataaacattgagcccacacagacacaaagaagggaacagtagacactggggcctacttgagggtggagcattaggatcgaaaaattgtaggatactatgctgattacctgggtgacaaaattatctgtacaccaaacccctgtgatatgcaatttacccatgtaatatgtatcccctgaacctaaaataaaagttggaaagaggaaaaaaaaagatcactttgggaagaattgatagcttaaattattgtgtcatccaatgtatgaacaaggtatatctctattatttgggtattgtttaatttctctcagcagtgttttgtagttttaaaagtacaagtcttgtacatcttttgtcacattcttaaatatttcatatattatgctgtggtaaatctgtttttcatttgaatttctgattgattgttgttagtatatagaaatgtaattgattttttgtatgttactcttatgtcctgcaactttgctagattcacttattctagtagaatgatgtatattgcattggatagtctacatagatgatcatatcatctgtgtataaagacttcctttccccaaaaaaagaaataaagtacagatacatggtgcaacatgcattaacttcaaaaacattatgctgagtaaaagatgccaaacacaaaagaccacatattgtatgatttcatttttaagaaatggcctcagtaggtaaatctgttgatatagacactagattagtatttactagggactgggaggaggagagtgtgggcagtgactactaataggtatggggtttcattctgaggttatgaaaattttaatggaatttaggtagttcttagtgatcaaggcacaactttgtgaatatactaaaaaccaccagattgtatacttaaaaagggtgaattttatggtatgaattatatctcaataaatgttatttttaaaaattcagttccttagttactttagccacatttcagttgctcagtagctacatgtggctagtgactgcatggtagacagtgcagatttagaacgtttccatcatcacagaaagttctgttagacagcactgatctaagagtctcaatctgagaccaaaaaataaaggaagaaaaaccagtctaaaaaacacagggagtggagaacagattatgttctgaagaaatgttactttggggtaattttaccctttgttgccctttgactgttctactaggagtcctcaacatgattttcattttattctcaaaacaaatgcctgtggtaggtactgttatactcatgttttataattgaattatatgagttttaagatatttgtgtagtaagggtagagcaaaatttctaacctaggtacataatctctgttacattgtttacctctgtttatggtatttgattttcttaccaaccatccttcactcccactttgttgctagcccactagagctattttcagtaccctaaatgcacagttctttttgtgccatagcagatgctagccctccttcctccttctgccgtctcccaacactagtatgtgcatgtgcacacatttactggccccacttacctgaaagtgtggtgcacatctctcttcctttgtgaagctatctgataccacagttttaggggctactctctcacctggttaaggttacataatgtcgcaagatataagcaagaatgctgacaggattcttgttgtgacactatgacacattgagcccaattcatagctgctgtgttggtgactctaacagggaagtggtcttctagtccaggcccttggctcccatttatacattatctcctttccattcacagccttctttaatccccacccacactgctacagtacctgactgaactttgcctttctttgcctcttcatatgtttttctgcttaagctttttgaacctgatgagatactgccatgtttttatatttttctgctcataaaacccttaatggtaaaaagatacctgattgaattctgaagtgctttcatggctttgcctgattctgaggtcatattttctaactttatgctaacatcagtttactctctggttttatatggagcatgtactcctgtagcttctgaagaaaggtttaatgggaagcaaattttgagactacatgtagtaggctaaatcatggcccaccaaagatgtacacatcctaattactagaacctgtgagtatgttactttacatggtaaaaggatctttgcagatcttattaaatttaggattttgagatgggggattatcccagaatatttggatggacccagtttaatcacaagggtccttataagaggaaggcaggagggtcaaagtaagtaaaaggagacacgacaatggaatcaaccagagtttggagtgatgcactttgaagatggaggaagagggccacaaaccggggaatgcaggcagcttcaagaacatggaaaagcttctcccctgaagccaacatcttgatttgagatttctgacctctgatcagaactgtaagagaataaatttgtgttgtttaaagccactaagtttgtggtagtttattacaacagtagtaggaaattatgaatacaccatgtataaaaatgtcattatgccctttaacttgattgatagtttatgtagacctaatatatatgtacacatactagtctccatggctccatgctgcagtggacccaggacccaggcccaccatccatggactcaggttccaaacccaccccagcagacttggcctccagactcaccctggcggatccgggctccaggatcatccctggttgtctcagactccaggcctgcccctgcagacccagtcttcaggcctaccttcgtgatcccaggcaccaagcctgcgtccttgaatccaggtgccaggctcattctagcaccaggctagtcccttaagactcaggctcaaggcccagtgcagcaccagattgagctttatggacccaggattcacactggcccctgtgaatacaggctttaggcctgccctgcatgcccagctgacaggcttgacaggcttacctgagtggaccctggcactaggctgttccccatgcacaccaggattgagatccaccctagcaaactcaagccgtaggcctgtcctaatggacccaagtttcaggatagcccacctgaaaactccagcagcaagcccccctgccagacagccctccggaatttctggacaggctgactggtaaaaggcttttcctgccaaagccagtctgtgaagactgcaagtgcctacttcttcttctttttttttttttttctgagacagggtctcactctgttgcccaggctggagtatagtggagtgatcacagctcactgcagccttgacctctcaggctcaagcaataccactgcctcagccaatcctactgcctcagcctcctgagtagctgggaccacaggcaagtgccaacaggcctggctaatatttgtattttttgtagagacaaggtttcttcaagttgcccaagctggtcctcaagcaacccacccgccttggcctctgaagtgctgggattacaggcgtgaaccaccatgcccagccaagtgcctgctttgtaaaatgtgcagacactaatgcaaaactgcaaggatcaccgataatcagggaaacatgacatcaccagaggaacaaaatgaagcaccggtaaccagtcataaagaaatggacatctatgaattgactgataaagaattcaaggccaggtgcagtgtctcgcatctctaatcccaccactttgggaggccaaggtgggtggatcacttgaggtcaggagtttgagaccagcctggccaacatggtgaaacctcatctctactaaaaatacaaaaattagccaggtgtcatggcatgcgcctgtaatcccagctactcgggaggctgaggcaggagaattgcttgaacctgggaggcagaggtcacagtgagccgaggtcatgccactgcactccagcctggctgacagagcaagactccatctcaaaaaaaaaaaaaaaaaaaaaaaagatttcaaaataatcaaataatcatcttaaaagaagttcagtgagttaaaagagaatatagatggacaacaaaatcaggaaaataatacacaaacaatatgagaagttcaacaaggaaacctcaaaaaaaaaaaaaaaaagaaccaaacagaaattctagagctgaagaacacagtgtctgaactgaaaaattccacagaaagcttcaatagtagacttgaagtagaagaaaaaattagtgagctcaaagatggtcatttgaaactacccagttagaggaagaaaaagacaactaaatgaaaaagagtgaagacagcctatgggagttatgaggtaccatcaaacaaagcaataaatgcatatgagatttccagatgaagcagagaaagaaaaaggggaagacagcttaaagaaataatgacagaaaatgtcccaaatctggagacatgaatgaacatccagatccatgaagtccaaagaacctccaactagattaaagagatcttcactgagacactttataatcaaattctcaaaagtcaaagataatttcaaaagcatcaagagaaaagcaaaccatcacctacaaggaaacctctataagactatcagtggatttctcagcagaaactttccaggccaggagagaatgggatgatatattcaaagcgctgaaagaaaaaaaaaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataatactagcagattttaataccccactttcaacaatgcacagaaaatcaataaggaaatagcagatttgtactacactgtaggccaaatggatctaagagtcatctgcagaatatcttatccaacagtagcagaatacgatgttcttttcaagtgtgcatggaccagtctctaggatagatgatatgttaggctacaaaacaagtcttaacaaatttaagaagattgaaatcataccaagtgtttttttctgaccacagtggtatgaaactagaaatcaaaagaaaacggaaaattcctaaatatgtggaaagtagacaacacactcctgaacaaccagtggatcaaagaagaaattgtaaggaaaataaaatcttgaggcaaatgaaaatggaaacacaacataccaaaacttatgggatgccatgaaagcagttcgaagagagaagcttataatgataaatagcaatacatgaagaaaaaagaaagatctcaaatagacaacctaactttacaccttgaggaactagaaaaagaacaaactaagctcgaggccaaaaaaggaaggaaataataaagatcaatgcagaaataaatgaaatagagactagaaaaacaatagaagttatcaacagaactgagttggttttttgaaaagtaaaatcaacaaatctttagctagactgagaaaaagagaagactcaaaattataaataaaagagacattgcaacttaaagagatacaaaggtttataagagactactataaacaattatataccaacaaatttgatagcctagaagaaattgacaaattactaaaaatacagcctatcaagactggatcatgaagaaatagaaaatctgaacagacctataatgagaaaggagattgacttagtaatcaaaaacctcccccaaaagaaactcccagaacctatggcatcagtggcaaattctgtcaaacctgtaaagaggaattaatgccagtccattttaaactcttccaaaaaattgaagagggaatacttccaaactcattttatgaagccagcattaccctgatgctaaagctagacaaggacagtacaagaaaagaaaattacagaaaatacaagaaaaaaattcctgatggatatagatgccaaagtcctcaacaaaatactagcaagccgaattcaactgcatattaaaatcatgcatgcttggtacaacagatatatctgaagagactcttttctctatggttggtttcttcttgatcatcactacctcttagtgtacaggaagctcaaaatattactgtgtgaccttaacaaaataaatttacttctctggtctttaggtttttttcaatgggaaaatgggaaggttggctccattagtttctaaagtccctttgagctctgaaatgagtaattttataatttctaagtgtttaattcatcaactacatgactttaccttttttcttcattacctgtcaaattcacttaaaaactattatcacacttcatttgctttttaataaatttctgacagcatgaatgggagaaaaaaagggactatacagcatgatcaaagaagatttatccctggaatgcaaggatggttcaacatatacaaattgataaatcacattaacagaataaagtacaaaaaccatatgatcatctcaatagatgcagaaaatatgtttgacaaaattcaaaatcttttcatgataaaactctcaagaaattaggtgtagaaagaacataccttaacacaataaaggctgtatatgacaggcccacagctaacatcaacactcaatactgaaaagctgaaagccttttttctaagattaggaagacaaggatatccactctcaccacttatagtcgggataatatgggaagtctgtcctagccagagtacacaagaaaaatgcatccaaatcagaaaggaagaaataaaattttcggtttgcagatgacttaaaattatatatcaaaaactcttaaaactccaccaaaaaaacctgttaaaactaataagcaaattcactaaagtggcagatacagagtcaacctacaaaaattaatagtgggggaggagggagtagggatggttaatggtcaccaaaatatagttagatagaatgaataaaatctagtgtttgatagcacaacagggtgattacagtcaacaataatttattgtacatttgaaaataactagaagagtataattggaatatttgtaacacacagaaatgataagtgcttgaggtaatggatatcccatttaccctgatgtgattattgtgcctctatcaaaatatctcacataccctataaatctctacacctacgtacccataaaaattaaaaattaaaaacaatagcatttgtatgcactagcaatgaactgagaaagaaatcaagaaagtctgatctacaatagaatcaaaaatatataattcatttctaagaggtttttttgttctctcttcttgtatatagcttcaagattttgtttcttatatgctatgtctaatgtcctccaagagaaagagagggaaatggaattataattaacattgtcttttccctatattatctgttttctcttattttcttttttcctgttttttagctttggtacttgtctgtctttcatgttagaggtgtttctcaagcatcttcagctgtttgttgctattaaggaaaagtttattggaaactgtgttcatgactgtggcttgttcagtgatggacctcatgtggtgtgattgagggaaacctggctatttatggggagcctatcagttcttttttcttaagccagtcagcttttctaaataggatttctaaattgaatcttttgtgggagggagtttgggagtaataagctcatgtctagggctggatccttaatcattggctgcaaagacttatttaacccttgttttcagtaaggcatcccatttttgttctcagttatggctggtgttcctgagttcaggggctctgattcaacctctccagagagtaacttaagccctctgctatgtggagaaaaggcagttgccagatgctctggttggagtgagagtatgtgaaaatcttacttctcttttttaaacaatttttcagcatccccccaccacttgctttaaaaaaaaggattattttcttcaaatgtgcccataagctgcaattcctgagcttttaccttctgttcttccagggcactcaggagtgaactggcttacttgcctcaatttagattcccccactgcaggtacttggcacaaagaagaaagatacaatcaagtcagttacctcttttccaaatgcttttcattttaaattttgtgggcctatctcctttgctgtcatcatctccccacgctcttcatcttgttggtttatatcttttctaattcttcagtcttttgatttgtagagggagttagataaatgcttgtatctgatcagttatgtttaaacaaaagcgcctccctcccttgacaccttctctttttcttggacttctgtttcttagactgtttccaccattagaataagagcttgtcaagggcaggaaccagggtatttaatagctccagcatttgtataatgcctggagtatagtaggattattaaataaatgaacatacctttattttcaattatagatttctctgacttgagaaataatttcaaataaaacagtgaagtctctcttacagataagttcggaagctctcctctttcctcgattcttgcttatttttatccacagtgcgtctcgtgaaggaaaagaatggatcattctttcttgatttcctcgttggtaaagtatttggctttaagagctattcaaatgaatgtgcaaagtaagagtaagttgggtgtatttctagcactaagttgttgaggttctagaaaggtagttttgtgccttctagataccatgtctgcctttcctaatgagcctggtatgtatactattctgcctagcataactaggagcaataggatagagaagtgggatataccatttcaaagattcactgatgctgcttagaaacaaaaatctaaatgaaaaccaatgtacataaattagataattcacatataccattagaaattccacttaaagtcagtactgctagaaaccttgtcattaccttgctttaaatgctaagcgctttctgattaattctttttcagtttatttacctgggaggtattcgatctaagcaccagcatccctgcccccacttttatctattaatatttacaggtttttccctctttgaagctccctattgaattctgaatgactttgaacttggaattgctctgggtctgcttttcacctcctttctctacctcccaccccaaccttcactaatttgcttttttttttttttttttttttaatatttgggtggtttcttcttgcattctcttttttctatatgctccatgacagcctggactacatttctgttactcactgctgcatccagtgcttagcacatgctgggccttaagtcactgtttattgaaaagaataaatggattactcgttgaaatttttttaattatgaataacaaaaattagtaatctaactatatattatcaatcttttgctgtcttatcttacaggttttctttctggttttcatactggatagtctctattgacctagcttcaagtttgctgatttttttctactgtcaacttaaacttgctgttgagtccttctagtgaattttttgtcaattatagtacttttcaactcctcagtttctattttttttaagaattctttttctttattgatgttctctatttggtaagtcattatcctcatactttaaaaaacttctttaagtatagtttcctttaattctttgaatatatttataatagctaatttaaagtctttactaagtctaacagctgagccccctcaggaagtttctattggctgctttttttcttctgtatgggccatcttttcctgtttctttgaatgtctcataatttttctgttgttgataactgaacattttagataatatattgtagcaactctggattctgatccactcaggtagtggttattgtttttacttttgtttttccattgcttaatgacttgcctggactaattctacagaggctgtctttgctgaaatgtgtggccactgaagtttgtgctaggattttttgttttgttttaaattcttgtttttatttttaagcctggcttcctagggttttccccttggtcatccaatggttggccacaagttttccttaaacactttgagccaataagccttccatcttttgctgaaggaatctctgtgtgggttggggcatacgttgaaagttcaggcagtttaaaagtctgccttggctttcactttctgcttgtgtagggcctcacagtcagccaggagcagtagataattgggaatctttctggtctctcttgaacatgcatacatgcacagagccctccaaatggatacaaccttccagaacccccaagtatgtcagagctttaagctttctatggctgtctcattccccacatctaccttttacatgttggctagtgtcttgcttacctcaaccagtattgcagacttaagcagctgtgattgtttctaatgattgctattgtttttgacagtgcccctggccatggggctttctcttggagctccatatcaagtcagcttccttcagtggaactgtccacaaagctacaaggccagcgaattgtggtagaagcggacccaaattaaaatgtcacagaccctgctggtcttacctaggatcattagtagctgaggtcctcactccgccattccagaagtcctgccccccacctctgccttaggttttcaatgtgtttttatagctgtttatagttttgtggcttttcatttagtataaatattttctcatgttcttgataactcattataactaatttctactggctctcatcatttgaatgtctcataattgatttggtaatttcccctgttgttggacttcagataatcactggtgtaatttgcctttcccaacaggctctaacctgaatgaggcctgggactgctttgtttactacttcatcctcagtgcctgacacagtaattcttgttaaataaaggtcaccccacaattttttaaatgttataaataacactttgaggtggatcgtactgccaaaactgtattcagatttcagattttttttaagaatggagtttcagaaatggaattgcttggtcaaaggatataggcatttctaaacctcttgacataggttgccagattgatttcttaaaaagtcctatcaaaatagaaccttttggccgggtatggtggctcacacctgtaatctcagcacttcgggaggctgaggcaggtggatcacttgagatcaagagttcgagaccatcctggccaacatggcaaaaccctgtctctactaaaaatacaaaaaatttagctgggtgtggtgacgcgtgcctgtagtcccagctatgcgggaggctgaggcaggagaaccacttgaaccccagaggcagaggttgcagagagccaagaccacgccactgcactccagcctaggtgacagccagactctgtctcgaaaagaaaaaaaagagaacctgttttttcagcagcatccttatctgttgcattgtatatttggcgacatcagatgtgctagttgctcaagttttattgaccttattggccaaaaaaaaaaaaaaaaaaattctcgttgaactattttgtgtctttttttgagacagggtctcagtctgtcacccaggctggagtgcagtggtgcaatcacagctcactgcagcctcaacctcctgggctcaaatgatcctcccatctcagcttctcaagtaactgggactacaggtatgtgccagcagacccagctaattttttgtttgtttgttttagagatggggtctcaccatgttgcccagcctggtcttgaactcctgggctcaagcagtcctcccaccttggcctcccaaagtgctgggattacaggcatgagccaccatgcccagctattttgtgtctcttcgataaccaatgaaagtattagttttcctcatactttttaaaaaaaattctttctataaattggccatttgtttttcccccattttgctcttagttgcctaatgtttttcttgctaatttatgtaaactttatatatcaaagatatttatctattattgtcttttatatatttttaaaatttttcattttgttcctgatgagtttggatgtgcagaaactaaaaatcatacagaagaagcctctttgttcgatatgattggatattacaactggtctgctaaagagggaggagtataaaaaaagtctacagatatctcttcaatattttaacttgaagacaaaatatacattaagtagctaatcctttgatattgtgtgacccttttctttgaataagtctaattgattcgaaacctgctctatatttcttttatatatctcatccaaaatgcatcatcaacgatgtccagttttgatttatttaaaatggggtaatgacttaatgagctgtaatctgagtgcaaaatccttttggatattttatagatccttgctccccccgcccccccacccagtcttttgcagttttgtcacccacatttaattcagtatctcctttatctggtctttgaagccagttcttctcttttgtagtcacattcaattgctgtaacatatatgtaacatataattaagaattataggccggatgcagtgcctaacacttgtaatcccagtactttgggaggccgaggtgggcagatcgcttgaggtcaggagttcgagaccagcttgaccaacatggcaaaattccatctctactaaaaattaaaaaaaaatagctgggtgtggtggcacgcacctgtaataccagctacttgggaggctgaggcatgagagtcacttgaacctgggaggcagaggttgcagtgagccaaggttgcatcactgcactccagcctgagtgacagactgagactgtctcaaaaaaaaaaaaaaagaaattatagtaacacctacacaaccaacataaagaggtacacatttaggaacaaatacaaatagctcttggtatgtagacaacttaatttgtggggttcatgggctcatatgtactacacagtaccctgtcagcattgagcagtcagcatgcagcaggcattcattaggtttctacagagggaatggagaatggatcagtctgtgaaatttgttaagtggggtcaattaagagtgcttctaccatggtcaaaatctaatcagtctttttctttgttgtgattgtttccatgcttagaaagtccttcccttcttgagagttatgtgaaaattcacctacatttttctgtctttcttttgattcatacatttaactctttagttcatctgaaatttattttgttttttagtaagaagtaaggatgtaagcatctaaatagattttccaccttcaaataatgtgctgttttttttttccccagcatagccagtgcattcttcaaaggcaaagatcaaaaatgtaatttctagttttcaacaattagaataggggttgaatgggtctgggtcttgggagtggaaggtcagtatggtccttggggttggggaagggcaggcagagcatagagtggaatttaaaacacacacacacatacacacacacacacacacacacgcatgcacattcacatgataaggagaaaaagataactgagaaattggataataacagagctagtaggaagaggatatagtacaatgaaccctctttagaatgcaggccctttccaaaatgaaaatttgaagggtacttgggctctatttgatgaattatagtgaggtaaagtagtttattaagcatttgaataaacctaaatagttaataagctattgtttattaataaaaggtatgccaacaaggaagtaattatgcaaagttctacagagctgtcaaacttgaaagcatgtttttccccaccgattttgccagtctctactgggaaattatttatgatcattccctcagtcttttgaataagtcaacttctctcagtgcaatcattgctttttcctgggccatagcattaggtcaattagtgaaatattaggcataatactctttaaggctatgaatggccttgaagtactgtatgaaaaatatgagattaatattaagaagctgctatgaagcaaatgttaccagtggaaaattttattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatcaaaaaataaaaaaaaaaagatgttggcatggatttggtgaaaagggaacactcttacactgttggtgggaatgtaaattagtacaaccactatggaaaacagtatggtgattccttaacatctaaatagattttccaccctcagataacgtgcctttttttttttttccaggatagcaactgcattcttcaaagggacagatgaaaaatgtcatttctagttctcaacaattggaatagaggttgaatgggtctgggtcttgggagaggaaggtcagaactaaaagtagatctaccgtttgatccagcagtcccactactaggtatctacccaaaggaaaagaagtcattatacgaaaaagatacttgcacacacgtttatagcagcacaatttgcaattgcaaaaatatggaactagcccaaatgcccatcaatcaatgagtggataaagaaaatgtggggtgtgtttgcgtatatatacacacacacatatatatacatacatatatacatatacatgtatatatacatatatatacacatacatgtatatatacatatatacacatacatatacatatatatgtatatatatacatatattcacatacatatacatatatacgtatatatatacatatattcacatacatatacatatatacacacacatatatacacatatatatacatacatatatatataatggaatactactcagccataaaaaggaatgaaataatggcatttgcagcaaccttgatggaattggagactgctattctaagtgaagtaactcaggaatggaaaaccaaacattgtatgttctcataagtgggagctaaggtatgagaatgcaaaggcataagaatgatatattggactttggggactcaagggaaagtgtgggagggggtgaggaataaaacacattgggtacagtgtacactgcttgggtgatgggtgcatcaaaatctcagaaataaaaaaaaaataaatgaatcaccaaccaccaaccaaccaatatgggagatttgtttcagctggagggccttagtttcttaaagtagttttcttctcttgctctggaaagtactaattccaaggcctcttttctcctcccagttgtaggatattggggattcttactagaaagcgtaggcagagcacatgcagccagtgtccccaagttttttagaccatctggagctacctgtggctgctatgtagcctaaaacttcagaaggccttatgatctattggcagatggctaaactgggatccttgtgtcagggttttcttttatgttatttttaaattccagaatagaagagaaaatgaaatggagaaagaagacattgaaggttgtggtgttttctgtgaagttcaagaagtattgacatttctcagaagagtatgactatagatgatattgttactgtttggggttttttgttggtcatggtggtagtgatggatttttttttttaagagtcacgtttcttcacctagaattagctgaggaaaagtggcatctgtattgatggttttaatagatatgattttattggtggtgccttcagagtagtggcttagagtaattagaaagacatcattgctttgtataggtcttaaaaagattgttaaacttttaattcaatgttggctgagcctgctgtgcctgatacattaaaagaaaaaagtcttatgatttactgaaaagagtaaaatggtcctgatttcagttactcccttctactcatgcacactgtgttgcttactgccctttttaaatccaaggtgattcttcaacctcatacattgttttaacatttcactctatgtctaggacatgtctagaatatttaagtgcctttttcttggaaataatagagatgtatcatacccagttttatttgcttaggtagcagataaagacttcagaaatactcaatatttgagtatttgggttggaatttgacactgtgtgtgtgtgtgtgtgtgtgtgtgtgtgtgtgtgtgtgtgtgtggactcaactagcctaaaagaaagataaatgcctcttagaagctagaggggaaaaacctatgaaaacttagtttgggatgtacctatgatgaagaatttgccctctgatttctcttccatgtggctgattttgaaggttgtatagtattttgtttttatgttttgatacagctgttaattcttgaccattttcctcagaaattggcatttccagattggcaaaatctagtatcattgtaggtagctctttacagataaatttgtacgggagagtatgcaatatattttgaaacttctgtttttgtgtgtacaaatctctaaatcagcccagatggtggccattatggattagtaatagcaagaaagaaagctgttaatatcacagcttctaacatatgtctcctgattgtgggtatatatgcctggtgtcaaagataacgctacagcatacctattacggcttttaaaaagttactaaggcatttctatctgtatcagccaactagaaggatggattagacaacatgatatatgtagtgcttttatctctggcaggtagctaagtctttgaaagaagatatatcttctcatctggccagaatgttttgattttaacttgaaatttcctaacaagagttcttatgtgtttattattgcatgttcttatgtgtttatttttaaaactatcctttagcatttaggcacattaatttatagcacctgtagagcaatcagttgcaatatctgcatatatgccttttattttctgtaattgagatctgtattatatttatataatcagtgtgtaagttactctaaaagttatctagtcaagcttgactttaaagatgtctttgtaacttgttctacattgttactgtttccttcagaaagttaagtttccaagcttctttaagttacattctagacgttccgaggggttccaaagtgttgaaaaggaaattgaagtaagctttggaatatgttaataagcttcaactggaaacatgtatggtagcagctgttttaaaggccgctgatagtgagatgttaattgagtactttttaaaatatattacccaaccttctctaagctctgaagcttcaattacatttatcctaggcactaagacttgaatccaaaggggttacttcactgctcttcttgaggttgggggtcctatgttattcactattgtaacagcaacagattataatgattggtaggcaaccaaatgcttgctgatttaattaaacttgcctagttatttttaccttattgtaaattttggtctatagagctgaagagatttctccccttttctttgaattaagaaaaagccacatatgtgtggtaaactccccttcaccataatgaaactactttttcttcattctttgtaaaatattaacccagtagagtaaaaactgaattcttccatgaatggtggtatttcttctatctggcaaattaaagcaatggagaccattagggtataaccctgaactttttgtgctccctccaccctggtccgttatttctttggtataaaatcagaagaatgaaatcttagtagagttctcgtaccactacacaagacaaggtaaccatgctcttgaaatagatttaattttagatgttgagtgttcctaatgggtggcaaattatttatgctaattgtgaggaataaattacttatagatttattaataatttacacatagtaacttaaggttcaaagtttgttaacacttattttatatatgacattcacatcaactgtatgaggtaactagatttttctttttccatctcataaatgaaaaaaacaggttttttgtgaaaatgcaacttgcccaaagttgtagaattagatttttataaacagatctgagttacttaatatgtgtagaaatctttacttgacaaattttcgacattgtaaggtttgtaattttatctcagaatcctagaattctagagctgagagaaacttaagttgatacaaatggaaaataggttctttattgagtgccaggttaatatcaattgtagctgttgagacttggagttgagacatttttattgacttatttccagtttattggcagagagtgccctaattgattaaccatgcctgaagtagacatggggcaacatatagatgacaaatatgtggcagtcagactcagtaacttgatatagcattttgaaagtacctaatatagctttttacagattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaattaacagcgggaactgcggccactgattgggaagcctaaatacaatgagggtaattggatcccaggatggcaaggaccagtagcacttaattgccaaaggaagggcaggtatggttactgaaatggacagcagagtcaaagcaacaattagaatgaactgactagtacagggtgatttcttttgctccaagcaggcccctggctgttctctggagattctttattgtccattcttctccatggccctatctgaaatgctctttggggagcacatttttcttggggactacacagctttcatagctaacatattactgttgagggtttggagccatgaattattttagagatttaatagctattggctgctgcagggcagttttggggtttccatgacaatatcgtttcgtcaaaaaatgtcgatatttttcttcttgtttttagtaagctccacgggggagaagccacatctagacatagtttcttagcctgaaaattcttctacttactggcctctgtgctctgcccttttctttcagcttttgagttaatagccagctgcctcgaggtaggcaacacccttaatctgatttttgctggctagttttctttcctgtcctgaagggaactcttaaaacagcttggggttgtggtttcatctcctgctaagacagccacttctctgagttactgcttataatcacctcagtttgagagtacaggagctgttgatgtttatagtcctccaaagcttcaaattatgtgactttcagtcgatttaaattgaaggctgcaggcacagaatggctggctcaagttctatttggtctctcctaggactgggctcaaaagctgcaagaggaaaccatcatacatccatatcccgaaaatgtcctacatttccataaactgtagcctcatttggcatatggtattaccaaatgttttgccactacctaacaagagtaaccagctttaagagtcactgtgaattggttagagactgatgggattagttaagactaattttccttaaagtcttttcttttccttgatataggtatattccaagtgttgatgggcagcttggggtttatttactttttagacttataaattgggagaaattaggactaagggaaatgattttttctaaggacatgaacatttataaaagacaaggaaaaagtatgacggaagaaatatgtggatgtaattgccaagaaaggagttcatcagtgatgggtaaatggtcaagaaaaaatggacagtgtgatctctgtgtgatcctgttaatatatattgtgccagccattttcctatttcagccaccaagtgatgcagtttacccagggtctgggttccagtcctcattgagaggaaccatggttaagaagaaagtgaacttacaaccaggagtttatatgttctcccacatttacccttcggatggtatctaatcattttctcctctaaatgaaatgtattacattctcttgtggctgatttctctagtacttatcttatatattcttaaacttacctttatgtaaatgtgctcaatcaattttagtaagacttaaacttcctgagctctaccttttaacagcatcctagactgagagttagtctcaaaagtcaagttctacaaaagaatcctttatgctgtttaacttaatatgttgtagtgttgtgacttctctacctttcagtgtttcttgattaggattcttcaaggtatttcttttgtttttaatcttaaaaaaattaacatgtcaaataagagaataaatagtacctggcctttattagaatcttattttccataatgttttaaatattttcatatcctatgagatatgaagggaagagttatcaaacaataaacttttgaacaccaactatcagccttttactacaccatgaggcttaataatagtaaatagtagttggtttttattgagtgcttattaaataccaggcacagtggtaaacattttatcttatatatattcattttatcctgacaacaatcccaagagataggtggtgttatcttcgctttatggatatatgtaaaccaaggctcagagagttgtaagccacttgcccagggttaccaggctattgagtggtaaagctaggagtctaaggaagttcaactccaaagtccgaactgtgtagctaccttgctataattgtagatggtccctgccatttgggaacttggtttaacagaggaagtaaacacggaaataataaattgaatgatttccctttcttagtttggccatagttgttatgatcatttcataataatcatttctataaatgtaagttggcacatatgaagcacctttggtatgatgtcagaatatcatttttgaagtagtgaactaaaatggcatatcaagtgacccaaaatgtcatgaagctttttggaaacattcactctacgaaatttattgaacaattattatggtccagggtcttctgggcccagagggtacagttgtgaataatatagaagctgtcctttctgtcatggaacttgcaagttagagagggagagacaggttaaataattctacaaacaattgtttaaaattcaatggtggtgagtgctgtgaaggaagccatggaagtgctgcaacagtataaaaagggaactgaacctacttcaagagtaagaatcaagggagtgattcaccttgagtagagctgtctttcaaactccataacatactttaatattttatcagtgagtcttgtaattcttgatcgttattctttctactagtatactgcagtcttgtgctttgtgagcaccaaggggaagagagcttaacttggtctgaggggaaatgaaaacaattcttagatacttaagctaaatcttgaagggacagtagagaggaattagaccaggggaagtatattctaggcagaggaaacagtttgtacaaagtttacacaaaggcattgggggcagatgagaacataatcctttaaagataattatggttagtatagctggatgcggtgtgtgtctagatggtattgagagatgaggctggaaagatagatagaaaatgtgaaatatttatgtaaccaaatctggtttctgtagagttggtctattaacttttccccatatttcagaggatctaagagatatgagattttcttttctcccccatattttaattgttagcattgttaaataaagtgtaaggattggcctaaatagatgtatagtgagatatcttatagttttaaaatgtatgtaatgcagtaattttaagggttgcagtcagatacccaaagcaaggcaattaattagtgaaatacatttggatctcctggctagactgaggcttgagtgttgtagaaatacatattactgcatgtgtataagattgggtctgcctgaagagaaggtttaagtgtggtgttccaggtatattccaatggtgaggcagaatattttgttaatgatcaaaggagaaataagagatcaagtgggaggaaattattaacagtgaaagcaacatgggcagtttgatgtagagcactgagaactatgtaggagacacatggcttgcatctgagctggcctctaccactgaccataggcaagtctctgggtattttggaatctgaatccaaacttcctattgaagtataacatggcatacagaagagtatataaattataagtatgtagcttgatgagcttttacaaactgaacacattcctgtaacagcacccaagtcaagaaactagaatgttaccagaagccctctttgtgctacctgtacttccatttgtttaatctttaaaataggggtaataatgtcttcttcacttttagaagtgctgagaaaatgacaacttgagaagtgccttgatctctctcagtgttgttatacaagtgaaatgagatgctaggaagtaggaccagcttccaaaattgtagaagtacatagagcttacttatagtattattagtaaacctattaaattggggatgcataaggagataactctgaaaaccacaaagcaaaggacaaaacagttgtctaaaatgaatcataaggatgcatgggcatagtatatgtgatgtcttttgttcttataaggtgtcattcttgggattcaggagagcaacttgtgtatttttacctgttcaaaaaatgtgaaactattctcattatttgaggatgctggagaaatggtagcttcctgaaataaaagtaagttctgttttaaaaatagccataagtcttgaattcaccaaatatttctgtttgggtttcaggaggtctgatgctgagtctctttttgttaatctgaatgcttacgaatacttttagaatgggaagtcctccttcatgttcttaatgccattagctaaattgatttttttcaaagtaacaaagtcatcataaatgaaattacatacattagtccccacttatccaaggttttgctttccatggtttgttacgtgtggtcaacagtagttcataaatattacagtagttcaaaaataaagtattttgagaggggggagccacatttttgtaacttattatagtatattgttgtaattattctattttattattagttgttagtctcttactgcacctaatttataaaataaactttgtcataggtatgtatgtatgtatcagaaaaatcatagtatatatgggatttggtgctatccacagtttcaggcatccactgggggtcttggcatgtatcccacgtggataagggtaggggactgctgtactcttgtagtactttttgaaaaagtttcaattttgtttagtgtaataacagattgatgcataccatttcttacacgacactagctgtagtcaccacaataatctgcatttttctatcaggcctatttgctttccaattctccatcatctccctgtacaggtatcttattagatccccttaagatctattctgtcctttacctgtatacagtgaactaagacttttaatttctataaggtaagatcattttattagcatatttttgtctttgatatataaaattatctctgctgagctcaaaagtttagtaaattttttgattgataatttaagaaagtctttaacataggcagtacagttataagggatagacaaatagagcagctttatttataataaacatttggctcttttgcaggatttccagattttaagatacactgaacccagtttatagccttttatccctcacgcccccgacctttccctcccaccagtccccaaagtccattgtatcattcttagaaacattctaagaacttcatgttacagttctgaaaactgttacatttacacttgttgtatttctgaagactttgttacatgtgagttacaggtgaatgaatttgagggaaaaactgacaaaactcagcttgaaaaggaacccacagtgatttctctacaagggtattttttgaatttgtgaataatttattggcagcttgctttgcaaaaaatacacaaaaacctatggaaataaaattttaaaaaaaaagtcaggaaagactgcaaaaaccatgaccttgcacaaaggccattgcaaccgtatacaaaaaaaagaacacttctgttgaggacatctgcccagccttggactggcatcacccttattattgatccttgaagccaaggacaatgacctaaaaacaattatgtaatcttcctcattttatctttgaaaacctttgtcttcctttacttccctaaatacacacatagtttactgtggcacacatattttcattgcaatgccctattcccaaataaataccattttctgtttttttttttttaagaatattttgtgctattatgtgattgatgttggttagtgctattagtgaagaagttggtgctttaaaattgaagcaccagagtctacttatttcgcttaaaacacgtgctaatttttaaaacatatcttcacacctcatgaaaataagaggcattgtgtttaaaatgtatttttttttgtttctttcccattaaaaatttaattgtggtaaaattatataacataaaatttgccattttcaccatttataggtgtacaatttagcggcattcattgcatttacaatgttgtgtagccatcaccactatgtctatacctttgtgctatattaccctacgtagatattatgggaagaaggaaaaattcttcccataatatctacaatggtatagaattgttaaatgatttcttaagatagttttattattttagatctggattaagaaaatcctttggtaaatgttatagttggatctgattggccagaattcaaaccagcaagtaccttattcaatagctgcttttgtaggcacaggtattccagtaccacagggtaatgagtatttcaaacaaaagagggttagagatatgtctaatgtttattgccataccctcaccctctgggctttgatctttctggtggtcttaagttactactatagatttcttccttgctcataatatctatttggcaatgggactgaaatctggtaacttctattgggaacaaaccattcctctccactgtggaaatggctgttgtctcataagtattctccctcctgctcccgactgttaatactaaatctttgggtaaataaagttactcatctgtacaaagagattggagaccagtctaattcccctatttgaaggaagccccagagagttggaactaatagttaagtgatgcatttagaattagaacacacctgttccaatctccaatcagggaagttgattgtcttgtggtggttgaagaaacagagagggacggggtcagcagaaaaacctatgaataaacctccagtgccttatggtttttcctgaagtcagaatttagagcttgacaaaatgaaagtatttatctagttctaacccactctattaaaaatgaggaaactggcgcagagtgactgtaacttaaaaatatataaccagttagttgcaaagctagaactggacacccgtatgtcttgacttttgccctagtgccaaatatatgagagtgtgactctggccctgcctctaatagtttatttgcctacaagatatttagtggaattgtcagtgccacattactgtagaattatttcaaaagaaatatttttgatattctggttttgtatccccttctaaccaattaggaacaagatatttttagtgccagttaatagtgcagtctttcagcagaaaggaatctaaatcaatatgcagtgttaaattcactttaataaatgtgaaaattgtttttaaagtaaccattgattataaagagagatgctttctatacattttggtgggtacatatacagtatttttctcatataagtgaatacttactatatactattttttaaaagcctaaagtcctacagaacataaacatataaggcaactgaaatctgtacaccttctcaatatataaaataagtgaatatttgcttctaatgaaagagataaagattagataacttcaacaggggaccttggcatatgtctgataatagatatgagacagggatagcatattgattaaaaaagtcatggactttggatctggaatttttaggacccggattctcactgaaccagttacttgatctggggctatagccaagttatttaacttctctgaaactcgatttccttatctgtaaaatggggataaatatgctaccttagagagttatgagaattaagtgagttaataccagtacctcttagaaaaatgactggcatatagtaagtactcaatagctgtaataataataataatataccaatacatactaatactaataaagtatctgttactaataattttatcattgctactgttgctcttgttggaagattatggtaaaggtgacatgtgaacagataatccttttatgcttctatggtaagtataggactttttacctgtggatgcttttgactacttggatttaaatacaaatattttaatcataattaaacaactattaatgaaattttttgttaagaaaatatttcccagtccagatggttccactaagccagctccttgatcagttttctgtaccatgcagttaaactattttttccattttcatgtttatgttcctgaaagtatattcattgggattacttttttctgtttaaatactaaaaccaggctttttaaagtatcaaattgtattaatcatggtttccactattttaagtcttcttttgtactggtattgaagtacattttttttttcttcatcattatacactaatgtactaaccaatatagcttttttaaagaagcattgttacacctccctgattatgcttcatttaaaatgcagtcccctacagtcctctccaccaatccccacccccaacctttatattgttcttaacatcactttcttcaataactctggagtgagggagcataaacagtaggttatgggtgaaagtgaaatggccccatagtgctgtttctgatgactagaagagtagcatggctgagtcttgcagtacaccaagatgttctgcatgagaggataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgctaactggactgatcactacaactgtctttattttctgatgattataatgcattttatctactagagttgaggttttagctgagtgatcactttcaaaaagaatgattagtcttgatcaatagtgtattacctatagatgagacttttagcataatgcaatttccttagctggtgttgagatccatttcatctgttcaggaaatgaaagcaggagatatatagtactttggattgtttgtattgcagattagctaaatatttgtgggaaatcagaggtctaaaacatgcttaaaattctagtctgatatctggataaagaaaatgcagtacatatacaccatagaatactatgcagccataaaaaggaacaagatcatgtcatttgcagggtcatgggtggaagccattatcctcagcaaactaatacacgaacagaagaccaaacactgcatgttcttacatataagtgggagctaaacaatgagaacatatgcacatggaggggaacaacacacactcgggcctgtagcaggggagggagagcattaggaaaagtagctaatgcatgctggacttaatacctaggtgatgggttgataggtgcaacaaaccaccatggcacacgtttacctatgtagctaacctgcacgtcctacacatgtaccccagaacttaaaatttttaaaaaaaaatctagtctgttatatggtagtaacagactattagattggtgcaaaagcaattgtggtttttgccattaaaagtaatagcaaaaactggctgggcatggtggctcacgcctgtaatcccagcaattttggaggccaaggtgggcagattgtctgagctcaggagttcgaaaccagcctgggcaacatgctgaaaccccgtctctactaaaatacaaaaaattagctgggcgtggtggtgtgcgcctatagacccagccactcaggaggctgaggcaggaagaattgcttgaacccaggaggcggaggttgcagtgagccgagatcgtgccactgcactccagccttggcaacagagcgagactctgtctccaaaaaaaaaaaaaaaaaaaaaggaacaacaaaaactgcaattacttttgcactaacctaatacaatctcattaagcacagtaactctgcattgtgtattgtagaagcaccagaattttcttacaaatgaaatgataatggctttttgatgtgttccctagaaagaattgtggtccatcatcttttcagtagatatactttttgttatttagtgctttaggtgttatttgctaatattacagccaaaataaaataggaatgtgcagtggaactcatttcttctctgttatagctggctctttgaaagttgtttgaggaaactctaattacctacagccctgcaatgaattgcacaacagatgtactgttttaaagtcttgattcttgcatgcatttttcaccttttacttcagttttagtctttgatttggaacacttaatgttaagcagtataaatgtgtctttctaggtgacataattggattctctctctctctctcttttttttttttttttttttttttgtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgaaattttgcattttaggtaatattcaaatgacatcatttcagtccttttgtttgttattacttctgacaaaagcacttttctgtaagcttttcatttattttactcttcagctatgaagtatttgattatatgaggacacaggaagaaataaggagtagcccatggccccagctaatgtgttagacatcttatacaggattagtgctagattagttccatgaggtgatttgaactgtcaaggtcatcaaaaacaaggtaagtctgagaaactgtcacagccaagaggagctgaaggagaatgatgactaaatgtaatctggtatgctggatgggatcctggagcagaaaaagggcatttaggtaaaaactaaggaaatccaaataaagaatggacttgagttaatgctgatgtatcaatattggtccattaattattacaagtgtaccattctaatggaagatgttagtaataggggaactggattcagggtatatggaagtctctgtactatctttgtaatttttttgataatccaaaactattctgaaaaataaagtttattcttttaaaagaacagcatcataagaggtgatctttctgtttagatgacctcttggtagtaaggtataagataactgtttaataaaagcacaaggagcataggtaggggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatactttcctggacttttgtagtgctattgttttagtttgttctatttctttttaaggttaccttctgtttatggcaagtgatactgtttcctgttaatgaaagtggtataataaaaaaaaattacctaagtaaagagagtcaacttaaaggagatttcctgaagaaagagattcagattatgagaagaaattggtatgagagagattctccattgctggcttgaagatggaaagggttgtggcacaaactgagtggcccctggctgatagccaacaaggaaatggaccttcagtcctacagctgccaacaacttgaatgaggttggaagtggattcttccctacaacctgtagataagagcccagcccaagtaacttcttgatttcagcattgtgagaccctacgcaaacaacctagctgagacacctggactcctgacctacagaaactgttagataataaatgtgtgttttaagccggtaaatttgtagtgatttgttgtgcaacagtaaaaaactaatacagcctataggctttgttcttactgctcttcaaacagagaccatgccctcctccaccaccaccaccagttcccctaacactgtgtctcagttcttttagtggttacccttaaaatagcaacatgtattatatacttaccaagtataatattagtcagtctcattagccttatctcagccaatgcaaggatcttaggacattttaactttattccttcctgatttacatgttaatgtctatcatatattttaattctttctgtacttgaaaactcagcaagacattattattacttacatagtcagtttacttaggttcattcacatatttatgttttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggtacatcatcattctgttgtcttctgatttctattgtccactgtcaaactgtcacttctttggagatactctgtccttttattacctctggttattttcaggtttttgctttgtctttatttttctgtagtgtgtctaggtataaatttcttttgtttatcctgccatgattcagtggaatcttgaatttgtagatagacacatctgatgaaaattctataaaaagatcctatgaaaaattctcagccatttcctcatagattttctctaactcattctctctttcctctcctgctgggaccccagttgacatacattaaatcttctcattattttatctaagtttcttaccctaattctgtgtttttcacctttttgtttttctccatggtgtattctggatcatttattttgacctatatttctcttcattaattttattcagctttcagttcctctgaaacccatccattgagttttaaattttggcttttttttttttttttttttttttgagacagagtcttacttcatcacccaggctggaatgcagtggcgtgatctcggctcactgcaacctctgcctcccgggttcaagcaattcctgtacctcagcctcctgagtaactgggagtacaggcgcgcgccactgcacccagctaatttttatattttcagtagaggcatggattcaccatgttggccaggctggtctcgaactcctgacttcaagttatcaacctaccttggcctcccagatcgctgggattgcaggcgtgagtcactgctcccagcctgtattttttgtttgtttcaatacctcatgtattttgtcttttatttttgctaattctaagatacggtatcttttcttgagagcatctgcctaccaggtttaggggataggacagctcatggccaggactgctttaatccaactttaagatttaaaattccatggaccaccagataaaagagagccaggctccaagtccatgcgaggccaggtttgttttgggttcacctccaccctaggcgtagcctttcagaacaaaacagaataaggtggaggttggtttatcaaatggactgtaggtattcactcactcattcattcctatgaggccctatgagtcctatggggcagttgcttcccaggggtggagaattaccctccaggcaaaagtagttttatgtgattgaactcactactgtgagttccctttttctcctagatcatcaactggcaaaatttaagtaccttataagatatttgatactttcaaaaaatgatggagaggggaaggttttattttgtttttcagtaggaaggctagtgtaggttatctatttcatgatcattggaagcagaactttctctggcttcttccttgtttctttgttttggtagtgaaagggtacccttttggtatggcagacatgatactttttaggggagaagtaatgaagaagtacttgtacaatagcagatgagccccagaagaagtctcctgttgttcgtatgcgccagacacaaccctttatgccttgttatttcctgtactgctgagaaccctctaaagtagctattatctccatttcacagtataaataaagtagccccagagagattgaataactggcctctcattatagttagtaatgagtaatgggcacatccaggatgcagccccaggtcttttgagctatcaagcccttgctctgtttatgttgtggtggctttgattcaaagaggaaaaagttaaagtctatcaggggctaaagtgcattctctcaaggggactttcccataattatggggtgtttgcagctggagtgtctgtacgtccaggttgcctgggcttgccaaaaggaagttgtaagttcattgtaaaatattaatgtgcagggattcttggttaatagaataaattattttttctttaaaaagttcaatggtctctcagtggagctgcctaaaaaaattcatgttaaaacatcttgttcttttacatgatctcaagccatctgtttgcatctatgatagatattcttcatgcttcattccctatttcttccctactggttgatataaagtaaaggattccattaaaggacagggcatagtaattgcatatgtcttgatttttaatgaattgataaacagtcattggccaaaatgtttctaattttatgatctcatcctgtgtctatttactggtttaaatttgtgctcaaaattgtcagtcttcagtccagcattaattaggaaccatgaagttttctttgtcatctgagtcttaattgagtttatatacctctaacttcacaaaaaggtgatcatgtggataatataagtagtttatttccatttaatgatattttctggtggtaagctattatagtgattgagtgtcatatttcatcttgccagatcatacaaactgaaatttttaagcaaactattaaaacatccaaaccaacaaaaagcttgaatgaattctgagctaatcattgtcacagctgattttgtaaacctttaggttgaaaagctttctgaattttaggagctatgtttggttcagttctctgctattacaaaatactattttgtaaaatgcctcaagtttataaggcctattttaaatcattaaagtatttaagaacagatgttattacatggtaaaagttaaaaagtctgctttctgagtcttagttatggtatcactggaaggattttgaattagcaatcaatgtctctagtaaaacaattatttttgaagatgtgtttaaaaaatagttaacatgttatatgattttacagcttttgtttacctttcagtaattggcattgacaaattaacatttttatttgtattagataagtgaaaatctcccccaaggtatcagagagctatagcttcaaattaacttaaatgtaactatgctaatgtaagtgtctggaagatggcacccatgtttgtgcatcctaaaatggatttatctatttgtccatccagtagcatttactgggtcttcattagcacagtgtcaggcacagttctatatgttagagactcaggatggataagagaaaattcctgccttcagagaactagtttagtcaactggtaggtcctttattaagagctgaccttcagttatgcataaccgtgtttgtgtagaatactgtaacccctaactttcctatttgtgtaatatggaaggccaagtgatgaaattgttattaaaaacaccaattcccaaacagtgtgccatgattttaatatgctaaatagactgtggcaatgttagatttcctttttgactcaggaagactgtgagggtgagtgagtgagtgagtgaggatgtatatgtgtgtgcatgaggagacaacagagcagaacccctagtctagtatgctttggttagttggtattcatcaaaccccaaaagattgagaaacatcgttgtttgagaccctaaaattctaaggtagagtgaggaatcatggaagactacattatggacctgatgagtttaatgcctgccatttttaactgagtatgttgatcataaaagaactgtagcttgtactctcattttaaatagactggactccttctgtaatagggattgtcaacaacaacaataaaaagaatggactcctaatgctagccagaataaaataggttgaaaatgcacagatttccatttccagaacaaaaaggcgtagacttacttttcactgccccttccttcctctataaatataactaaatgtcctggaaattattcaactgacagcaataaagggattctgaaagttgggaagaaagcagagtagcttggaacctcaggactagaagtttgaggacaatgagtataagttcactgggttttcttttaatctcccattttctcctagactgggtgctggagagacctacaacccagaatcaccagtgggcaaagaaagcagaacaaaaagcctgctttctctggctagaagaccaggaaagggaaagcccaacaaagacctaagtgggagtgctcatccccactgtttcacagtgggtcccggtgggcactctgatctgtccccattatggccccagttgctgcgggagcagcaaagcccctggccctcccacccactgctctacaactggggccatgacgggtggtttgttctgccaactacggtgaagaccagaccatttcagcccctgtggtctgctctgtagacagcagcagcaacagcaaagcccaggctatactgcctctgctcccaactggccccagcaggtggtctcttctgtagggagcagtaagcagctgcagccgcagcgaagccatgtgtcttcctgccctccacctcatggcttaaggagacccaggccccagtaggtgaccccctccccctcaaggtttcccagcaatagcaagtggccctgggaagtaccttttatccctgcagatggcatcagcagggattgagtgggagtcccaacatcaccagaagaatgaagcacaccaaaatagcattgtgagggctcagaaaactaaactgtcattggaactgaagcccacaaaagtagtctagaacctacacactaaacctaagcagggtgaccaccctgctaaaatagaagatcctgtcatcaagtcttctaacaataagcaaaacatccagggtacaattgaaaaccacttgtcatagcaagcaccacaaaatatctaggatacaatatgaatgaaaaaagacatcaactgatgccaatacccagttgaatcagatatgggaatttgataaggtttttaattcagctgtcatgcaatttatccaacagtcagttgcaaattttcttgaaacaaatgaaaagatagaagatctcaggaaagtagagccaagagcatttcctaatgaactggaatgtcagagaaaaaaaaagggtcaagaatggtgccataatttttggctaagctatcagaaggaaatacggagttgccttcaactgagatagcaagaggagagattagaaagctcagttcactcagatgttttgggggatctgattgccctttctcttgtcttccatgctctcttgtgtgccttattgattagcaggagtcattacggagactgagaggttggtccatccatgggaaactcgttaaaagtgagcattactaacttgcatactcacatgcagggagtttggtttcttacctaacttgaaaaattccccaagtgtttagatgtttgattttactatgtcgcctaaacagttacatccactatactcttattttcaaattttttcccctaaagcaattattttccagatcatctactttatgtctttagacctagaaactgattactacaattatgattcaaaacctattttctgctgccctgcactgagctgagtaattgggtgtaaatggttatttcgtttgcatgctttgcctttgtgttaagtgttttttggttaaaagaccagaggttgcattattgcctgctgaatatgcttatattaacaattgtaaaaaagtaaattacttttgggagtattaatgaataggcacttaaattgcatagttaaatcttttccatcctttactaagcaaacaattggattaccccccataagaatttaattgacaatttccatgccacatttgggtagggaatatttcttacagacaaaagttgtttgaaatcagaaggttcttagccatttcaatttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaagaggagtgttcctgtttagggcagaccctgctaggccttcctgtttgttatctccacaagatattgtaccttaagagcttgcctttagcactttttctttttcctttctgggcttcttacagtctttctatggggatgtttccagcagccccttggggaggggtttggggatatattcatgttttctggggctctgtcctctgtatcctgaagtgctgtcattagcagcaatggcttcaattacctctcattcactcatgctacctagggagtatagaggttaagaatttagatttcaaagttccatatgtttaggctccagtcctagctctaacatccactaactgtttgaccacagacaacctcttagcctcagtttcctaatctataaaatgaggctgatattatattagctatgatgacaaataaattatgataaataacaagaatctatgtaaacttcttagcagcatgcttgctgctgacatgttatattataaatgacagttgttgatgtcttcattatcatgacccgttccttgaactttatactcctatctatatgccctctataaatctctgcctggatattccatggaaaccaatattttccaaacatagccatgtgcttcgtttctttctcagccttctatcagttctttctcttgtaattcctttctcatttggtggtatcattcacccagtaactgttgccagaaatttgtaagttttcttacaactcaaccccaaccaccatctagctaatcattcactgtgttatcttgtgaatttattttcttaagtatctctctgtcgcctttactttatcacctcttgcttgggctaatgcaataacttcctgagtggctcccacccactccacaacgtctctcactctctgtcatagtgatctttggtccccttttccttttccagccacttctcaccctccagtttttcatgctagcagtaccaaatagcttgaagtgcccagcacacacttttttttttttttttttttttttctgagacagagccttgctctgttgcccaggctggagtgcagtggcatgatctctgctcactgcaacctccgccttctgggttcaagcagttcccctgccttagcctcccaagtagccgggattacaggcatgcaccaccatgcctggctaatttttgtatttttagtagagacagggtttcaccatgttggccaggctggtctcgaactcctggcctcaagtaatctgcccgccttggcctctcaaagtgctggagttacaggcatgagccactgcaccctgccagggcccaaaacaccatgccctgtgttttgacttggctgtaggccattgcacaggctattacttacctctggaatcctctcctttccctgcttagcccaacaaactcctattcattgtttcaagccctccaggatgtccgtgtgtcatagaggccttctctcagtaccatgctatccacagatttttaaaactcatagtgttatactatttctatactttataactttacactaacattatatataacgtatgtatacatacataatgtatatatgtatgtgtataatgtatatatacatatgtatacatacatatatagtatatatagtatatatacatataatgtatatatactatatattatatattatactatatatactgtatgtatattatactatatattatatgtatatattgtatgtatatatacatatatacaatatatacattatatatacatatatacatgtaatatatatacattatatatgtgtatatatacatgtaatatatatacattatatatgtgtatatatacacgcacacacatatgtcaacagcagcctactagattggaagttccctgaggacaagaattgctttattaatctttttcttgtttattctttatattctttgtcttattttcattggggaaatgaggtaaataagataaaatgtgcaaatgtcaatagaatttttaaaatcttagtgctttaatatttatttttgatttagctaagattgcctaaagtgtgtaaccaagtcagaattctcacttttgtaaggtttatcttcatatgttttcttgcttgtttctttccatgcatgtctaatctccttcttcacatttcttatgttataaaaatcttttttcttctctattaatagttcttgatatatcctccatcaagtgtgagctaacaaagacctagaatcgatgtccctctacattggctctaaccccagcccttctcacacacgcatgcacacgcacacacgcacacaaacacacacacacaccaatcaaattttccagaacctttgctttgagcagaaattgccttatgtgactggcagtcctctcataaaagtagtaaatgatgagtgtattatagttagactcagaccagaagatggtgtgctacatgaaatctaaagtgaagtctactaaacttcactgaagtatcaaggtgtgacagaggtactaattatgtcaatataagtactgagttagtaaatgctagtcttaactctgaattgttcagctttgacaggtgagctagatttgttccattagcttattggagattcattgctagctgtttcaaataaacctcccccttctattttcaaggaatgatctgaatcatactcctttgtcaagtctttaattgttaacatttaggcaacagttcctgagacttttattttaataattttccactccgtgtgtgttttttgcggtagcaatgagtaggaaaacttttttttctttggtttaatcactgtacctaaagcaactcagcttggtgaatgtatgtaagcatatgtgttggagctggggatgggtaccagaagtgttaaaaagtgtcaggacagcatctctgttcccttactgctatcacattgattaccgcgataatcattgtcacagctgattttgtaaacctttaggttgaaaagctttcacaaagctatcacaaagcacaggaagacaaggaaaggatttattgatgaaattatatgcataagctcttctttagtggcaatgactacactaaatagtgttgaaatagggaacagaccatcgttatctttaatcggtagagtttttatataaatttatatatgtctataattttcaagattttattcttactgctaatgttgtcatttatagttattttattttagctttgtttcctttttgcctacccaccatctatgtccctcaattcttaacgtcagaactgtataaaaagtagtaggaagacacagatttagaaaatgggtagagaaatatctagaagcaccatgatttctcaaaattttatgtacttacataaaattgcgttacttaataaatgtatcaatggcttattcatttctagtttgtcatttttcttatatcattcaccagatattttttgagggcctaatgtgtactgggtactcattaagtttatattttaatatgaatacacacacataaatataacattacatattataagtatatatgaaataatataaatacatgtatgtgtgtatatatgtgaatacacacagtttattctcattattcatggtagttgtgttctataaagttaccatgaatgctgaatgaaccaatactgaaccattgctcctaggggaagtacaaggttgggttccttcaaacctctggtcacaacattttcatcaaccgatcaatacataaccttgttttatgtgtgcttctgtttaaagatactgcatgtaatatatactgttgattcattaacattgaactcacagccaacattgttataactcatgcctgaaggaagcttccctaactcacgtattttccccataaggcacatcacagccttcttgtgcttaggaacactagacagtcccttcagcactatgcttggtgaccatattaaacagcaaaatcaccaagaaaaagcgcaaaatgcaaaaaaatgctctaaatagactttgaaaagatgacttgttgatggcatgagagctgaaacaagaaggcagagcatcatcttgtttgccctcagctggcatcatgcacattgggtgattcaaatttttcaccattacatgcgtgcctgtaaacgactgaaagtgccatgactgttgatttgggggttataagtgaattttaccaagtaggcgaatttacagacatgcactctgcaatgtaatgaggatcagctgtatatcaactttgtgtgtgtgtgttgtgtatatatgtgtgtaaaaatttgttcttggccttcactttccccatctttgtcttttcttttttaaatcattcacggttttcctacgtatcttgtggtacattgcacaattcattataaatgtaatggggcttctaggcctgttgttatggacagaaatttcattgcgtttattaaaggtttcctgagacatgatgtgtttttgtttatagacctctcatagggtgaaaatttaacatgtaactccaaagtttatatgtagcaactcaaagtattattttaaatttattacaattagatataaaattacaactgacaattcatattgactttattatgtttgagatgcagtgtttttttgaagtgccttcaaaagccctttgtgctcctccccaatcacaaccccctccccctcaaaccactatcctgccttttatattaatctttttaaattctctttatagctttaccccctatgtttgtatctctaaggagtatattgtttaatcttttagaactgagtagcaaacacaaacttagctgggtaaagaaaggacaatattactactattgtatgaagacttaggagaagagaagctgaacaagctcttgttcatagtctggcttcagatgttctgagagtggttaggagcccattctgggaagtcggttggcaaggtcatgcacaaataaatcccgagacaaggggctcttcacaggcaggacatttccgctgtagtgcaggatagggggaggtactgagcacccagcaggaatttggtggggggcactggctgccctgcatttcctgctcttcagctccctgatgcctgcctcccattctcaggaataggtcaaagcaggcactgctgtagggtgaaattaagagtcctctgctagtctaggcagcagagaaggacagaaatctcctcagccaattgtcaggaaaagaaaaacagaagaatctggatgcagctcacctacctattctgttttcaggttaaaaaggtggcccgtggcagtggaaaactgatggctctcagtctggattggttgtcctctgtgcctgaggcacagctgtcagcctgagatttcccttccttgcattcctggggattcccttcatctctcttctgtgttggatctcctatttgctgtctccaggcatgctttttattggtctattcttgttttagcaaacacgtcctacaataatttcttcagaaagtgtgcatggcaagtaatttattgaccttttttgtctgaaaatgtccttatggttaatgatggtctggctggatgttgaattcaagattagaaatcattttccttcatgattatgatggtgttgctctattgtcttctagcgttggcattgagagatccaaagctattctgggtgaattgtgtcatccttcctcgctgcacatctttacccccacttctggaaacctgacaatctccttgtccacagtgattttaaatttcacagcagtgtgtgtatggacatgggtcatttattttgctgagtacttggtgggtccttttaatttgagctccttatgatttaaattctgggaagttttcttggattattcccttaatttcttccccttcattttctttgttatttatgctctgcttttcccaaattatcggccaacgcttctattgataaatttctctgtgtgtttttcaagggctcttttgttttctgaaagttctggtttttgtttcacaattgtgatatctttctgaggatattaatggtaatttgaagtcttattgtgtagtgtgtttcctctaagttgctctttttgtttgtttttggttctatcttccaaattagagactcttcagatgtcttaggagccttggttgttgtatacttatgattagaaatagagcaatgattctcaactgggggcaatttgaaccttccgtaccccaggaggatatttggcaatatctggaggactttttggtggttaaagctgcagggggtgctatgctactagtatctagtaagtagaggctagggatgttgctgaacatcctacaatgcataggacatccctgcacaacaaaaaattatctagctcaaaatgttaatagtgctgatattggaaaccctataatagagggcctcaaagctgattaagagagctccgaaggtgcaggtggaacgtgttgactttgggttttgctggaggatgatctagttgagtagtttggagaacctcttcattatctttaggtcttttcttctgagctagtcagatattcaatagaaaagtctttcatctcctgccttaagggtaaagatctggcttccaatattccccctgttagtcaaaaagggactcgggctgtctgcgttcagtgtatatgtgaccacataatacccttgcttttcatataatacccacttcctcaacagccttgtgtttccagttgtgagaccctacagtttggttttttttttttttttttgagacggagtcttgctctgtcacccaggctggagtgcagtggtgcgatcttggctcactgcaagttccgcctcccgggttcataccattctcctgcctcagcctcctgagtagctgggactacaggcgcccgccaccaagcccagctactttttttcagagaccctatgttttatttactctttccagataattaacctgttgggatgagggagcggcagttatccatggtatggagtacaggagaccacctagggctctaactgcttctctaacacatttcattcaaaccttgttactttaactctaccctctcttcacttccagttccagagttatctggaacccattcatgagtttcttggggattctacagtatagatgggtttggttctgaactttccttattatctctttgcagttcagcttttccaggtctgccaagtcaattaccactctccatctgctttcttggattccaaatttaattattactattatctcctctcttgtactcccaatcctttttaaaaacccctttggtatcattgtagtggagtttggatagggaaataaattagatacattgtgctcaatctatcccatgatcctggaaaccaacatgctgtattctagcataatttcatttaattctagtcttattttggtatatttacctttgttatcagaattatttcctagacttaggttttcttcacataaatgaaaactagaggatattagtctgtgtctgcatagggacataattgaattcttttcaaaaccttaggggatattgtagtgatatattcacttctaacatattctggtttaatttacctttttgcttaaaaacatagactgctgtaagcagccatctgcctcaagtagaaccttgttttaccatcccaatcaatattcagaatttgtaaagagttgaataaagaatatatatttcattaaatctgaaatgctgtcaattatctttttccatttttaatacggtcataattagtggaaatatgagaaagatagttgtttatgatgacggcttataactatctctaccagtattttcccccacataaatattcaagaattgactgtaccttagatttaaaattttaagggtgatttcaaacatcaataaaatgtacaggccagactgaaacctatacctcctgaatttttgctgttccctaaactgtcatccaagcataagtaataagtgtaatatagtaggtgtgttacactactttatcactcctccctttttaagatgggaaaccaagccaaattttaaattttttatcagtttctgctgagtttccagttaatgggttaaatcgcaaaaacctcaaaacgtattttagtatctttttagggtgttaaatttggtttaccattgttaaccccctggatgtcattgacggacagacccttaaaatgctttacttgtaacctgtcttcaggtcttcagtagttcatagatataattattttctttgcctcgtactataaaattaaagaattggggatttgatttgatttttattcacagatttttaaaagtttgtgttttgttgtctaagtattctcttttctccctagctctattaattttattgttactaaaagaaaaggggggagaagatatgctttcttcctcacctttgttcaagcaggaaaaagtaaagaattgactcgattgaccatgaacaatcaaccccacatacagatgttgggaagtttccaaaaagatacagtgaattgaagcagactattcaaatgtatcataaatagagtcccaagggtttatgtgtggacaaaaaccaattacatgaagcatttcctgaaattgcttgctattgtcaggataagtaatcagaagtaagacatccaggttgagaatgaaaacgtttgtccctcagtttgtaatattgtcttctcacagaggaaaatctttgaacagttttgagggattatcaaaaggatcctctttctgtagagttttgaaagatatattattaccatttcttttcctcccaggttagcttttttaggttgcttgaaaagagagatttgaagctgtggtatagttgatgtcctcatgatgtcatcttggataaatgtttaagtctaagattaaatttagtagttcgtcctgtagttgaaagaagaaaaactttaaggccagcagtatcacaagtgtagtactgtaaatgaagaacttttctctatctgctaattgagcacatgcatctaggtgtactgtttgtacctgtaataagcgaatgaaggtggtttttttgtttgtttgccttctccccaggagggggaaaatacacgcatgtatacatgtacacatgtatttaatgaccaccatattaaccttcaaataaaccaatcacattgctattgcattctgtattttatagtcaattcacacacacacaaatctatatttggattatcttaactgagttcagatatttcttttataactggtaaccacagggaaccgtgtgtgtgtgtgtgtgtgtgtgtgtgtgtgtgtgtgtgtgtgtgtgtgcgcgcgcccgcgcgcgcgcgcatgttccctggaccagggtatgggcatctttaaatcatctcagctgattcaactgtgaggtctgggtcagcaaatagctagaccagtggctgtgctcatagaaattacttcctttcctctagtaatttcaaacaattctaatttgaagtttgaggaaaattaaggatttctctgtgatttcaggtgaaactggagagggttggagaccaaaccacgcaggcctttctctttgtaaagtgtttgttcaagtcttttgcccagattttattggagtgtgttttttttcttattgtatttacaagttacttatatattttggttcttgacttggactgtatattgcaaatactttctctctctctggtgttttaaacagggatatcatatcagattttcattttttaaatatcattacaagaatgaatgggagaaacaagtttttcagtggttctagtagaagatggtaggatgtgggacatggagagaagaggacaggttcaagagatatttgagataaactcagtaggatttgttagtgatgattaggtaaatggtgggtaagatgagagggaagtgtcaagaatggcttgggtttctggttcataagaataccaccattactatggacttcacttattttgtttaagatgttgataatctatatagaattgtacagtcattatttgccttgagcataagactactatttagaatttttaaaaaattactgcaaattgcaaatttattggtcatttttatggttttggtaatcttttaaaattatctcatgaattatagaaaaatatgttggaagttatattacttaaattttattttgaaaactgtgttcaatttggagtctaaagtagaatggcaaacattatctatattatatagataatgaaacagtaagacattaatgggaaataggaacttaagagaatcaatgaattaaaattgactttttgttttataggggtcccttcagtgttgtacgacgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattgttataaataattaaaataaatattaatagcttctttttcaacccaaaattatcaataccagagttttgacttatctcattgttgtaccaaattctaaatctccccaggctaaagacattctttcgggaaacaattacttaccttctcattggctgaggttgtttattgacagatttcttcagccagatctcttgagctacagactcagaatgccaagctgaacctgtctcttgtcacttggtcagggagtcaaattccaaatttacaaaaggggaaagtacttagtatatagttcatatacctggtattaagtcctgtcttcatttaatataatatatgggagtctgttgctgaagttatagctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccctagccttatgggacctatgttttaatagtctccaaccattgtttataacatggtttttattaggaaaacaatgtgtaataaattcgaagtaaatcatttacaaattaattttttttgagatggggtctctctcttgcccaggccagagtgcagtggtgcaatcatggctcattgcagcctcgacctccttgggctcaggttatcctcccacctcagccgcctgaatagctgggactacaggcatgcgccaccacacacagctaattttttgtattttttgtagagatgaggttttgccatattgttcaggctgatctcaaactcctgagctcaagtgatctacccacctcggcctcccaaagtgttgggattacaggcatgagcctccactcccagcccacaaatttacttttgaaatgaaatgtgttgatttgttgcagaccacctgtacgttttaatattttaaattctcattgctctaatgaagatgagatattataattggtgaggctaaagatgagacatttcataacagatgagatatttttgaatatctgttctctacttttgccatcaaaatcataatttttattttatagggcttcttaacttgcaggttgccgactattcaataatcccttgaaatagtaagcagaattatgtttatttttttagagagtccatagctcttattagattcctaaaaaggcatattattcctaaatgatttagaatttctcctttcacatgtatgaaaaaatgaaattcatgcttatgaacatgagatgaataagaagtttctactaaatcaaaactggatgaatttatattaggatatgacttctgattgggggattttttatacttacatatacagcttccattaatgaatttcctagattattatcttgaacttttaattaatatactttttgtctcttactctactgagccactaatttagagtttttgtcttaaaaatagatatcaaaattaattcagacaaattataataaggaaactaaaggaaagtaagatgtatagaattggaaactaaattatcaaagttctgagttcttgataggactcaattctttatggtttattataaaagtccaaaattaactgtttttatttgggagtattataaattgtgttctagaaagagtatattttgggctccagtttgcttagtcttcaagaatgtctcattctaaagtcccagatagtaggtgatatcagtgaaattgaagaagtaaggaccttgacagttctcacttttcatttaaaaaaaagagaaaactgacagaaatgtcagaatcaactttttcagggctctggaaattgaccaaaggcttacagctatccaggaataatttattcaagaaaactgactgattcttagtaacaacagtgaacttcatagcattgtataataatttgtcccattcacatccccctttcttccagttctgtagtaaccttgaaaacaaacagttcacaatcacgatgaaaaccagcaacttgacagccatcaaaggaggctgaatggggatggagctcctctaaggccgcattcccataatattgtcatttttttacttgtctggtagttccctggaagacttgtcttagtacatttgtgtttctataaaggaatacctgagagtgggtaatttatgaagaaaagaggtttatttggctcatggttctacaggctgtacaagaagcatgacaccagcatctgcttctggtgagggcttcaggaaacttccagtcctggtggaaggggaaggggaaccagtgtgtacagagatcacctggcaagagaggaagcaagagagagatgggaggtactaggttgtttttaacaaccagttctcatgataactaacagagtgagaactcacttgttactgccaggatggcaccaaggcattcatgagggatccacccccctgactcagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggggataccatcaagcataccaacatatgcataatgagaatttcaaaaggaatggagagaaaggagtagaaagaatatttgaagaaataatagtccaaaacttcttaaatttgatgaaaacataaatctacacaaccaataagttcagcaaactccaagtaggataaatgcaaaaacaaaccataatcaagttgtcaaaagctacagacaaggggagtatcttgaaaatagcaagggagaactgaatcatcacatacaagggatctataaaaatattaacagcagatttctttcaaaaaccaaggatactgaaaggcaacaggataacattcaaagtgctgaaagaaaaataatatctaccaagaattctttatccagcaaaaccatacttcaaacatgtaggataaatgaagatattgtcagataaagaaaaacggatagaatttgtcactagcttccttgtcctacaaggaatactaaacgtagttatttatgctaaaaggaaaacttatttttttaatttttaatgtttatgggtacatagtaggtatatatatttataggtcacatgaaatattttgatacaggcatgcaatcacatcaggataaatgaggtattcatcacttcaaacatttaacctttgtgttacaaacaatccagttatattctttcagttattttaaaatgtacaattaaattattaaattatttttgactgtagtcatcctgttgtgctagcaaatactaggtcttattcattctttctattttttgtacccattaaccatccctactttccccaacccctactagccccccgcccccccaactaccctttccagcctctggtaaccactcttctacctgtatcctcctgacttcaattattttaatatttagctcctacaaataagttaaaacatgcaatgtttgtcttcttgtgcctggctcatctcatttaacataatgacctccagtcctatccatgttgttgcaaatgacaggatctcattcttccttatgactgaatagtaccccattgtgtatatgtaccacattttctttatctattcatctgttgatggacacttaggttgattccaagtcttggctattgtgaatagtgctgcagtaaacatgggagtgcagatacctcttcaatattctgatttcctttcttttgggtatatacctaggagtgggattgctggattgtatgatggctctatttttagttttttgaggaacctccaaactgttctccatagtagttgtactaatttacattctcaccaacagcgtacgagggttaccttttctctacatccttgccagcatttgtcactgcctaacttttagataaaagccattctaagcatagtaaaaggaagtgtagtaaaaggaatgacaagaaatcaaagtagaacaccataaaatatctatttaacacaaaaggaggcagtattggaggaatacaggaaaaaaaagacagatagaaaaccagtagtaaaattagaaacataaattgtaccttgtcagtaataatattaaatataaatgaattaaacactccaattacaaggcagagattggcaacatggatgaaaaacaggtgagatggtatctcatgtcgttttttgctgtctggaagagacatacttcagatttaaaaaatacatataagttgaaagtaaatgagtagaaaatgatatactatgcaaatagtaaccaaaagagctctgaagtggctattactaatatcagatgaaatagactttaataattaaatcagaaatttaatagtcaaacaaattgttactaaagaaggacattttataacaatagcagcattaatccatcaagaagatttagcaattataaacacatatgcacctaagaacaaagctccaaaatacatgaaacagaaaaaggcagaattggagggagaaatagagaattcagcaataataattggagacttcaatacctgacttaataatggattcaacaactaaacagaagatcattaaagaaagagaaggtagatttgggcaacactagaaaccaactagacctaacagacatctgtagaacactccactcaacaacaggagactatacattcttttcaagtacacatagaacattatctaggatagactgtgcattagcccatcaaatatgtctccatcaattttaaaatatctgaaatcatacaaagtatcttctctggccacaatggaatggaatcagaaatcaataacggaagcaaatttgggaaattcacaaagatgtggaaattaacatagtagccagtgggtcaaagaagaaattacaagaatactttaaaaatactctgagatgaatgaaaacaaaaatataacttaccaatatttatgagatgcagcaaaagcagtgattagggggaagtttattattgtaaatgcctatattgaaaagtaagaaagagctcaaatcaataatttaacctttcactttaagaaactggaaaagaaaactaaacttgacaggcagaaataaggaagtaataaggattataggagacatagagactagaaaaacaatggaagaagtcaataaaaccaaaagttgtttctttgaaaaggtaaaaataaaattgagtaggctttaaactgaccaataaaaagagacaactcaaagtaataaaatccataataaaggaagggacattactactgaccttataaaaatgaaaaggattataagagaatatgctgaaaaattgtatgccacttaattagatagcctagattaaatgagctaattcctagaaagaggcaaactaccaaaactgactcaagaagaaatagaagatctaagtaaacctgtaataagaaatagactgatatgtactcaaaattttcccataaagaaaagcccaggcccagatagcttaatggtgaattctactacatgtttatagaattcatataattccttcacacatatttctgaaaaataagagagggaacacttctcaactttttgtataaggcctgcaataccctgataccaaaaccagacaaagatattgtaagaaaggaccaatatcccttatgaatgtaaacacacacattctcaagaaaatactatcaaactgagtttagcaatttaaaaaatgttctgtagttcttcagaaagttaaatctaaggttatatgacccagccattttactcctagacatatgcctaagagaaatgaaacatatatccagataaaatcttgtatatgaatgttcatagcagcattattcataatagctggaagatagaacccaaatgtctaccaactgatgaatttataaactaaatatggtatatccatacaatggaatgattttttcaaccataaaaaggaatgacatactgatataagctacaacatgaatgaatcttgaatatattgtgctaagtgaaagaagcaagtcacacgagattacatatgttctattcatgtgaaatttccagaataggcaaatctatcagaaggaagtaaattagtggttgcccagggtatggagaaagatgagatggggagtgtctggtaatgggtatgggatttcttttcgaagtgattaaatgttcaaaatttgaacacagtaatggttgcatgactgtgaatatactaaaatccattaaattgtatactttgtggacaaattgtatgataagttaattgtacctgaataaggattttttaagtaccacgagtaagtagaattataacagaaattcaagcttgtttaaacatttaaaaatcaacgtcatacaccttattaatagaaaaatgaacaacagtccacatgatcatctcagcagacaaaaagcatttaacaaaattcaaccccctttcatgataaaaacactcaacaacctacaaatagaagggaatttctttaaccttttaaaagacatctaggaaaaaccaaagtctaactttatatttaatgttgtaagataatgctttcctccgaagatcaggaataagataagagtatctgttctcaacatgtttattcaacattgtactggaaattttagccaaggcagttatgcaagaaatagaaataaaagcatccagattgaaaaggaagacttaaaatgccctctattggcatataacattatcatgtatatatgaaaatccaaagaaattcacaaaaagacttagatgtaataagtgagcttagcaaggttgcaggatacaagataaatatacaaaaaccaattgtatttgtatacacaagcagtgaaaaatctaaaaatgaagttaagaaagcaattccatttaccacagcatcaaaaagaataaaatacttaggaagatatttaaccaaggaagtgcaaggctaataaatggaaaactatattgttgagaaaaattaaggaagtcctaagtaaatggtaagatctctcgtgtttgcctactagaagacttaatattaaagtgaaaatatttcccaaattgatctatagattcagtgctatctctatcaaaatccctactggcgctttttgcaaaaattgacaaactaatctaaaaatttacatggaaaagcaaggtaccccgagtagccttaacaatcctgaaaaacaatggacaaagttggagtactcacatttttcaacttcagaattttttttttttttttcctggagacagagtttcactcttgtcacccaggctggagtgcaatctcggctcactgcaaccttcgcctcctgggttcaagtgattcttgtgcctcagcctcccaagtatctgggattacaggtgtgtgccaccacacctggctattttttttgtattattagtagagatggggtttcaccatgttggccaggctggtcttaaactcctgacctcagatgatctgcccacctcgcctcccagggtgctgagattatagccatgagccactgcgcctggcccagaattttctataaagctacattaatacacatagtgtaaccctggcataaggatagacatatagattgatgaaattgaattaacaatccagtagtaaatccatatatttacagtcaaataattttcaactgtggtgccaagacagttcaatggagaaagaatagtttcttcaaaacagtggtattgggacaactggaggctgacatgcaaaagtttgaaggtggacctctaccctacaccatatacaaaaattaactcaaagtagatcaaagatctaaatgtatgagttaacaccatgcaattttaaaagaaaacataggcataaatctttgtgaccttggattaagtagtggtttcttcattattacacctaaagcacaagcaaccaaagaaaaaaatagataatgggattcatcataatttaaaatttttatgcttcagtagacactatcaagaaagtaaaaagaggctaggcgtggtggctcatgcccataagctcagtactttggaaggccaaggcatgcagatcacttgaggtcgagttcaagaccagcctggccaacatggcaaaaccctgtctctactaaaaatacaaaaattagccaggggtggtggtgcatgcctgtaatccaagcttcccagctactcaggaggctgagacatgagaatttcctgaactcaagaggcagaggttgcagtgagccaagatcatgccactgcagtccagcctgggtgacagagcgagactgtcccccccacccaaaaaaaaaaaaaaaacaaaaaggaaaaagataatacacagcattgggggaactatttgcaaatcatatatttgataatctagtatctcagatatacaaagaactcttgaaaatcaacaataaacaaaaacagataacctgattaaaatgataatggatttgaatagacatttcttcaaataatatttacaaatggtcaataaacacatgaaaagatattcagtgtcattggcttttaggaaaatggaaatccaaaccataatgagataccacttcacacctactaaaatggctgtagtaaaaaaacaaaacaaaaaacaacagcatgtgttggcaaggatttggagaatttggaaccatcataaattgctattgggaatacaaaatgatgtaaccgctgttgaaaagcttggcagttcctcaaaagttgaacttagagcaccctatgacctagcaattctcatcctaggtatatacccaaaagcattgaaaacatatgtacacacgaaaactggtacatgaatagtcattgcagcattatttgtagcaggcaaatgtggaaacaaaccaaatggtcatcaactgatgaatgggtaaacaaaacgaatattacatacaatagaagatttattgttcaaccttaaaaaggaattaaaggtatgcaaaactggttcaacatttgaaaatcaattaatgtaatccatcacgtcaacaagctaaagaagaaaaattatttgatcatattagtagatggagaaaaggcagttgacaaaatctaacaccctcaacttgataaagaagtctacaaaaaaaaccctacagctaacatcttacttaatggtgagaaactgatgtttttcccctaaaattgggaatgaggccaggatgttcctgttccctactcctgttcaacatcctaccagaaacccttgctaatgcaataagacatgataaggaaatgaaagctatacagattggggggaaagaagtaaacctgtctttgttctgagatgacatgattgtctatgtagaaagtcccaaagaatcaacaacaacaacaaactcctggaacaaataagggattatagcaggttgcaggttacaaggttaacatataaaagtctatcgctttcttacatgccagcaatgtgcaagtggaatttgaaatttaaaatataacacattatattaacaccaaaaaattgaactgcttatgtataagcataacaaaatatatacaagatacatacaaaggaaatttctaaactttgatgaaagaaatcaaaaaagatctaaataaatagatactccacgtttgtggataagaagactcaatgttgttaagaatcagttcttaccaacttgatctgtagattcagtgcaatcccaagcataatttcaggaagttactttgtggatattgacaaattgatctaaagtttatatggaaaggcaaaagattcagaatagacaccatattattgaagaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaaaaaaaagactcctagaactagtgagtgcgtttgtcaaggatatgagataaacatacgaaaaatcagttatttctctatactcgcaaagaacacctggaaaccacagttaaaaacatagtaccatttgcagttgcttaaaataaaatgaaatgcttaggtataaatcccacaaaacatatacaaaccttgtatggtgaaaactacagaactctgatgaaagaagttaaagatctaaataaatgaagagatgtactctgttcagggattggaagactcaacatagtaaatatataatttctccccaaatctatctctagatttgacccaatttcaattaaaatcctaggaagattttttatggatatagaaggcttatcctaaaatatttctggaaaggaaaaagaataagaatagctaaaacaattttgaaaaactatgataaagtgggaggaatcattctacccactatatagatttatatagctataggaattaatatagagtagtactggcagagagatagacacgtagcttgatggaacagattagattacccataagtacccccacacaagtacagccaaatagtttttgagaaagattcaaactcaattcaatgaagaaagagtaatttttttctacaaatggtggtggagcaattggacatccataggccaaaaatgaacctcaatttaaacctcatgccctataaaaaattaactcaaaatagatcatagatttaaatataaaacataaagctacatagcttttttttttgagacagagtctcgctctgtcgcccaggctggagttcagtggcgcgatcttggctcactggaacctcccatcccgggttcaagtgattcttgtgcctcagcctcctgagtagctagctgggactacaggcacacaccaccatgcccggctaattatttgcatttttagtagagacggggtttcaccatgttggccaggctggtctcaaactcctgacctcaggtgatccacctgccttggcctcccaaagtgctgggattactggcatgagccaccatgcccagccaagatacatacttttgaaagaaaatgtaccctaatatcattaggacatggagggagatgaagaattcttagacatgacactaaatgcacaattcgtagatgaaaaaagaaaaacaaaaaacctcaacagtaaaaaataaaacaaatagtccaattggatagtggttaaaagacatgaacatttttcccaaaaagggttatacaggttctaaacaattacatgaaaatatgttcaacatcattatccattagggaaatgcaaattaaagccacaataagatatcgctccacacttaatagaacagctacaataaaaaggtgaggccaggggcagtggttcaaacctgtaattccaccactttcacaggctgaagcgggaggattgcttgagcccaggagttcaagaccagtctgtgcaacatagggagaccctgtctcttaaaaaaaataagtaacaatatgacaataccatattctggcaaggatgcagagaactggatctttcatatatctggtgtgaatataaagtggtacagtcactccagaaaagagttaggcagcttctttaaaatactaaaacatacatttgccatacaacccagcaagtgtactcctgggaaatgtacatcctaaggaaatgaaaacttatgttcacagtaagacctgtaatcaagtttttatagcagctatactcgtcatagctaaaatttggaaagtaccaaaatatcctacaatgggttaatggttaaacgaattgtgatacatctataccatggaatcctactgagcaataaaaatgaaaaatctactgatgcatgcaactacttggatagatctcaagaaattctacttcgttaaaaaaatctcttaattgtcgtgtactgtatgatttcctttatataagtttcaaagtgataaaattatagaactggagaacagattagtgattgtcaggtgtgggacactgcaaagtttaggtgaggattgtgagatgggtgagtgggtgtgactagaaagggttagcacttggggtttttgtgggggattattatgtagcagttctgtatctctgttttggtggtgactacttgaatttacacatggcgataaaattgaatagctgtgcacatagacacatgagtgcatgtaaaactattgaaatcgaaataaagtctgttggttgtatcaatagtcagtttcctggttttgatattgtactactgttatatgctactatgggggaaaatgggttaaaggtacacaaaatctctgtactacttttgcaactttctgttaatgtacaattattttaaaattttaaaaaattgtaaggtttcccttatgaactgtatgctcttccatgaaagagataattagcccacaaatatttaggagtataggtaaaagcattttaactacaggttttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaatgagagtcaattttaaatacgtctgtttcttaatgattaattttgctgtattatgacaagcatttctggataactatttacaatgagatacaaatattacaaatgtaaagtttatacttgtcttgctaatcagatcctgctattctgtgaaaaactgctgatgaatctctaaacctaagacaatttatagtgattatgcttgagatcaactgcatgggaaaagaaaacttacttctttcatcttgttttttgccttttaaaaaatagtgtagattacctacttctgaaagtatgtggctatttgttaactaaaatgactcatacttgttcaatataattctaggtgtaaacatggcttgatattacatgtaacatgttggccataatccccaatatcaacgttttatttgtaaatgtctcttaacctgaatttctcatcttatatgacttcagtatgtagatgaggaggctcatgtttatataatagagctctcaaagttcattggctcatatattcaatttttcttagtatcatcttaatgttacattcgggaaatatagcaatatgaaaaaaatgtgagatgagtttctctactcattttttattctgaaataaagcagcttttaaaaaatgtttttccaggccaggtacagtggccaggcatggtggctcatgcctgtaatcccagcactttgggaggccaaggtgagtggatcacctgaggtcaggtgttcaagaccagcctggccaacatggtgaaaccctgtctttactaaaaatatttatttttaatgtttttcctctactataagtggaatttgtgtttcacaagttaaaaatgatttttatcattgttttctctttttctatacaaatagctacctattttctttcaaatctgcattttgctagcttttacattatgtgacgtagagaattccttaggaagctgtgggaatagaaaatagataaagacaggaatttggtgggttgacataacccttgatatatgggctacagtagctggaaaattcagtctgtacactaggtacaagatgaattttggagtatacttgctaattaaaatttgagtctgaagaattagatgggggtgttcttagatgtattgaataagttactgttatcccatctatatgaataacctttggaaataacctaagaagtgtcttttgttaagtttgctctgtaagaaatttgtattacacaattaaataatacatgtcagatagaaaatataataaattctaacttagcagacagtttattcaaaagaattatcgcaagggggagaaactattgcaatagggagtggggtctattttaatagaacactctcaccataagatctatgagtatctcaagggttaggcaaaaaatatttttcttttatgggaggaataaacaagactagaaagaacttggtgggaggaagtgggaaggcctgggggaaggagagaagcgtaaccagtttgattaacaggcaacttcaaattgggtacaagagctcctaattgttcacaaaaacttctatacaatatcaatcacgaatagttttaagggaaccacttttcaaattcttacttctatatatactcttcgtaaagttgatatgcttaagaaaatgtctgtaatggacatagaagttctcctttcttatatcccctttcacaaatttttcttctctcattttactattgtccttcctcctacccatccagaatcttaattgtggtgcgttacaagatctgttgtaatatgtatcaaaatctccagggcgccaaacaaaaggacagtttgaaaattggcatcagtgttgagaaagtgaatgactctgaaagaccaataacatactttttcaagttagatctattcttgctttgctttcaacaaaattgatggatgaccttatcaatttgtaagttgatggattattaagagtaatttttgtggctcactcctgtaatcccaacacttggggaggcagaggtgggcagatcacctgagcctaagagttcaagaccaccctgggcacaacatggcaaaaccccatctctacaaaaaatacaaaaaattagctgggcatggtggcatgtgcctgtagtcccaactacctgggaggctgaggtgggaggatcgcctgagcccaggaagtcgaggctgcagtgagctgtgattgtgccactgcactccagcctgggcgacagagtaagatcctgcctcaaaaaaaagcataatttttattaagtcattataattcatggtgtataactcaaaaagagattgctttaacagaactccatctattcccgtatacttggtttttttcaaataggtttattgagatataattcacacaccataaaacactcctttaagttgtataattcagtggattttagtatattcagagttgtgcaactgtcattgctacctattttcagaacattttcatctcccccaaaagaaaccctataccttttcatagacacccactattttcccccctcccagcctctggcaattaccagtctactttctatttctatggatttgccttttttggacattttgtataaatggaaccatagaatatgtgttgcatctggcttctttcgccttacatattttcaaggttcatccatgtagtagcaggtatcagtactttattccttcttatgactgaatagtattccattgtgtagatatatatcgattcattagttgatgtacatttgggttgtatcagttttttagctgttatatataatcttgatatgaatattcatgtgtagttaagcctcgttattcaaggattctttatttaaaaattcacctacttgataatatttataacccccaaactcatactcttggcgtcacgcacagacaggtgcaaagtgacaacaagtttgaatcattcaacatgcacattcccagctaaggtcggacaacgcaacactcttctatcttgttgtttgggctctcataccataaatgagttcccttttctatgtctacttaattccatattttttcacatttttgtgttttttgctggtgattttgcttcttaaagtggccccaaagcatagtgttgagtgctgtctagtattcctaagtgtgagaaggctgtgatgtgccttacagagaaaataaatgtattagacaagtgtcattcaggcatgagttatagggctgttggccatgggttcagtgttaataaatcaacaatatatatgaaataacatgtctttaaactgaaatacacatgtgataaggttatatattgatctgtggacaaatatggtgcaaccagagattcacagtaacctgtattttccctaaggaacagtgtttctgtgtttcctcagtcagtgtttgtgttgactttatagaatataagtactgcaaataatgaagatcgactgtatatggtttcatgtaaacatacgttttcagttctcttgggtgtatacccaggaatagaattgctaggtcatatgataacattgcttgttttgtgaacaaggtttctcagcgttcacatctataaaagtgaaaataggaatagaatttgtgttgagccctgtcttattctaccacatgcaagaaaatgagatccttgttggactggtgtggaactggccccatgacacacaggaatgtcaccttttgtgacacttccatagacataacttccaaggacccctgaagagacatgcccaagtggaagaaatcaccacattcaggaaagtccaaagctgttcaattgtaattttcctagagtagattgttttctttgttattataccagctttccaccatctgtctcactttcctctttcccagttcctagatggccgctttatgggattgaatctagagagtttaagccttacatagaaagttgatgagcctacaagtgggttaaagcttagtgtttttttttttaggtttcgtgttttttaaaaaagcattttcatatgaactgttgcttttttatttatttatttatttatttattttgagacggagtcttactctgtcacccaagctggagtgcagtggcacgatctcagctcgctgcaacctatgtctcctgggttcaagcgattctcctgcctcagcctcccaagtagctgggattacaggcgtgcaccacaatgcccagctaatttttttgtatttttagtagagacagggtttcaccatcttggccaagctggtcttgaactcctgacctcaggtgatcagcccgcctcggcctcccaaagtgctgggattacaggcatgagccaccacgcccagctgaactgttgctttataatatctcaattgtttacttcttcaatagcatgaataatttactatataattaaaagattttagtgatagtacatcaaaaagagtagtatctgcaaacagaagcagttttgtgcttgtttgtagtaaagactctatctataactgagtcagtaagcatattctcctttttaattactgccatgtactaatcaaacactatttaaaatgccaggcatgttgctaggtgctgttcatatctgttgtcttatcttcagagaaaccctgcaaaaaaatactttatctacattttgcaactgaagattaaagaagttaaataacttttggattgatgcacaggaagtggtagagccaggtgaatccaagttggtctgtcttttggactgcaaaagctgtatttttcccacatctgaagctgttagccctcaccctttatatcctagtgcccagctactttatgtgtcctgcacccctaaacccaaaagcggtatgtgtgtgaagtgaaggtagagagttttgtttttctggatttgttttttcacagctttactctgaccacctagaaccatgcctggcacaatataggtaatacttattgagtgaatgaaggaatgccacgtaagttttgtgaatttactgaggagtctcgggatggtgcaataagagaacagtgtgacagttgataaacaaaggaaggtttctgctttttggcaaagattacatctgtaaaaggtaaataggctgagtaacactttcatggtcaggactacaaagctgggctataaaaacacattattctaatccatgtttatctatcacttcttttgtttttttttttttttttttggcagagtctcgctctgtcgcccaggctggagtgcagtggcgcgatctcggctcactgcaagctccgcctcctgggttcacgccatactcctgcctcagcctcctgagtagctgggactacaggcacccgccaccacgcccggctaattttttgtatttttagtagagacggggtttcaccgagttagccaggatggtctcgatctactgacttcatgatccgcccaccttggcctcccaaagtgctgggattacaggcgtgagccaccgcacccggccatctatcacttcttacctggctggcacgctagtttatccaaactactttattgtacacgcttgttgtacagcttgctattaatataatgaggtcatataattagttatggtagtagatggtgacccttctcaaactatgaggaagatgtttaggtatcctcaaagtaaattctgcagtgatcccagagacagattaggaagtctcagagatggacaaaagacttgaaaggtatttcagaggctgggcacagtggctcatatctttaattccaacactttgggaggccgaggcaggaggatcatttgcgtccaggagttcaagaccagcctgggcaacatagtgagacccgatctctacaaaaaataaaaaaattagccaggcatggtgatgtgtgcctgtagtcctagctgcttgggagggtaaggtgggaggattgcttgagcctgggaggctgaggctgcagtgagccgtgattgcaccactgcactcagcctgggcaacagagtgagaccctgtctcaaaacaaaacaaaaaaaaagatatttcagaaaaaaaatgtatccacatgagcagtaaacaaggcacaactccattagtcatcagagaaatgcaaattaaaaccagataccactgcattcctaacaggatggctaaaaaatgaaaatgacagttgtaaagtggcagtgagaatgaagagccaccagaactcttactgctaatagggatgcaaattagtttaaccactttgataaactgtttgggaatatctaccaaagctgacatatatatatatatatatatatatatatatatatatatatatatatatatatatatatatcttgtgacctagcatttgcatccctgggtatatacccaacagcaatgtcttaacatatgttcacccccacccccccaaaaaaaaaaaaaacaaaaacatgtacaagaattcttttagcagaattcttcataatagccctaaattagaaacaacccaaatgtccaacagtggcggaatgacataaataaataccactgtattcatacagtggagcacaacaaagcaatgagaatggatggaactttgttacacaaaaaacacagatgaatctcacaagcataatgataagtgaaagaagccgggcttaaaaaactaccaactctatgattccatttatataaagtacaaaaacagtgtaactaatatatgaagtttgaggtcaaagtagtggttaccggtgggggaaggtagtgaatgggaggggacatgatgggagctacggaggtgctggtcatgttctgtttcttgatctggatgctggttgagttcactgaaaattcatcaagctgtacatttatgatatttgtaggaaggataggtatacattgtccgaagggaaagagtggagcagttttattttgtcagctcatgtggtctggcataaagatctgtctgggctatttaaatatttatattttgcataatggggatctgacttgttcacaaaagtattcattcagtcttggggagaaaagggtgatgacatacctgttctgtgccaaatgctaagtactgggatatgtaaaaatagaaagaaaacatagatatctttaaatctaataatccagacataagattctcttcctcagtagtaaatgctaaagagacagagtgactccatgtacaggtgaatctgctttgttatccttattggttactttaaaaataatgacagaaggcattggtgcaaaatgtatctaaagttacaacgtaagtgccatttctaaagcgtttgggagaaaattccactagtctatttgaactggccttgtgttgtctgtggtgtttggctttctcttgggtagcttaaatttcctccccatcagtatagtagattttatctattttgtttactcttcagaaataactgccaggggatttttaagactactgattgaggaatgattgccaaattacccatttttaagtgtaaagtcagtaagcaatgccaggtttctgaggagcttcaccaatttgtctctataatgtgtagtatttttttaacagttttaatatatgaatgaaaatactaccaagtttctcctggatccccacttttgttcattcagtgattttttttactgagctttggaaatgaaccttttgtctttttagtatgatcctctcccctcatgtcgtttgaaaatacccatctcttgcacgagactaagaacaatgctgtcctgttgagttcttataaaatccaaagaaaatttaagtactaagtggatgatagttaaagggtttacagcttttcttacagatccatcaaagtgggaaaatcatgagaagagttggagtcagacatgccagacattccaaatctgtcctgtacaatgtgaccttaagtagttccataaacctcagctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaagtaaatgcattacattgtatttttaaaacattttttgccttaataaactgctagcatttcagttaagaggagttaataacagtttcaccaatgcacattgaaaacgatgggttccattaaatagtcaataattattaaaattaagccaagaataatgaaagggatacaattacactaaagtgatatttatgtcttataaagatttctcttaaatgaaaattgacaattattagactagccatacacaaaatctggtattttaaaactaatcttggctgggcgtggtggctcacacctgtaatcccagcactttgggaagtcgaggtgggcagatcacttgaggtcaggagttcgagaccagcccggccaaccaacatggtgaagccctgtctttaccaacaaatacaaaacttagccaggcatggtggcatggacctgtagtcccagctactcaggaggctaaggtgtgagaattgcttgaacccaggaggcagaattgcagtgagccaagatggcaccactgcactccagcctgggcagcagagtgagaccctgtctcaaaaacaaaacaaaacaaaacaaaaaactaaaccaagggccaaagcagtatggtgacagggaaatattttatattttcccttagagacttcagagtgctgactcaccccttccacctaccatgtgaggacgcagtgataacacaccattgattaatgtctaagaatatattgaggaaaatactctatcaggctaacagggaaactggcacagttttgtttccactatattttattggttagagaagtcacagagccacctggttggaaggagaaaggatgtagatcccacctctggatgggagagatgacaaaaaaatttctggccatctttaatctgccacatcaattaattttaaacttaaactttgttgccttaatgtttgagtgagattgtagtagttgatgctactccattccgaggcagtactaaaatcctaccagaggatccaatgtcctcattaagtcccaattcaggatacatatgacagcagtgaataatttgtcactgtgaataggagactaaaataaggacataccatgttgcacaattacagactatttgaaatccagtctggcactgtttgttaaaacagaattttaatatttttgtaatcaaaagatagggaaattatttcaggcaggctgtttttataatttcgttttggcattcttctcttaagaatgaataataatataaggaaacaggtagtgattgccttttgaactataaagtgcttttcatttttagtaagaggttttatgtctataaaattatctgaaaagacaggtcatctgctaaccagtggtagagtatccactgcaaggctcaggactcctgaaacacatcataaaattgtcatgtaaggaaattcttggagctgagtgcagagctagtttgatttcatcataataggcagatattgatggattaactttgagtatttcatgaaataaaacatactttgctgtttttggtttataatacattttaaaacgtttgagtctgaaacaaaaattgtgaagctgatatttgtctttcctttcattctatatgtgaccagtttaatttttgtgattcggggcaatcaaagtatttgctgggtatctagagtgaatattttatcactttagataatctaatctaaaagcccagtaataacagttttggttatttttttcacaggtggggtagtatatcaaacagggtccagttaggagacagaaaccaaacagtaatttaatgtgtttcttttgactttttaaaaatttttgttggtacagagtaggagtatatatttatggggtacgtgagatgttttgatataggcatgcaatgtgtattaatcacatcctgtaaaatggggtatctgttccctcaagcatttatcctttatgttacaaaaaacccaaaaatactcttgcagttatttttaagtgtaccattaaattattatctgctgtagtcaccctgttgtaatatcgaatactaggtctttttcaatagtaatttaatttgaacatgcaaagtttagtataaggaattattgccaaggggttggggtaattggctagtaaaagttagagaactgtgaaaaatacaggcataaggaacagctgctattccaacggctgagatagaatgctcaaggaagaggtttggccttcctcctggcagcactaagatctgaaccttgttgaagaaaatatggccatgactcaccggatcacagtgaggttcactgagacaccatgctagtgggactcattggaaatctgccctctggagtccaggggaagccatccttagggacagaactctgaacatgcagcaagctcactgaggggctgctggaggaagccagtaacaaggagagtaccttgccagcagcgctctgctgtaaaggcacctgaagggggttccaagagaagctgcacatggaaagatgcatgctgctggccactgtgcactgcagataaactgcacacactgcaggagcctgatgagaaaaacactggaactgggacaacagaaccctttctcctccagtgcccctccagtgcccttagtggacaaagcttaatgttgtgccagttggaaaaatattcacagtcaatctccagtagtgcagagcaggcaatgaagtgtggatttggagctgacagacaatagattgataagtggcatgaggagtggagagattgtgtatatgacagtgagtatagttttgatgacatgtatcaagcaacctcattcattatacttggcaatgattttatttcattttgcttttttttccccctcctttaaggagattcattcaatacaacttagtggtatagggcttaaggaaggaaatgcccacgtttttgcttcatatgactagttggatagtggtgctacttattttattcaaatggatactatcaaagggtcagggagaataaatgagtttttgacatcttgcatctcagtaacttttgaaatataaatgttgatcagttaaatattttagtctaaaatttaggaccacaatctgaacaaaagagaaaagatttgaaaatcttcatcgttttggtaatagacgaaacttcggaaatacctgtgattgcttaaagaaagtatattaagaggccacaatgaaaaaaaatgatcatgaggaaccatttttggtcatgaaaaatggtcatgaggaatgatcctgacgaacacctaaatttaaagaaaggatggaaagagacagaggaaaccaggagggggaaagagaagtacaagaattattatcagagaatgctgtcatagacgctgagatcaaaaagattttctgtgttgtcaaatgctataaagaagccaaatgagggaacaactgtaatgtctatggaatttggcaacatggaaaccagtgtgaactttggccagagcaatttcggtattgcactggggacaaaaacaagattgtagtaggcagaggaaggaatggggagtgaggaagcagggaaaataaatataggataattttcaaatggctagactgagaagaggagagagaaacagtcatagatgcaggggcatgtggaggcaggggtagcgattaaaatgggaaggattccagtatctttttttttttttccttttttgccagaagagagagctaagaggaaagaaaagggtgcactgatggactgagatcttcgataggcagcaggtggagggtgggcccctcttccatcaagaccaaaagaaagtcaaggtactgatagagctaggcctgcaggcaggagaaggaaccagaggatgtccctcagctgatggcctgattttcagcaggtgggaggcagagccacctgctgagagtaggcatggtggtagagagtagagagataagagagttagtaatagcaggttaagagagataagagacattgctaggctgcctcaaggcccctccccccacccccgctgaggctaaatgcaaggaatttgtagcagcgcttatcaacatgcagatatgatttctctcagcaacactaagtagcctacaattgaggaaaggaaaattgtatgggtagattgtgctagagtgagaagtattacacacagcagacatgatggacaaaggaatcaagagagatgaaagtaatagtaatagcaagagaaaagaccatggagctggatggggaggaagattttagaggtgcatcaaacatattctagttggtcagtctcctcaccagtcacaatagttttcacgacatcaccgtaagagggacaatagtatggtaagtaagaaaaggaagttaatttcaggagacttgggttcaaataatgatcctgccatttatttattttgaccttgtgaaagttacctaacttctaagcaagcctgcatttttctttctttcttttttctttttttttttttttttttttttttgagacggagtctcactctgtcgcccaggctggagtgcagtggcgccatctccactcactgcaacctccgcctcccaggttcaagcgattctcctgcctcagcctcccaagtagctgggactacaggtgcacaccaccacgcccagctaatcttttgtgttttagtagagacggggtttcaccatgttgcccagtctggtcttgaactcttgagctcaggcagtccgcccgcctcggcctcccaaagtgctaggattatagatgtgagccaccacgcctggccacctgaatttttacacatagtaaatgctcaacaaatatttaatatgaagtgatatttcaagaaataagaaggtgcaatacaacacattagagatgccattctggcacaaagaaacaagtcagtgcctgctctaattttaatttaatgttacaatagccagttttgattagaatattttgcttcaccacatggtgctcaaggtactgtggctgcataacaaattaccccaaaacttagtgtcataaagcaactatttaatatactcacagcttctggggctctgcagtttagacagggcaaatctggggtgtgagtcagaagactcgagggctagggcaggaatcttctaaaggctcactaactcacatctggccattgatgctggctgttgactgagagactttacctgggaactttggcttacacttcatgtgacttctctctgtgaaaaggcttcctcatagcatggcagctgagttccaagggcaaatattgagagagacatccttttgctcagaataatggtattgagattcatccccatgtctgttgtattagtactttttaaattggttagtaatgttccatttcatgcatatagcaaagtttttaaatccattttcttgttcttagaaatatatgttgtttccactttggggctgagtaaagccgctttgaatgtttgaatgtaaatcttttgagttggacatattgtcacttctctcacataaatgcaagagtgcagttgctaggtcattaagaaactgccaaactattttccatagtggttgcactattttatgttattaccagtaatgtatgagagttacagcttttccacatccttgccaatacttggtattgccatcctttttaattttagccattctggtgggtatgtcatgatatttcttgtggttttcatttgcatttaccttatgactaaaaatgttgcacttattggccattcatatatctttgttgaagtatatcttcagatcttacaccgatgtctatttttcattgaggtgtgtgtcttttgtattaagttgtaggagttctttgtatattctggatacacttccttggtcaaatatacatattgcaaatatgttttcccagtttgtaactttcccttttatattcttaatggaatctttaaaagagtagaagtttttcattttgatgaagtccagtttacagtttttttccttcatggttcctgatttttgtgacctaagaaaatttcacctacgtcaaatttgtgaaaattttctttatattttcttgtataattgtagttttggctacgtttatgatgcactttagcataagagttgtatatcgtatgaagtgtaagggttgagattcatgggtagccattcgctccagcactatttgttgaaataaccctattgagttattttagcacctttatcaaaaataatgtgttggtctattttctgcactttctattctgatctgtatgtctatccttatatcagattcacactgtctagattattctatattaagtcttaaaatccagtagccaaaatcctacaattaggattttgtgtttaggctattctagctacttaaattttcataaacaatttagagtaaatttgtgaatttctgcaatgaagcatgagattttgattggtgttacttttaatctatatattaatttggggagaatggaaatcttaaccatattgagtcctccaatccatgaacactactccatttatgtagatttttttacattctcccagaaaatatctttgtagttttaagagtagatattttattcatatttcattacatttattgttagggcctcatgtttttgatgctatggtgaatagtattatgttaaaatttttaatttaatgattattgatagtatatagaaatacagttgattcttgtatattgatctcatatttggcaaccttgctaaatttacttattctagtggcttaaaaaaatccttaagattttctatttgaacaattgtgttattttatttctgtccattctgtatcccttttatttctttttcttacctttatgccctagctaggacattcaattcagtgatcttatattgatctcatatttggcaaccttgctaatttcacttattctagtggctttaaaaaaaatccttaagattttctatttgaacaattgtgttattttatttctttccattctgtatgacttttgtttcttcttaccttgatgccctagctaggacatacaattcaataatcttagggagcaaaccagtctcttaccattaggtattgtctgcaggtttttcttaaatgccctttattagattcaagaatttgttttatcgtcctaatttgttgaatttttattatggataagtgttgaatttcttagaatgctttttttctgagttgagtttttgtatagttctcctttattctgttacttacattgattgaattttgaatgctaaagtaaccttgcattcctgggataaaccctacttggtcatggtttattaaattttttatatacccatgtggtaaaaatactaatattttacaagatttttgcatcagtggttatgatggttattgctttctagttttctttttaaagtttctactggcttaggtatcagtagagtcaggtttactggtctcatataattagctcattattttctcaaaatgtttgtattggattgctattactttttcttagtgtattgtggaattcaccagtgtcactatctcctgggcttgggattttctttgtggggttattttaaattatacatgtaatttctgtaataaatttagggctattcagattttctattttttcttgtgatagtacttgtaatttgagtatttcaaggaatttgtcagtttcattttatttgttggatatattggtatatctttattatatttcttataattttcttgtctgacatatctgtactgatgtctcccctttcattgctgatattgataacttttgtcttctctcattttccttgatcattaaaatctttccaatggaatctttcaaagagcagaagttcttaatattgacaaactccagtttatcatttttagctagaggtttattattttcattgatcatacattgaacaagcttttggtatcattaactttattgtttgttcattttctgggtaatttctatcactgttttaataaagtccaatttgtcgacgtattgttttatgaattgtacttttggtgctccttctaagaaatctttgcctaatccaaggttggaaagcttttctccttttttttaatagaaatttaatagttttaggttttacatttaggtctttggtccattttgagttaatttttagatattttctgaagtctggatacaagttgtctttttttttggtcttgtcttttttttccatatatatagttgttccagcatcatttgttgaaaagattatcttttctccattgaatttccccttgcaattttgttaaaatttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtcttacaaaactcagaacacattgagctctctagtccaaaaattcagaatgctccaaaacctgaaactttttgagtgcctatatgacatcacaactggaatattccatagctaatacctaaatccaaaacacttctggtcccaaggactttggataagagatattcaacctgtagttctaatagcttttttgtagactctctctgattttctccatggatgattatatgtcagttatgtcatcttgaatacaatcagcattaattacatcttcctttccaatctggattcctcttgtttggttttctggccttattgcactgactggctagatgtctcctccagtataatgttgaatagaagtcatgacagcaaatgttttcttattccttagagaaaaaacattagattgtttaccattaagtattaatattagctgtaggtttttgtggatgacctttttgaggttgaagaagtttctttctattccaagtttgctgagaattttcagtaggaatggatgttggattttgtcaaatgctttttctgcatttattgagatgacctttttagtttattgacatcatgaattatattgattaattttgtagtgatcaaccaacctgtattctaaaaactgcatattggcctctagttttcttttgttataatagtctttaactggttttgatatcaaggtaatgctgagctcatagagtgaattagaaagtgttccttttcaattttgggggaaaggtttgtgtagatgtggtattatttcttcatgtttggtagagttcatcttggcctgaagttttctttgaaggacgatttttaactaaaaattctattttttatagttataggaatattcagtttatttcgtcttaagtgaggtttggttgtttctttcatgaaatttgtctgttttacctaagtgggtaaatttattggcatggagttgtttgtaacattcattattcttagtatatctgtaaaacctttagtgatgttacctttctttatccttaacattattagttcatgtgttttctctctttttttttttctgagcagcctggctagaggtttatcaattcattgatctatttcaagaacccattttttgtttcatttatgttttctgttgatttactttttcctattctatttatttcaactttggtctttatgttttcctttcatgggcttattttgctttaattttctcatcttctagtttattaagttggagactaagatcaagttagttaatagtattgttcaacttttctatatcctcattcattttctgcctacttgttttatcaattataattttggatttgtctgttcatatacttttatcacttttgtcttttatgtattttgaagttctgttattagatacttatacatttaggattattatgtcctcttgatgagttgactgtgttattatcatgaactgatcttttttctttgttcttcctttatgcagtgtatccttttttctgaattaaaaaattttgtttttttagctgggcacagtggctcatgcctttaatcccagcagtttgggaggacgaggtgggtggatcacttgagctcaagactagcctgggcaacatggcaaaaccctgtctctacaaaaatacaaaaataagccaggcatggtggtgtgtacctgtaatcccagctacctgggaagttgaggtgggaggatcatttgagtgtgggaggcggaggttgcagtgagccgagattacaccactgcactccatactgggcaacagtgccagatcctgtctcaaaaaaaaactttgtttttatcactggttttatgcaatttgttgataatctgccttagtgcctttttttatttgtattttaatttgcttgagattctttgagcttcttatatctatgggcttatagtttacataacatttgaaaattttttgggctttatttctttagggtatttttcttctccatttgtctcttctctcctttgaagggctccagttacatgtatgttagacccctttatattgtcccacatgtcattaagcttctgtattttaattttatacttttcatgcattgtctaatctgtttagttcatccagtgactttttcatttgagataatatatttttttaattctagaagctccattttgttcctatttatttttttgtatttcttttctcattatgtccatgctttcttttaaatctttgagcatattcataagctattttgaaattcctgccttgtaatgcctacatagctatcatttataggtctatttgtattgactagtttttcttttggttatattttacaatttgctgctttcttcattagactatatctagaatagccattattttagtgccaaatttagctccactacttaggtgtgaattatccttagcatttcagtgaggtctctctactgtgtctggttagaactgcagtatctccctgctctttttgaccagcctcatggagtttcaagttatgcaaggacaaattattattaaagtattgttgggactttttttatacctcagtcccttcttttcagtaccctctcctgaacattccatctccctcatcctccccaaaccataatctctgttttctctactcagtgacactgcatgcactgctttgcttcccctccctgtgctgcatactggaaattgcttccaggaagaagccaggctctcatttggtactcattccattcatttccctttccataggaatcacaatcttttactgcctattgtctcagtgcctgataatatttgtttcatacatcttattcaattttctagttcagtgggtaaagaaagtcctattccaattaaatttgcatgattagaagctctttttttcccttcaaaatctttatttgcatttctttttttttattattatactttaagttctagggtacatgtgcacaacgtgcaggtttgtaacatatgtatacatgtgccatgttggtgtgctgcacccattaactcgtcatttacattaggtatatctcctaatgctatccctcccccctccctccacccaacgacaggccccggtgtgtgatgttccccaccctgtgtccaagtgttttcattgttgaattcccacctatgagagaacatgcagtgtttggttttttgtccttgcgatagtttgctgagaatgatggtttccagcttcatccatgtccctacaaaggacatgaactcatcattttttatggctgcatagtattccatggtgtatatgtgtcacattttcttaatccagtctatcatggatggacatttgggttggttccaagtctttgctattgtgaatagtgccgcaataaacatacttgtgcatgtgtctttatagcagcatgatgtttaatcctttaggtatatacccagtaatgggatggttgggtcaaatggtatttctagttctagatccttgaggaatcgccacactgacttccacaatggttgaactagtttacactcccaccaacagtgtaaaagtgttcctatttctccacatcctctccagcacctgttgtttgctgacattttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatccttcacccactttttgatggggttgtttgtttttttcttgtaaatttgtttgagttatttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcatttgttgccatggcttttggtgttttggacatgaagtccttgcccatgcctatgtcctgaatggtattgcctaggttttcttctagggtttttatggttttaggtctaatatttaagtctttaatccaccttgaattaatttttatataaggtgtaaggaagggatccagtttcagctttctacatatggctagccagttttcccagcaccatttattaaatagggaatactttccctatttcttgtttttgtcaggtttgtcaaagatcagatggttgtagatgtgtggtattatttctgagggctctgttctgttccattggtctatatctctgttttggtgccagtaccttgctgttttggttactgtagccttgtattatagcttgaagtcaggtagtgtgatgcctccagctttgttctttttgcttaggtttgacttggcaatacgggctcttttttggttccatatgaactttaaagtagttttttccaatttcgtgaagaaagtcattggtagcttgatggggatgccattgaatctataaattaccttgggcagtatggccattttcacgatattgattcttcctatccatgagcatggaatgttcttccatttgtttgtgtcctcttttatttccttgagcagtggtttgtagttctccttgaagaggtccttcacatcctttgtaagttggattcctaggtattttattctctttgaagtaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctaaacatacaatcatgtcatctgcaaacagggacaatttgacttcctcttttcctaattggttaccctttatttctttctcctgcctgattaccctggccagaacttccaacactatgttgaataggtgtggtgagagagggcatccctgtcttgtgccagttttcacagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgatggattacatttattgatttggatatgttgaaccagccttgcatcccagggatgaagcccacttgatcatggtggataagctttttgatgtgctgctggattcggtttgccagcattttattgaggatttttgcatcgatgttcatcagggatattggtctagaattcccttttttttgttgtgcctctgccagcctttggtatcaggatgatgctggcctcataaaatgagttaggaaggatttcctctttttctattgattggaatagtttcagaagaaatggtaccagttcctccttgtacctctggtagaattcggctgtgaatctgtcgggtcctggactttttttggttggtaggctattaattattgcctcaatttcagagcctgttattggtctattcagggattcaacttcttcctggtttagtcttgggagggtgtatgtgtccaggaatttatccatttcttctagattctctagtttatttgcatagaggtgtttatagtattctctgatggtagtttgtatttctgtgggattggtggtgatatcccctttatcattttttattgcgtctatttgattcttctctcttttcttctttattagtcttgctagcagtgtatcaattttgttgatcttttcaaaaaaccagctcctggattcattgattttttgaagggttttttatgtctctatttcctttagttctgctctgatcttagttattttttgccttctgctagcttttgaatgtgtttgctcttacttctctagttcttttaattgtgatattagggtgtcaattttagatctctcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtcattcaggagcaggttgttcagtttccgtgtagttgagcggttttgagtgagtttcttaatcctgaattctagtttgattgcactgtggtctgagagacagtttgttataatttctgttcttttacatttgctgagaagtggtttacttccccttccaactatgtggtcagttttggaataaatgcaatgtggtgctgagaagaatgtatattctgttgatttggggtggagagttctgtagatgtctactaggtccgcttggtgcagagctgagttcaattcctggatatccttgttaactttctgtctcgtttatctgtctaatgttgacagtggggtgttaaagtctcccattattattgtgtgggagtctaagtctctttgtaggtctctaaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgtgtctcctgaatacagcacactgatgggtcttgactctttatccaatttgccagtctgtgtcttttaattggagcgtttagcccatttacatttaaggttaatattgttatgaatgaatgatcctgtcattatgatgttagctggttattttgcttgttagttgctgcaatttcttcctagcatcgatggtctttacaatttggcatgtttttgcagtggctggtatcagtttttcctttctatatttagtgcttccttcaggagctcttgtagggcaggcctggtggtgacaaaatctctcagcatttgcttgtctgcaaaggattttatttctctttcacttatgaagcttagtttggctggatatgaaattccgggttgaaaattcttttctttaagaatgttgaatattggcccccactctcttctggcttgtagagtttctgctgagagatctgctgctagtctgatgggcttccctttgtgggtaacctgacctttctctctggctgcccttagcattttttccttcaactttggtgaatctgacagttatgtatcttggagttgctcttcgcgaggagtatctttgtggtggtctctgtatttcctgaatttgaatgttggcctgccttgctaggttggggaagttctcctggataatatcctgcagagtgttttccaacttggttccactctccccatcactttcaggtacaccaatcagacgtagatttggtcttttcacatagtcccatatttcttgaaggctttgttcgtttctttttactcttttttctctaaacttctcttctcgcttcatttcattcatttgatcttcagtcactgataccctttcttccagttgatcaaatcggctactgaagcttgtgcatttgtcacgtagttctcgtgccatgattttcagctccatcaggtcatttaaggacttttctacattagttattctagttagccattcgtctcatcttttttcaaggtttttagcttctttgcgatgggttcaaacttcctcctttagctcagagaagtttaatcatccgaagccttcttctctcaactcgtcaaagtcattctctgtccagctttgttccgttgctggcaaggagctgcgttcctttggagggggagaggcactctgatttttagaattttcagcttttctgctctgttttttccctatctttgtggttttatctacctttggtctttgatcatggtgacgtacagatggggttttggtgtggatgtcctttctgtttgttagttttccttctaacagtcaggaccctcagctgcaggtctgttggagtttgctggaggtccactccagatcctgtttgcctgagtatcagctgcggaggctgcagaacagcgaatattgctgaacagcaaatgttgctgcctgatcgttcctctggaagcttcgtctcagaggggtacccagccatgtgagatgtcagtctgcccttgccggggggtgcctcccagttaggctacttgggggtcagggacccacttgaggaggcagtctgtccgttctcagatctaaaactccatgctgggagaaccactactgtcttccaggctgtcagtcagggacatttaagtctgcagaggtttctgctgcctttcgtttgtctataccctgcccccagaggtggagtctacagaggcaggaaggcctccttgagctgcggtgggctccacccagtttgagcttcctggccgctttgtttacctacttaagcctcagcaatggcgggcacccctcccccagccttgctgccgccttgcagttcgatctcagactgctgtgctagcaaggagtgaggctccgtgggtgtgggaccctctgagccaggcacaggatataatctcctggtgtgctgtttgctaagaccattggaaaagcacagtatcagggtggagcgcagtatcagggtgagagtgacgcgattttccagatgccatctgtcacagcttcccttggctaggaaagggaattccctgaacccttgcacttcccgggtgaggcgatgtctcgccctgctttggctcacactcggtgggctgcacccactgtcctgcacccactgtccgacaagccccagtgagatgaacccggtacctcagttggaaatgcagaaatcacccgtcttctgcgtcgctcacgctgggagctgtggactggagctgttcctattcagccatcttggaactgcccccctagaagctcttatcgtgagttttaatgtgattttaaagaatcttaattctaatgatattactttcaaatagagacagactattacagagttttatctaacaaagctaacatttatttagcatttcagtgatgtgagacgccttgctaagaggtgtctcagttcccattataatcctattataaaggtgccatgttatgcctattttacagaaaggaggactgcagcttgaaaacagttaagtgacttgttcaagctcacatatcagtcgagtaaatggcaaaacctagattcaaactcaatcttgtcaaactgccaaggccttgcttatcatcaccatgtgctatggtttggatgtccctgccaaaactcatgttgaaatttaattgccgttgtaacagtattgggtgctggatcctttaagaggtgattggcctggcacgatggctcacacctgtaatcctggcactttgggaagccgaggcagatggatcacctgaggtcaggagttcgagaccagcctggacaacatggtgaaacccatctctaccaaaaatacaaaaattaactgggcatggtggcagacacctgtaatcccagctacttgggaggctgaggcaggagaatcgcttgaacctgggagatggaggttgcagtgagctgagatcatgccactgcactccagcctgggtgataagagtgaaactccgtctcaaataaataaataaatacatacatacataaagaagtgattaggtcatgaggaatcctccgtcatgaatggatttatgttgttatcgcgagagtgggctagttattgctggagtgggctcctgataaaagaatgagcttgggcccattttctctctatgtcttgtgcttggttgcccttctgcaatgggacgaaccttaccagatgctcatgccatgctcttgaactcctcagcctccacaacagtgagccagataaacctgttgtttataaatttcccagtctgtgggtttctgttataacagcagaaaacagactatgataccatagtatgctgctttgaagtgggtgagcagctgggacaattaaggaatcagcttcagtactaagtgtctgggatgcaatgctttgggggccattttcaggttttgtacagcagtctttcttgggtcacattttcactgctctttacttcaaatggtcaagtcagacatcttttaagcaacatttatgggtaggttctgatggcatcttccttatatctgcatatgattggaaatctaagagcatttgggaaccttgtcactgaccatctttttttattgtaactctacattaaagtggggtgttttttgttgttgttgttgttgttgtttgagaatgataaggtaccatgggagcagaattacattactggaaaagtggtggctaggtttataaaagcaaaacagtcaatgatgttctcagtctcaaattatttcaaaataaaaagatttttaagaaaaatttacctaaaataattagtctcttttcagtttagccaccagcttcctatattcttagattgttttattttgatttttgggggttttttattgtgatttaattttttataatcatgtaaaacatttacgtggttccaaaggcaaactataaaagaaaatattttcaaagaagtatgttttctatccctgttcccaccctccttcataagtaatcattttcattagctttcagtttatactcattgtctttgctttaaaattgtaaatattgtagctgtgtgtgtttttacatacacatacatacacacacatttccctcttccttggataaaaggtggcatattctacacactattctacatcttcttgttttattaagtcgtagatactctggagttcactcaatagcatggtattaagattgtccttttttctttttaaagctccaggatattccactggatttaaatttttcaaaatctcatttgataaacatttattgtctactgtgtgtgtcatctgtcacgggtagtgcatagcattgtagggcaaacagaaatgaacaacatatagtcttcaccctcaagaaacttacagaattttaaaatacttttacaaatgtgtacctctcacagtagctgatccagtaacaattatttttatttttacccatctcctttttagagaacagagtaaaaatttttttgccatctattgtttctgttatatttaatgtcatttcagtagtatttataagcagtctaggaacacgtcccaacatttaaaatacttagatatatgattgtaaagtgtgaggcagagaagtacatcatatgaatgtatgctatttctaaatacttgctattaattttagtcactctaaagtcagaatataccagacagtccaaattactgtaattataccatccttttaaaaacttggcacctctttattcccaatattactccaaccattatcattataacaggttcctgttctgtacctcactcacatctgtactcttctccaatatttcttatttctttaatgtctgtacctcataagatgctgaacttttctttgaagacttaggcattggggctgtgggggtactagcctagacttattgaaagcagctcacctatggtactttgtcacgggagtgggtatatctgtgctaggtattgtccttcctatctctttgttggctcttaggggcactccgtctctcagggtcctgagtctgactttgcatctttgaatatggtgtctctccttaaagtcatcttggttacaccttgggtttaccttttctttgcctgtcctccagtagtggccctgaagcctatccatgttatcatttggctactcctggctcttccatcctggagctgttaacctagttgctcttgaactctgcatataaggcccccttccctttctctttcccctttccccagttgctctctaggttttctaatttctttcctgacactatgtatggctttagtcaagcgtaacccttgtccctaaatccacaaatataaagctaagacatgttacttgtctagttttcttagagaaggaaacttctcaggtctttgtatgcttcctcatacaattgtaggttgcagtaaggttaaatggctgaaaagcggtgaaggaacatgttcaagaagtttcatatgatttcactacatgaatgtagatgtggtaatctagcacctactgtactacttaaagcatttcctacagtgaaggcttctgagaaaataaatactattcctgaagtagtctcacaaaaaaaccttttttaattcagaaaattgattccaggttcactaagtcagcattttctctcatcaggcattgcaactaatgacattaatgagagccatgccatattttttaaaacaaaggataaaaagggcaaaactgagaattttaaaagggagttgtttccagtagtctgtttgaacattgtaattaaccaagaaataaaacaagaaaaggccattttaattgtgttttttagtactccattaacagtgcatcaagctccttatgaattgagacagtataaaatgagtgcttacgttaaagtaggaaagccatcagtctgcggtacagagcattgtatttattagagtatcccagacctgaatgagtattaccaccattaggtaatgcttaagtgtctattttaacaaaaggcatttttttttgttattatagagaacaaacactaaattgactaaataaatgaagtttaaacaagaaataaaacagctagaatttgcttgcttttgttggtggtgatatgctcttgtagccccagcaaattacatcagcattgttaccctcgacagggagctttataatttgtagcatgtaaaataacccttcccaaaaaagaagagagccaggacctgtgttgaactacttacaaagcaagcatgtccctggtgtcaccttagtagttttagtgagaaagatgggatttctaaggacagtagttcacagttgtgctctctctgttttctgtctttcatgctttaaggtttttttgctctcttattttaatgtgtgtgtctctatgtatgggcatgtaaataaatatgcagatggtggcacctatgtaagaaaatgtttgaacacagccccaatttcagagctcaatatggcatggggaattcttgggagaatgtgacctattgagggttggttggttgtttgtttttaagatggaatctccctctgtcacccaggctggagtgcagtggtgtgatcttggctcactgcagcctccgcctcccgggttcaagcagttatcatgcctcagcttcccgagcagctgggaccacaggcgcccgccaccacacctggctaatttttgtatctttagtagagacagggtttcaccatgttggccaggctggtctcgtactcctgacctcaaatgatccacccacctcagcctcccaaagtgctaggattgtgggcatgagtcaccgcgcctggccaattatcataaatatatgctttttagtggaccatatagaaagttctattctggttctttatatggttgggttttacttttatctaagtaatgtaagcacatggttttaaaagtcaaatcatgctacttctaacaacaaaaaagcagtgtctctcctaatttgttccaactccaccactttaagcatttttgctgtttcttctgtaaccagcaacatatattactatttcttgatttcatagtttcagatatcatcagttattgcctttttgctatgaaagatgtagctgttttatgttgctaccctcccaccccacttcctggtccctacttactttcccttccccatttttataatattcatatttcagttattcatataatatgattgtatttcttgtgtaatttattgttatatctggggtgaatcattgactcatttctttgattgcttagttttttgttgttgttgtttttgagacagtctcgctctgtcacccaggctggagtgcaatggcgtgatcttggctcactgcagcctccacctcctgggttcaagcaattctcctgcctcggcttcccaagtagctgggattgcaagagcgtgccaccacacctggctaattttttttaatatttttagtagagatggcgtttcactatgttggccacgctggtctcaaactcctgacctcatgatgtgcccacctcggcctcccaaggtgctgggattacaagcgtgagccaccgtgcccagcccgattgcttgttattttatgtattattgctaatttatccctaggctgtcccactaaactgtgtaactttcctcggtacattcaaccccattggataatttatcacattcattgtttttcttggtgacagagggccccctgcctgtgagcctttcatctgtttcattgtaagttggttgctgtcctggcctgctgggctcgtcatgagaattccttttgcctttcatctgtgctagagtctttgttccctaggtttcttgtttttttgcttttttggtttttttggcttccttcttcattttgataaagtatgccctctagtaactttctgagaagaggtgcttttttgagatacctgaaaatgtctttatattactctacaatttgatagtttggctgggtgtagaattctaggtgacaattttgaaaatatatagcatatgggtgaaagtttatatgatgcaacgagactacttaggttcatatcacacttaaccagctgtgtgtgacatgggcacatcacataacccttctgtgcttaagttttctcatctaaaaatcaggcataatatcttacctgcccttacagttattgagaggattgattgaataatgtatgtaaagcacttagggcagtgcctggccgtttttctcccaaagctttaatgatattctctttaccccagtgccctaaaattttacaatgatgtgctttactgtgggcctttttaaaagtcgttatactgattgcttagaaatatttttaaatctggaaactcattgttctttagtttagaaattctttaaaatatttcttagataacatccttttctccagtttctttgttcttcttttcaggagttgctgtgattcaaataacataagggcttataaggtagggcttcatctctaaccttttctttcctgttcctctttctttatctttttgctctactttgagagatttcttcaacttgatcttctaacccttctgtttgagtctcgtggtttagctctcattttttattttcaaggacttttttctgaatgtttttcttttaaactattatatagtttcatactcttgtcttcataggtttcatattcttatctatctcaaagtagtatatttttgaaattttctttgccttatacagggaacagtttcctcagaaaaatattaagagggaagtgttaaataggtgcctgggaacactctgtatatgggtaaattcattatcagtgatcagacaaagactaggccattttttgagcgccttatggatatccgttatctgtagatcttttgttcttaagcaggtcagtttgacagaagaatcttctgatcttctgccttgggctaagggtatgtgtattagggggagaaagggtacgtaggggcatttaagtctgactgcagtggttctgagagataaaggctgagggtctttattttaacatgtttaatacatggaactttccagttaatcctcttgtttgagtacagcacttcagtttgacgtgagctaggggtctggtgtccaaagtctccaaaaagtggggtaaggataatttgcttggccaaagatatccaaggtcatactgcatacctataaaggttcagccagtcctcctgttatctgctccaccatgcaaccctgccctcaaagatacctggtgcttcctattgctaaacctttcttagggacattttgacaggcatatcagcgtgcttcttactggctcgccttattgaaagcttgtgttcaggttctacagaaagcttgtgttcaggttctacaaaaagatgtcaagaagggatttgatgtgcaagaaatttattgagagtgaaaatgaatggtagggagctggaggaggctgggacagccatcacaggtcatgcaggtctgaccccgttggaggaaaaagggaagaaaaagaggaggattgggtggggaaattatttgaccaaggtgcagtttcaaggatgttttggcaaggcgtattgggagtccttgagccaaagttgaccatcagagacccatatctcacaggaattagcctgcttaagtattcctgctgctcttagtcaccagctgagagtatttataatagctgctttgaagtcttttctgctaattccaacatctgggctccctcaaaggcagtttctattttctgcttttttttcccctcctttgtaaaggtcacacttttctgcattttgcatgtctcctaacactttgttatagcaactgtggatactgacaccttcctccactccagggttattcttttttagttacttgctggactagttcagtgcaacctctgatgtccctcttcaggacaggtgtggtccttatccatgcatttctctgctacctctattggtgttaaacttaaccaatcgatagctgattgctcccttctttttgacaatgccttgtggtataaattgctccatagtctgatccaattaaaattgggtcccttcatggatgaaattggaaatcatcattctcagtaaactatcgcaaggacaaaaaaccaaacaccgcatgttctcactcataggtgggaattgaacagtgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaagaaaagaaaagaaaaaataaaaataaataaaaataaaataacattgagtcccttgtcagggacaagtttttctagtctttgagacttgctatacccttccctgagcagaatctctgcactatagagtaggagctggggaaaatggggaactcactcctcattggctgttccacccagatcctccctctgaagcagggtttttgtgttgccgggaaggaggaggtatgaactgtgcctccttttgcctctgctgctactcagtgtggatcttccacagctcaaaaccagggagtatgatatctgtcagtgttcaccaggtgctgaaagtactcagaatagttctttcaccctaggaagttgaaggagatgggagctgccactcagctgccaaacacatctctgtagctctcttgacaacacagagctgtgtgggcaggggggactacactgtttaccagcttcctcacctgattcctctgtttttagctggagttcaggggagagaaatggctgctgccatcagcttctgccgcttgctctatataggccttccacagcatggagccgtggaaaatgggatctgccaatgtttactagctgccaaatccaccccgagtagctcttccatctcaaggggcggatctgcccttagctgctgaactccttaaaacagttctttggcaaaacagagctgtggggggacaggtgcagtccctgtgtggtccctatctcgaatgctacagcctcttattgttcttatcgaatttctgtagattctattgaataaatgcttctctatttgttgtaagccctttgatcagtctccagggactttgaatgattgtgatttttgaccagctaaatatatgtctctccaggggagagatatccctgagctcctttatacagccattccagaagtcccacctagtcattgtgggggttttctgggttttttctgagacagagtcttgctctgtctcccaggctggagtgcagtggtgtgatctcagctcactgcaaccggctcactgcctcccgggttcaagcgagtcccctgcctcagcctcctgagtagctgggattacaggcgcacgccaccacacccagctaatttttatacttttagtagagacagggttttaccatgttggccagggtggttttgaactcctggcctcaagtgatctgcccacctcagcctcccaaagtgctgggattacaggcgtgagccactgcacctggctgtcattgtgtttttaatgattctgtcttaatagaaaactagttttacacaaatataatcaagtgacttaaattgaaaggactaagattgaaaactgaattgaaattgaaaattgaattgaaattgaaacctaagatttttttgaaaggtatgattttattacggaaatttgcttgattgagctttattttaatcaagactttgtatttccatttttagaattaattcagagaaatagctaacctataaagttcatcttcagaattgagtcattgtagacctaagaagcaatatagcagagttattaagagcataggttctggggccagactacctaggttccagtctttgctttgcagcttattggttctacctgggttccaatctttgctttgcagcttgttagttctttttatttttatttttgagacagtcttgctctgtcacctaggctggagtgcagtggcatgatctcagctcactgcaccctctgcctcccaggttcaagcaattcttctgcctcagcctcccaagtagctgggattacaggcatgtgctaccacacccagctgatttttatattattagtggagacggggtttcaccatgttgtccaggctagtctcagattcctgacctcaggtgatccacctgccttggcctcccaaagtgctgggattacaggcgtgagccaccgcccctggccgcagcttattagttctgtgaatgagttacttaactgctctctgtctattcatatataacatgagcatcatctgccccttagaattattgcgaggttaaatgggtcaacacatctaaaatagagcctgactcatagtaagtactcagtaaatgttagctgatggttattgttgttagacacattaaaggcaaataatcatctcatctttgtattttattattgagaccaataatattgtctaaagccagagaccttggtgaaacgctgggtgcccagctagctataatatgatctttagttccctctagtggaagaaaattagataggctctttgcataaacatgctgcttttggaattgtgatcatttaacctaataaaattacccctgaataattaaccaaagacaatatccacatacataaatggatttaagaaattgttaaaacttacaatcttaaatattctttccaagtgaaacttttttggggacgtgtaatttataatattaaataatatagtatataaaccatccagtgacataaaaagttaggcatatattacttttgtttaaaacaagtgcattcagtagtagtagtaccttgaagttttccattttaacattcatacccagttatctgcaagtagatggcatttcttggtcattctctgagaagtctttaatcattgtgatatgccacctggagtagatttccttgaagttttggcatttttagtatcctcttccacacagcctatggggtaacagaaagattgctagattgggaatctgagacctgggttcatcttccagttctgctatgaaatatctgtgtgacttcgggcatgtcttactagggcctcattttccttctgagtaaaatttgaggatagagaggagcatgtgatgatgactgtcttgctgtcacttctgtttctaacattctctgattcagtgatacatacactttgatgtgagacaggagatgtataatagatgttgagtctaagttgggtaaatgggtcctgtatgcttgatgttgccttctagcaggattggcaggaatggaaatcaccagcagtggaatgatttggtaaatgccaagatcttgaggcatctatggaggcggttgctagattgcagcagggtatgcctccctcagcttgggagattgttaaagagaactttgaggcaacgtctaagtgggatcttgatgaacaagtaggggtttaccaggcagagaaggaagcacgtggagtatcatacagagggaacaacatttgtcaggggacagagagcagggggccggtgcacaagctgcgggtggttcaggattggggtcagggaggctgaaggaagaagctactggaaaggaatgtataaatgtgtgacttcaaaaaaaaaaaacaagagctaaattgtttgactaagaagccggagagctagcttctatttccagttatactgttaaataggtctgtgaaccctagttaagttgttggacttaaaagattttttggaaggctttcaaagccatgcttagggattataatgtcttgctgtatggaatggagctcagtgaaggttttggaataatataatatctgttttagagtaaaactatgatgacactttaatgagtctaaagagaagaaactagaggcaaagaaacccatttaaagatctttgctgtgatccagtcaagaattgttgagggctgaaactagggtaaccgcagtaagggaaagatagttttgacaggtgttgcagaaatagaatggacaggttttggcagctgcatataggaagtagaggagaagtggtagatggtgtgaagatgactccaagggctgtctggaagattaataattttggtaatcagtaggccacacacatacagctacatgggttctgttttacttttcttaactagtgtccttattattaaacattttgagtgtgtctagtttttttcccaaataaccctatggtcatcttgaggttttttacgaaatatgtgatttcccaaaaaactgtagatgaaaaactgcaaagttaaagtaggcatagaactacactatatatagcagtgtggtttactaatagatgttcacattgctgccttcttggtgtcaaactcggtttgattgacatttgttaaacatagaatgatttccaccaaaaatgatgaaaggaaaagaaaacaaaacttattgtgcatgtgcactctcacatactttattaatcatccaggcctaactacaaccctgtataggagttgttatcttactctttctattttacaaatgaggaaacagatgttctaaggttatgcagctactaagtgatgaagacaggaaagacaggtcttttgactacaagtctattgccctatctattatatcataactgcctgccagcagaatgtgttagtgcttaaaaggatagatgccagatctgtggaagtagggtgaccagtcatcttggtttgcctgggaatgagggtgggttctcagaacccaggactttcaacctggaaagatcctcggtgccacaactgagaaagttccaggcaaaccaggacaggttggtaccctgtccagaaaagtcacttatatgaaataaaccattatctagaatgacttaaataaggtatttactgtatttctttcccataatattgtgtcatcaatgctaaatgacaaatgattcctaagtgaagaggagttaaggccccgccttccttccatctgtttgttttcactggctctgagcatcctgccttgctgcagttacactcaactgtgtgtgaatcagatactagatgcctttgcttctaagtcagttttattttattttttatttttatttatttatttgtttatttttagacaggatctcactctgtctcccaggctggagtgcagtggcatgatcttggctgactgcaacctccacctctcgggctcaggtgatcctcccaccccagcctcctgagtagctgggactacaggcacacgtcaccgcacccagctaatttttgtattttttgtaggaacagggtttcaccatgttgcccaatctggtcccaaactcctgggctgaagcgatccacctgcctcagcctcccaaagtgctagtagaattacaggcacgagctaccgtgcctcgtctctaagtcagtttttaaggaaacttatgctttgcccattccaaatttgatgaaatggcaaaagagctattcagggaaaaatcaaggagggctgtcagtatctgtgatttcaaagtatttatcaaaacaattaactcatttttcttggtcctttttcaaataagtatcacatattggtagttatttctttacgataaatttgttttatactatttttatgagactttgttgacaaaaggattctgtagctggatggggaaacccatattattaaaagaaaaaaaaacctcagataatcatttcactatgccgtacagaatttttacctcattcattttttacatattgaaacagaccacaaattgctttctgggaaaagttttggccctgctgtcagtatttcctgggctggccccatcctggaagaagatttgggggagaaatgggtggtaaggaaatctatcctgtcaacgtgtccttgttgagctcctcagctatcagttaataaatatagaaagtaaattatagataacacaattatgaaagtataaagcacaggtatgtgaagaacattttttttctttgacatattagttgaattcccattttatttcagtaacttctcgtttgctttttaaattttattgaagaacgtgtatgcacaataaaatgtacccatctaattgtacacttcagtgagttttgacaaatgtatgcattctgtcatcccacaaagttccttcgggctctaacatgtatgatttttaagactttaatattgaaaagtaattgagttataaactgatatttctctaattttcttgtataaagtaaggaataccatgttgaaataggtgtctggtttttctaatagtcaaatgccctgatcttcccccctttggtttacatttcccaaaatgaaaagcaacagagcaattgcaccttttagacaaacttagagcattgtatttctatttttgtcatatacaaatttgttacacttatcagaactgaaaactctttgggaaatatattaacaaaaccccattaatttgtaaatgcttaatgcagctaagattgatttctaattaatacacatttgcctatttaagaaaattttcacatcagtcaaacactgaattaatggtatgctgcttcctttctttattcacctgatgatgatatttggggccataggaattttttttcaatgggcaagaattcaaagaaattagaaggtgcttggatttctgtttgtgtgtgtgaaaaaagacaacaaaatgtatagagctagtagtgaaacatgtaaaaaagaatcaaagaaattatgagtttgcagttgacccagatttctatggtggcctgtctaggcctctactcttcactagctgaggtcaactttcctgaaggtcaatgaggaagatagcctcattaaagccaacctgacctgtgttgttgccaaaggcagctgggatctttattcttcaacttgattatgagataaaggtagaacccagcagcagaaattgactttgctactataatccttccaaggttctgcttggattcctttcttaaagtatcatttggtcattcatttcagtacactaaggaaaaatatgttgagtcaataatgactttcatttacttattttgttattaatatttattgaaatgaacacattagtacttgtcctagttctttctatgactagattagaatattctttattttgattttgagtccaggtcagctcttagcgaattttgtttaactgttgaatttctaacacaacctagacattgtttggaaatgaatgagaatacttgtatatttgttaggaaaagcgcagtatctagtttctgactatcactagttacaatgcagctgaaataagccggttctgtaacagtcttgatagcctgtcattcaagtcagtattaccatattagcactattgtgtgattggatcttaggatatataaaaactatgcagacccaggaggcactgtggtgtgatgtaaagagcaaagggctttggttattagtcctgcttcctccacttactagctgtgtgatttatatcattgagccctggacctcagtttctacctctgtaaaatggggagatatatgtgcatatatatgtatgtgtatatgtacatgtatgtcatgcagggttattacagtaacaaatgaggacttatagaggggcactttaaagtctcagagtttgcattagattaacaatagtgaagaaattccagatttagttattaaatgatggatttgggttattaaaagaagctataggatttccttctgtgaaagtattttttaaaaacacatctgtttgaatttagattctttttggaatgactgacattataaatatctgtaagaattacagaactcacaatcaggagaggataagaattaaagcaagtcaacttatctagagtggcaccattccaatttggtagacactagccacatgcagttattgagcacttaaaatgtggccagaccaaattgagatttgctataagtgtaaaaatacatgctagatctcagagataatagtacaaaaaaagtaacttattttattaattttagtatgattatatgttgaaataatactttgtatacattgaattggataaaatatgttatcaaaatgaattttacctgtttctttttacttttttaatgtggctactggaaaatttaaaattatatgcatggcttacattatacttaaattggatggtgttgatcaaaatctttattgagctaggtgcagtggctcacacctgtaatcctaacactttggaagtccaaggcaggaagattgattgaggccaggaattcgagatcaacccgggcaacatagcgagactctgtctctataaactatttaaaaattagctgggcatggtggcacgtgcctgtagcccagctgctcaggaggctgaggtgggagcatcccttgagcccaggagttcaaggttacagtgagctatgatcacaccactgcactccagcctgagcaacagaatgagaccctagctcaaaaaaaaaaaaaaaaaaatccttattgaatgctctcgagcaaacgaaatcttaaatttagatcttttaagttcagatacagatagaatgaaaagttctcctagttcttcaagaaaaatagtagtaaaataatactttacaggaaaatcatttttaaaacagaccacttgaaccagcttccctaactttcccttacttgaccagtctgataggcagaccctggtgggatacttgctttactattgttggagagcccaaactttttaggaaaataatagtcattctaatgccatatggcaggttgatttcatttaagtttctaatttgggttagaaaattaaatattgctacctgtattactagttccccttttaaagggaaataaattgataaaataaatataggcatatagttaaatgtaaggacactaaacacagaaatagattagtttaaaatatttttaaaatttcctgagaaattacaaaaaagaaagtacaacttagccataaaaaggaacaaaataatgccattcacagcaagctggatggagttggagaccattattctttttttttttttttaatctgagatggagtctccctttgttgccctggctggaatgcagtggcgtgatctcggctcactgcaacctccgcctcccaggttcaagcaattctcctgtctcagcctcccgagtagctgggactacaggtgcacgtcactacacccggctaatttttgtatttttagtagagacggggtttcaccatattggtcaggctggtcttgaactcctaacctcaggtgatccacctgcctcagcctcccaaagtgctgggattacaggtgtgagccactgcacccagctggagaccattattctaagtgaagtaactcaggaatggaaaaccaaacattgtatattctcactagtatgtcagagctgagctatggggacgcaaaggcataagaatgacacgatggactttgggggaagggtgggaggggaggtgagggataaagactacacattgggtacagtgtacactgcttgggtgacgggtgcaccagaatctcagaaatcaccactaaagaacttttccatgtaactaaacaccacccgttccacaaaagctattgaaattaaaataaaaaatgtactcattaaaaaaaaagaaagtacaaaggagagtgaagagaggtaccagttactagtctgtaaacaaaacaatacttcaaaatagagatggtaaccctgggtcatgtcattcccaggtacattttgtgctaacatctgtaagcagtcagataatcaccactttaaatcatattttcatcacctgctttcaaattccttcctactttgcctctagagttgatttgtaggcaaatagtgtttttagtttgctatatcagcgtggacttaatagcacttaatacatatatctttaattcacattcatatttagaaacaaacattttgagtttaatattcgtggaatctatagttggaatggatatatttgtgtttttaattgtgctatttgagctatttaatttatacttgaattcaggaaaacatgaccacaatttttctagatcattgcccttatcatttgaaatatatttttatgttgctagtttcatactagcaaatcaagtcaaatcagtgttctgactttagttctgaaatgtcagatccggtgacatttaaattgctttgaaggctggccccccagcaattctgcctttattttgagagtgggtaggtgataagagactagaccaaggacttgttcagccatttaccaaatcaaaatgtgaggctcaaatggagccaaatgtgtggcagaaatggagcatccatttctgcttacaaactttcagtataaccaatgtatcacatagcaaatggtgaatgtggagataaaaatacaatttagactgggcacagtggctcatgcctataatcccagcactttgagaggccgaggagggtggatcacttgaggtcaggagttcaagaccagcctggccaacacggtaaaaccccatctccaggtgctaaagttgaacgagctgatggatatgaaccaccagtccaagaatctgtttaaagttcagacttaaaatagtggcaaataaaaagtcctcatttgtgatggtttgcttctgaaagaaaaaaaaaagtctctactaaaaatgcaaaaaattagccaggcatagtggtgcacacctgtaatcccagctattcaggaggctgacgcaggagaatctcttgaacctgggaggtggaggctacagtgagccatgatcacgccactgcactccaacctgggcaacagagcaagactctgtctcaaaaaaggaaaaatacaatttagttacatgaaagaggcaaaatagaaaataagctgaaaataaagagaaaatatcagttttaattgtggcaaacaccaaatctgtttacttcatgactcctgtgtcacaggatagagttaaaatcaggcttttgattagaatagagaggaatggaaagagaaaaacttaagtcgaaaacagaagatatgaaagggtgagttctaataaaaatgggaagctagagataaacataaaaatgagtaataaaaattttaagcttttcctagaattagaaggcagaacactcctggagaggaaaaatctgtgcaggcatgtgattgatgttgtctggctcagcctggccctccagcacacttgttaaaagctttcctcatggttatgacttcccagcacaaaccccacagctgcttcacatcctcccctcctgcggggccttcctaactacttttggagatggaggcatctttcctgtgcctctgatctcttcctttgcagtaaacactgagcccccagccctgccatgctgggctccaaacatccagcttctcattagaatcttaacactgccctctccaactgatttggtagactctgcaggtaccacatcacttgtcactgccccatttcattgactctaagaaagtcatttgtagaagttagcagtcagcttgcagatggtaggacaaaggcaggaccagcaccatattttctgactccagatcctgtaggcttttcctcactgccacttacaaacacacagagtgcttcctttaaaaaaacaaacaagtaaaaccttctcttgaccccgctatttctttcctactgccagattcttctaatatgatcgtgttcaaacccagcatggcattattggaaggactgctgactttggaattgggcaggccagggttcaaaacctaccctcatgatagctgtgtgatcttgaacacgtttctaagcctcagtttctccatctgtaaaatacctacctcacagtgtggttgggacatcaagtgacagtgactatattaagtacttagcccaatgagaggtgtgataattttaactgattattacataattgtctctggcatactgacctcaaccctgactcctccccaaaagttgatcttgctcaggattctcattaccttttctggctgaatcttgtggtcttttctcagctttcagccttctccagctatttacaacttaatttcctctactctcttgattttcttaatattattgattcttcctttccttgtggcttctcttttgtcaaattttctgacttctttttctcattctacccttatgtaagtcaatcttctaaggttccatctacgatcattgctctgttgacaagactaagttgaattaataaatcagaaaggagataatattatctattttactttctgcagtacatccttagccttggttcttccttacctgtctcccttcgactttctaatataaaaatgtcacattggattttaagtcatcagcaaacgggtaaagccccagtgctattagcactggatggctttcattattctattccatgtagacatggcaagcgatttccatgcccaaactgttttgtatgatgatgatgatgatattaacaactttgttttccaaatagtattatagagtttacacagtagtcctacatacattatttggatttgttcttcaaagtaacattgtgaggtaggtagagtttggaattatccaacactttttttttttttttttttttgagacagagtttcactctttgttgcccaggctggagtgcaatgacgcgatcccggctcactgcaacttctgcctcccgagttcaagtgattctcctgcctcagcctcccgagtagcagggattacaggtgcccgccaccatgcccggctaattttttacatttttagtagagatgtgatttcgccatgttggccaggcttgtctcaaactcctgacctgaagtgatccacctgtctcggcctcccaaagtgctgagattacaggtgcgagccaccacgcctggccccagcacattttataaatgatattttaaaaattctgactttgactctaggaatagtgccttttctgtttaaaccatactattttttgttccctattccgtataacttccctgataggtctataaatgctagattttaggctaaagaatagacaacatatttttattttatttagggaaaactaagaaaaagaggtaaaaatcaaaacagtaaattgagttattagtttattagcagatcaaggaagagttacaaatttggaggctaagattttattagaagagttggggaaagtatttgtggtttgtttttttttttttttttgcttttggggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctcagtgctttgagagtctgaagcagggaggattgattgaggccaggagttcgagaccagcctgggaaacataccaaaacctatctctatttttttctaaaaaaaaaaaaaaaaggttgtaatcagtgactttgattaggaaaaaaaacagaagatatacttgctaaatattcaaaagataccaaggtcagaggttatattcattacctattgcttcataacaaaatgccccaaaatgtaatggcttaaaacaacatacatttattatcttagtctctgtgcatcaggaatgtgtgttccaacttagcagggtcctctggctctgggtctctcacaaggtgataataaagctgttggccagagctgaagtcattttgaggctccactacaatgtggatctgcttccaagctcactcacatgattgttggcagtcttaccttcctcacaggctactggactgagagccacaattccttaagagctgttggcccaagcctcccttggttccttgtccgttgggcctctccatagagcagcttccagcatggcagctggcttcatcagagcaagcaagaggacaagtgagagtatgagcaagacagaagtcacagtctcgtaacctaatctccaaaattacacaccatcacttctgcagttagaaatgagtcactagatccagcctatacacaagggggatgggattataccagggcctgaatatcaggaggtgaggatcactgggaggcatttcacaagttgccccctacaaagggctagctaacatattggctgtctacatcaaaattcaaaaatatttttacaagtttgtagcaaaggagctgaaacaaagaaggtgaaatttaagaccagttaatgttaactccttcattcaaatatgagtaagtgcaagatcagtgtgaatttagttgtgattatgtgaaaaaagatgtaaacattttagttgttgtttgcaacagcttaaaaagcgctgaatggaaggttatgctacattaattaggagtatatagtattcagaacaaagtcatactcctcccgttcaccctggaccattcatagtaagcaggacactggaatgtctgcagaataggataaccagaatggaaaggagcctgaaaattgtgtcatagagacacagccttcaaaatcttttctggcaaacctgctaaaagaattttgaggccaggcgtggtggctcatgccaataatcccagcaccttgggaggccaaggcaggcggattgcttgagctcaggagttcaagaccagcgtgggcaacatggcgaaaccctgtctctacaaaaaatacaaaaactaggtgggcatggtggcacacgcctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactctgtcacccaggctggagtgcagtggcgcaatctcggctcactgcaacctccgccccctgggttcaagcaattctcctgcctcagcctcccgaatagctgggactacaggcacgtgccaccatgcccggctaatttttgtattatttagtagagataggtttcaccaagttggccaggctggtctcgaactcctgaccttgtgatctgcccgcctcggcctcccaaagtgctgggattacaggcatgagccaccacgcccagccttaaatatattttctacacaactgtagaattgcctgtttatctcattcactgtatggaaaatgtctgctatgtgacctacatggcaatgctagtccttattgtcaaatcactcagccaaatcagactcattttctgtcagggaaaaaaaaaatctgacttcatttttcaaacaaaattaaagtgttaaatggacatccctgtgacactcatcttagtattgattttgaattcttaaacagcttaccatgaatatattgcctggataaagtaaggtggaacctccctttttttctcaaactctctttgttttgctttcaaaggtctctccctccctcaggggctgtgcatttcccagccatctctttgaagttaggctttttgggttggaggagtagtttgccttttggatgggtaactggagatgtggagatgggtgattgtagttgtggagatgtaaaagaaaaaccgcagaccacagacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgttgaaaagactgggaggctttggttatccacgaatgtattcgtttcattattctgctggaagagtccccaaagcagaagcccatagatagaacataatcaatgtccacagttatttgaaagattgtcatatataagactatatgcttattcagtgtggcatcagaggctgtaactagaatcaacaagtggcagacgtcacctctaactaaagaagacctttttgatgattaaacttactccatgaatgaagcagcctgtctcacagactatgtagtttctcactagaagcactcaagttgaagctggatccttccaaggggcctgaagataaggttttaattttggactagagatggcctctaacatcccttctaattttaagatattgtaattcttttgttttttttttttttttgagacagagtcttgctctgttgtccaggctggcgtgcagcggcgcgatcttggctcactgcaacctccgtctcccaggttcaagcgattctcctccctcagcctcccaggcacaggtcaccacgcctggctaatttttgtatttttagtagagacagggtttcaccatgttggccaggctggtctcgaactcctgacctcaggtgatctgcttgcctcggcctcccaaagtgctgggattacaggcatgagccactgtgcccggccaagatattataattcttttaaaattacttatctggtttaattttattctttattcaagaaatatatttctgtctgtatgtttattttctgagaaaactaagaacaagttgggtttgttttttgttgttgttgtttttgtttttaacagtctcactctgtcgcccaggctggagtgcagtggcgccatcttggctcacttcagcctccacctcctgggttcaagcgattctttgcctcagcttcccatgtagctgggactacaggcgcatgccaccacgcctggctaatttttgtattttttgaagagacggtgtttcatcatgttggccaggctggtctcacacccctggcctcaagtgatcaaccctcctcagcctcccaaagttctggaattacaggtgtgagccaccacgcccagcctcctaaaaagcaagttttacatactatataaagtaatgatcacagaaagcaaattttaaaaattcacctaaatttcaccatgtatgctaattgtatcaaaggggacttagtgacagtgtagtagagaaaaaaggatctttggtttcataaaacctgggttaacatcccagctctgtcacttttactaattatgtgaggttggccaagttttataagttccctgagcctcagtttgcttaccttcagaatcttcctaagattatgagaactagatgagaaactgtatgtgacttccctttgtaagtggtgaagtgctttttaactataaagtattatttccagtggctttaacaggatagttttagtccctcattgttgaagtagtctgtgtgggattttatgtaactaattttgtatgttgtgatggaaataattcatggttggctgtatatcgagatgagacctggttaaattggatattttccagtgacctgatcccagtgttaacccaaatcactagaacatggccttatgttttcttttgttttgttttcttttttaacagtgtaattgtggaaaatttcaaatgaaaagagagaatagtataataaaccccagcatactggtcaccaagcttcaatagttatcaaaacattttgccattcctattctgttcctcctgatgtctttttctcccctggagatttctaaagcactataatttcacctataaatactcttgtttgtatttctaacagataaggattttttaaatgatcatattattattatacctaacaaaatcaacaataattccttaatatcatgtcatgatcagttgatactcagttttccctgattgaacatgaattttaactgacagatttctgaatttagaattgttttattagctctagggacctgaaagtagattataaattcagttaaaataacttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagtttgagaccagcctggccaacatggcaaaaccccgtctctactaaaaatacaaaaattagccgggtgtggtggcacacacctgtaatcccagctactcgggaggctgaggcaggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatatggaaaagattagattagtaaatttcaaattttaggttagaaaatccggtataaaacttgttaaacaagcaggtacccaggtcccacctctagacattcacttttgcagatgtgagttctgaccgggcaggtcaagagatgattgacctttaaaatgggggtaatacaacataaaggctatatcatcattgtcccaacacacacagtagttttgtagacatctgcatatatttgcacatccattactttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccagactcccagaaagaaagcaggtgttcagcctaaatcacattgttagcacaaacagtttagacacagtgagtcagtcttttcagtcaggaatgtagaggaccgtcctgaaatccaagttcccagataaacctctcaagggccaaccttagtaggcctttcaagccttttatgagatagtagtttaggcctgctatattaactcttctgcacaaactaaaatagagataaatagaagaagggttttaaaagagttgatataaactcctggatctgcaaacaaaatataattgactgtaaagataatgacagggtttggagtttggggtttttttttttttctttttaactgtaaatacagtatcatttttatatctgttaaaaaacatttaggtggtcagatttttgtataaaacaaatcctggattgggatgttacagtatagaacagattttaaactttgaatgctatatgagaaaataaactattcagatgctactgtcttagaaatacatttgaaattgtcactccgataacttttcgtctatgacaactaatcttcaagccactaaaataattttgaataaatttgtgtacatataaaatctgaagaaaattcagttaattttctgttatttaaaagaagtatagtttgttcatttaaaaataaaagttattggccaggcacggtggctcacacctgtaatcccagcactttgggaggccaaggcgggcggatcacttgaggtcagaagtttgagactaacctggccaacatggtgaaaccctatcactactaaaaatacaaaaattagccaggcgtggtggcgggcgcctgtaatcctagctactcgggaggctgaggcaggagaatcacttgaacctgggaggcagaggttgcagtgagccgagatcacaccactgcactccagcctgggcaacaagagcgagactcagtcttgaaaaaaaaaaaaattcttagtgtacaacctttgccatatacataacttgtaaaaatttagaaattacagaaaattttgacaaaaaataatgtcttaattttgttataaaaattgtaacagaaataaatgtcattcacaaacattttggaccatttccttctattggaagcattttgctataccattaaatattttttggatacaatattttaatgacttcattaagacatctaaatgtgtgcatgtgccatgtttaataaattccctatagttcaacattaacattgtttttccctattagaaataatttataattaatatcttgtacataattacttgttcacgccccttgattgctttgtttcctcagaatacatttctgaaagtagaataactgggtaaaagagtatatgaatacatacaaatacatacatcatacttagatttaacctttttctcagtacaatgcctcacattttgaaaaatacattcacataaatatacaacttaaagaattattgtagaagtgaacaaccatgtaactataacccaagtcaagaaattttaaaactgccagtacctcaacagcccctgaattcccctttctcatgataatccccttcttctctcagaaataactaatctggacttcacttctgtgctttttatatccctagcatcaaaataggaattctcagaattctcaaataataaagttcactgtcgtctgctaaaatctattttttttttttttttttgagacgatgtctcgctctgtcgcccaggctggagtgcaatgctgtatcagctcactgcaacctccgccccctggattcaagcaattctcgtgcctcagcctcccgagtagctgggactacaggcatgcaccaccacgcccggctgatttttgtatttttagtagagacagggtttcaccatgttggctaggctggtctcaaactcctgacctcaagtgatccgcctgcctctgcctcctaaagtgctgggattacgggcatgagccaccacgcctggcctaaaatctttatttgaatggaatcctacagtatatactctatttttggtctctgagattcatctggttgctttgtgcagctgttcctttattttattgctatgtagtattgcagtgaacaaactcgcactatttattcattttaatgctaatgagtatttgggtgattcccagatttcactattttgtagagcagatccttccacgttgttcttcagccatgttttaagggatgtacttgtctgcatttctcatatacattttagaatgaggttgtcaatttccaccaaaacaaaaaaactattgagatttttgtcttgaattactatatcaaatcttgatagcaatttgagaataattgacatgtttacagtgttgaatcatccaattcgtgaacatagtgtctatcttcccatttatttagctctttgatttcttgcaataaagttttatatgttcctctgtagaggttgtgtacatctgtattagatttatgtattgtcagatttattcttaggtattttgtttttagggtaagtcagtttctctcattctcccttctctttccctttccttgtactaactttgtgttcctattcatcaggcttcattaattccaacaattaatctgtagaatcatttggattttctccatacataatcatatcatctgtgtataaggaggatttgatttgccctttccaacttttttacatcttttcttgcctttattacaatggataaaacattcagggcagtggtgatggcagttatctctgcttatttctgatcttagagtttgctaagcatgaatggatcatgaattttatcaaatgtcttttttctgcatatgcagtcatgcatcctataatgatatttcagtcaacaacagactgcatatacatgggtgctctcataagagtataatggagctgaaaaattcctatcgactagtggtatcatagctgtcataacataatagctcaacacatcactcacgtttgtggtgatgctgctataaacaagcctgtgctagcagtcatataaaagtataacacatacaattatatacagcacacaatacttgataatgataataaataactctgttactggtttatgtatatactatacttttttgttgttttgtttttattttaattttatttattattattataccttaagttttagggtacatgtgcacaatgtgcaggttagttacatatgtatacgtgtgccatgctggtgcgctgcacccactaacttgtcatctagcattaggtgtatctcccagtgctatccctcccccctccccccaccccacaacagtccccagagtgtgatgttccccttcctgtgtccatgtgttctcattgctcaattcccacctgtgagtgagaacatgcggtgtttggttttttatccttgcgatagtttactgagaatgatgatttccagtttcatccatatccctacaaaggacatgaactcatcattttttatggctgcatagtattccatggtgtatatgtgccacattttcttaatccagtctatcattgttggacatttgggttggttccgagtctttgctattgggaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcctaccaacagtgtaaaagtgttcctatttctccacatcctctccagcacctgttgtttcctgactttttaatgattgccattctaactggtgtgggatggtatctcattgtggttttgatttgcatttctcggatggccagtgatggtgagcagtttttaatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttagacatgaagtccttgcccatgccttgtcctgaatggtaatgcctaggttttcttctagggtttttatggttttaagtctaatgtttaagtctttaacccatcttgaattaatttttgtgtaaggtgtaaggaagggatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagttgggtagcgtgatgcctccagctttgttcttttggcttaggattgacttggcaatgcgggctcttttttggttccatatgaactttaaagtagttttttctaattctgtgaagaaagtcattggtagcttgatggggatggcattgaatctataaattaccttgggcagtatggccattttcacgatattggattcttcctacccatgagcatggaatgttcttccatttgtccttcacgtcccttgtaagttggattcctaagtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttctcctgcctaattgccctggcctacagtatgttttaagctaagtgttattacaggagtcaaaaaggttttaaaattttttaagtttattatataaaaaattatagtaagctaagatttattattgaagaaagaaaaatacttttatataaatttagtgtagcctaagtgtacagtgtctagaaagtctacaatagtagaaagtaatgtcctaggtcttctcattcactcatcacttactgactcacccagagcaagttccatgaatgcaagttcccttcatggtaagtgccctataccagtgtaccattttttatcttttatgctatattttgattgtaccctttctatgtttagatacccaaatatgtattacagttgcctgcagcattcagtagtcacatgctatgtaggtttgtagcctaggtgtgtagtaggatatcccatctaggtttgtgtaagtacactctatgatggttgtacaggaacgaaatcccctaactatgcatttatcagactatatccccatcgttagcaacacatgactatattgaaataattatataataccatccttcaatctattgctgtagtgaattgcattgattcttgggttaaccaaacctggtcatgatttatgatcttcataatcctttttacatattgttgggtttggtttaggctttctgtgtctctcttttttaatttatttttacttttttttttttttttttgagacagggtctcattctgtcatccaggccatagggcagtggcaccatcacagctcactgcagcctcgacctcctgggttcagttattcctcctacctcagcccctttctgagtagctggaaccacaggcgtgccaccatgcctggctaattttgtagagatgaggttttgccatgttgcccaggctggtctcagactcctgggctcaggtgatctgtccgcccagcctcccagagtgttgggattataggtatgaaccactgtggcttcctggttttcatacctagattacacttgcctcataaaatgaattggggaatgttctctcggtttttttgttgttactattgttctattgattgattgattgactgagatggagctttgctcctgtcgcccaggctggagcgcagtggcgcaatatcagctcactgcaacttccgcctcctgggttcaagcaattctcctgcctcagcctcccacatagctggaactacaggtgtgcaccaccacgcctggctaattttttgtatttttagtagagacagggtttcaccatgttaaccaggctggtctcaaactcgttacctcaggtgatccgcccgcctcggcctcctaaagtgctgggactacaggtgtgagccaccacacctggcctctattgttctctttatgtgatttgtagaactcacctctaaatccatccaggccagagttttcaatcttagttcaattccttaaatatttataggaatattcagggtttttattcattactgtgtcacttttagtaaactgtattttgctaagaatgagtgcattttatctaaattttaaacagttttggcataaagttcataataccactgcaggttctgtagtcatgtcttctttttcattcttgatactggtaatttgtgccttctctttttctttctcagccttgccagacatttaccagttttattattcttttcagtgacaacttgtagctttgtaattcttttttttttttttttttttttttttgagacagagtctcactctgttgcccaggctggagtggcgtgatctcggctcactgcaacctccacctcccaggttcaagtgattctcccaccttagcctcccaggtagctgggattacaggtgcctgccaccatgccaggctaatttttgcatttttagtagagacggggtttcaccatgttggccagactggtctcaaactcctgacttcaagtgatccgcctgcctcggcctctcaaagtgctgggattacaggcatgagctaccgcgcctggcctgtaatttctttttattgtgtgttgttttctattttagtaatttctacttgctgttatttccatccttttattttgggtttaattttctgggagctttttcccttttagtttcaacctttttgtatccttgggttttatttgtacctcttgttaaaggcatatagttgtgttttattccagtctctcaatctttgtcttttacttggatcatttagtccatttacatttaattatattttagtatattttgagttttatctatggtcttatgtgttctctatttgcaccacctattccatgtttttttctctcttgatttatttgaatcaaatgaatatttttatcattctattttccctctgttaattttgaagtttaagcactcttttctgttatcttagtgtatatcccagaaattacagtatgcttcgtaacacatcaaattctgatattgataccattattgtcctcctgaacagtgcaagtactgtagaacatgttaattttatataattccttccttgacttttaggctatgtttttcatgtatttaaattatattcgtgtgtataaaaacataaatcccatgtatttatatcatctcctatttcttatattatttgtatcgatttggatttacccacacacttatcctttgtttgttctttattctttcagcatctctaaggttttatctgggttcattttccttgtgtcagtctgctggatgcaaactttccatttttcttagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagatagatagatagatagatagatgatagatagatagattgtattatttttggcttttattctcttgcaaaaaaaaaaaacaagctcagcttttatgttctagggcatagtaagcttcattgtttgataatctgtgctggataatctcagtatatgaagtccctgtgggtttgcttttattgtctgttatttttgctggttattggtcgagatctcttatcccttcatgtaccttattcatttttgtcttgtgctagaaattatgttgaaaattattggcctaagatgatgctttctttctccaaagaggaattttgttgttgttgttgttgttgttgagacagggtcttactctgttgcccagactgaaatgctgtggctcaatcacagctcactgcagcttctacctcctgggctcaagtgatcttcctgcctcagcctcctgagtagctgggatgacaggcacacaccaccacagccacttaattttttttatttttagtacagacatagtctcactgtgtttcccaggctggtcttgaactcctgggctcaaggaatcatcctgcctcctcagagtgctgagattacaggcatgagccactgtgcctggcccaaagaggatttttatttgctgcttctactgcgaaccttcaggcacctagctgtttaagactttcttactcaagatttaaggcttagattttcagtgccacctagatgtaaagccgggttgcaagtctgtgaaggggctgattgcttccagttcacccctagctctttagggcatcagctcagtgctggagagtagagtttatcagattctcttgaattctcactcattttcccttttgagcccaggaattagagaccagcctgggaaatatagtgagacctcatctctaaaaaagtttaaaaattagccaagcatgggggtatgcacctatagtcccagctactcaggagactgaggcgggaggatcacttgggcacaggagatggaggctacaatgagccaagatcatactactgtactccagcctaggcgacagagtgagactctgtctcaaaaaaaaaaaaaaagaaaaagaaaaagaaaagaaaaaagtactttttttttttacttatttagttgtcttcaatgggagacatcatctagtctaccattacaagaagcagaactctagcaatgtatttaaaactcttttaacgtagttttcatattactctccataaagatttaccaatttatattcacacatggtaaataaatgtatctatgtttacattttgataggtcaaaaggatgttttggtttaatttgcatttattttgtcattagtgtggtcaaatattttaaaagtaaatttacccatttcttttgcatctagtcactttcattagttgtttagttttccttagttgttttagttgtaagaattcttttttgtttgtttgtttttgttttttgtttttaatagagatgggctctcccttgcttgcctaggctggttctgaactcctgggctcaagcagtcctcccaccttggcctcccaaagtgcagggattacaggcatgagccaccacacctggcgaagaattctttatttgctaaagatatttacctttttcatgtatttgtaaatattttccccaaatctgcctgttttattttgcttgttgatttttttttaacatgcagaacattaaaattctgtcagaaaattacagataagcaatagggaaggctagaatgaactcttagctactagattagagttgaagacagcagtataatctcatattgaatttattatatgtacacacacgcacacatacacatatacatgtacagatatatacagaaatcataaattatatgtgcatacatgagttagtacacatacattcctagctctgtccacttagagagcctaaagcatacccacacctagatttttgtttctgaatgtcctcctctaatttaagcagccagggatcctcggaaaaatgattataaattctagggctggaaaagagaaaatataagataaacatgaagcatcttagagtgcctgaaggtaaggaagtattcaaaaagatgggggcatatcagagagacataggaaccaacctgaaagcatgtccagtggccaaaactggaacaatttgagcaaaaaataacacagtatagattacaatccaaagtataaaataaatacttatgagtgcatagtgatataaagaaataattagataaacaattgagagagaaaaaaagaagaattccaagtgttaggtatagataatttccctccacccttgagtgtaggttggacttagtaactcactttcaaagaacaaagtatggagagggaaatagtaattttacagtagagagaactaacagattatcttcaccaagtgatcacattagcattaccagtgatcattcctgcgtatatcatccgctccttgatatgatgtgatgagaagggcatttcacctctgatattcttcccaagaaacccataaccctgacctaggcaagagggagacatcagacaaacccaaattgaggaacattctataaaatacttggccagcatgctttaaaactatcaaggtcatgaaaaacaagtaaagactaagaaactgtcaccaaccagaggagactaaggaatcttgacgactaaatgcaacgtggaatcctaaatggcaagggaaaaagtatatagttgacaaactgatgaagtccaggtaaagtctggagtttagttaatagtaatgtaccagagttactcttagcttttacaagtgtactatagttacctaagatgataacactagaagaagttcatttagtggtatacaggaactctctgtacaatcattcctcagtatatatgcaggggattggttcctggaacctcacgtgtactaaaatccacgcatctcaagctctgcagtcagccctgtggaacccatatataggaagttagccttccatataggcaggtttcgcatttagcaaatactgtattttttatctgcatttggttgaaaacattctgcatataagtggacccatacagttcagaactgtgttgttaaaggatcaactgtactatctttgcaacttttacgtcaatctaaaattattctaaaataaaaagttttctttactctaaacaaacaaaaaagaaaccatgagtttacaccatttccagtttaaagtagcaattacagatttttatttacaagacagttattaaattataaggaattattataagtaattttggtattatagttatataacaaaaaagagttcttaccttttggagataagtactgaaatatttatgcataatgctcttgtttttgtttttttgaaacagggtctcactctgttgccccagctggaatgcagtagcccaatctcggctcactgcaacctccacctcccaggttcaagccatcctcctgcctcagccccccaggtagctgggactacaggtgcgcgtcaccatgcccggctaatttctgtattttttatagagacagcgtttcaccattttggccaggctggtctcaaactcctgagctcaagtgatccacctgcctctgcctcccaaagtgctaggattacaggcgtgagccagtgcgcctagccatttatgcataatgttttattgatgtccgggatttgcctcaaaatcaagcagtgggtaggcagtgggtactatgttggaatacaggtgaaacaagattggccaatgtgttgttaattgttagagcagtgtaatgaatgtatgaaactctgtattttctacttttgaaattttccataatataaagtttttttaagtgagaaagaaattacatagtttttaactttttaagttttatatttgtatatcttatctctgaaaatctgggttccttgccacattaatatacttatttgcttcatcctactagtttaaatatgcaataaaaataagactattgaatgcagattaggatttctttgcacttcttttcatccgaagggtatatcccacaggaatgcacaatcaaaaccctgggttttaaagaaattttaaataactcttctcattgtggttttgccacaagcttgatatagatagatttaagtttgtttgtttgtttcagtttgtttttttatttacatagtttttattacaattttagattcacatacagctataagaaatatagatccttgtagactttgcccaattcttcccaaaattaacattctgcaaaactactgtgtcacagccaggatattgacattgatacaatccactgatcttattcagatatctgcatcagtttgtttttaatttttaaaattgtcttttttttctccttgctttaattttggttttagattatgaaaaacatgtatatgattacacaaagtcaaacctgtgaatagggttcattcagaaaggtctagtttgcatccctgtccccattcactttcttgccctaaagaaaacaatttttaaaaattagttattttatttttccattatttttatttgaaaatatgagaagatatgtatatgattttgtgccaccccccttcttacacacttccatatattctcatctaaaccttgatttttaaaaaattttaatatgaaaacactggggatcactccatggcagtaagtagacatcttcttcattcctgtttatgcctgctgaatactccattatggcaaagaattgtttattaaaccattcccctaatgatggactttgggattattttcagccttcttttactacatgaataaccttgtgcatacgttatttcatactgttgctaatgtcaaattccttcctcaaatgttgtgtcattttgcatcgccaccagcactgtctgagggttgtaggcttcaattttaaattgtgatttaaaggactaatctctgtcatataaattagtatatgtcttacttcattaaaaaactgtactcatatgtataaggctagacaaagagagtcatagataaattctgatttattttatggccctcatttatatctgtggacttgaccagaatgcttttaactagagtgggtttcttatcattgtaaggtcactaggtctaagaaaatttgtaatactcagaaatagagagaaggtcatttgtccctctgccatttgtttactttagatagtaggcagagtcattgaatcttattaggaaatataaaaaacatacttgctctttttgccagactcgaaaaagtactaaagctattcatatttcttatacacaccattgagagctcaagaggttcacaggaaataaaggcaagattttgatgggacttttaagacaaggcaaggatttggggtttatcttgaagatgtggatgccatcctaaggcatgtgatcagatcaccatttttaaaggttgtttttttttggctacagtatggctatagtataggaaggaacacatttggatatggggagaattgggaggccattgccattgttcagtatggatattgatggctaggatagatcagtgtcagcagagagcaacagaagtgaattaggaattagaaaggatagggtttgatgattagataaaggaagtaaaggaggaagaggagtcaaagctgacttgccgtctctggcttgggcacctgatatatgatggtgccactgactaacttgggcaaccctggaagcagatgatgcagtatactttggacatgctgagtttgaagtctctgtaagatatctgaatgaaaggactaaataggaagttagatatgtggattaggagcacagagagagatcttgggtagatacagagatttgggaatggttgctacttagatgatttagaagagtatatagagggagaagaaaaaaggacttgaggactgaggttcttccaaattttggaggttgtagaaaaggaggaatagctagcaaatgagatagagaaggaatagctgaagagatagaaaatcacgacagcaaggagttgcagaagccagaaaaaaaaaagtgtatcaggaacaatattataggaaaatgaagggtttgggtaattcttagttccatcctttactagattcctgtattcttcaactattgtcgagtgttcatgctctgcacagctcccattcggcctcatttctgagatgtgctgccttttggtatctattggtatctctttgctgccatttggtattcctatctgatatctcatttccttagtgagggacatagtgagtgaaagaacattagaggacaaatggaaaggcctatactgttgtcctagctctgtcaccaactttatttagtaattttgtttctttatgcctattatctgtgagatatagctagaatttcaggacagagatggctacacatggaaacaattacaatgagaagtaaggagagagaggaagagaaagagccgtcatagaggaggtgatactgagaattgaaggatgaccaggagtttgccaagtggtaatggcaaggatgaaactagaaagaagtagtaaatatattataaagatacagaaatatcataaagctttctttttgagacagggtcccactctgtctcccaggctggagtgcagtagcacaatcatggctcactgcagcctcgaccacctgggcccaagctgtcctcacacctcagcctccaagtagctgggactacaggtgcacgctaccacacgcggataatttttgtatttttttgtagagacagggtttcaccatgttgcctgggttggtctcaatttcctgggctcaagcgatccacccacctccgcctcccaaagtgctgggattacagacatgagtcactgcacctggcaaaataataaaatttaaagaaagaaaatagaatgaagccaggcctcataggaactaggaaaaaagatctcaggaatccaagttactgttctcttcattccttagggttttgtgtctactttgctctggaagaaccagctttctccagttactcaagcgcttgcacatgaccccaaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctatagataaccttcttttgaatcagggatctgtttcatccagtggcaaacagaagcccactgctgtttccatgattgggctggggctttagatgggagagtttaatagaatatagatggcaaatcgactatatgagtgggaaaagagagaggcattacaggcaggcaaagagcatgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccagttgagaatatccaacacacataaacaggaattctagaagtagaacatagagggaatgatgaagaaaagagaccttattcaaaaagataatagcccagaactttcccaaattgaagaaacattgtaacctcagatagatgtaaggtttggagaagaaaattgctaattttcttggattatttgagtttatggtggttgtaggatacccacctgtaggtgtctactccaaactgcctgagtctggcccccaggagaagaacctaggctagcaataagagtttaggaggcattaccattagcacagggtccatttcacttcttggcacctcagtttctaccctagcaacttttgagaatgaaatgaagtgtaaaagtactctgataatcacaacactacatagttttaccattgtcttcattgtcattgtcataaattctattgagtatagagcctcagtattagaggagaagagctaaggaacctggagccagatttcctatattcaaatcctggctctgctactttgtaaccatgtgaccttggacaagttatataacatttgtcttaagcctcaatttcctcatctgtgaaatagtacctgtctcctagtgtttttatgaggattaaataagttactacttgtaaagcactttaaatggcacttggcatgtagataaatgcccagtaaatctttgctattagctattaaagtacctgcatttcacaggaaccttcagtatcttatttcagaggagtgactaatgtaaaaatcatagtctatgaggataataaatttaggtatctgtgtcttcctgtaatactcaaaggatcagtttagttaactgctggcttttgtctatgtaaagagttttgtggttgtttgcaaattgctcatgatgttatttgaacattcaaggacttctatttttttcttggtaatgtctgaaacttggaaataattcatgggcatatgggatattctcctgaggacacaataatggttccatttttcttgctaagttggaacaatttaatcttgagcaaatacctatgcttgtgcttctgtttttgtttatatctgtatacatctatagttttacaaataccaatattgacattttcattttagccagaaacttgcctaaaagtaagattacacgagctagtttgatttcagagtgcaaatggcagtaaaatgaaagcagaaaataaaaaattaaccatatgattattttgtaatccccagtgtgtttgttcaaggtgagatcattttccagattcatccttcacctgtaccaccttcctgatctgcaaggccatatcagggctggcatggttatttacagttatttagatgttctgtgaggcagataaacagaagacaggacacaagtagaactgtcaaaaaaaaaccccaaaatccatgaattccacaagcgactagaaggaacttgttgtggttttcatatctacatcgtttgaaagggcactccctctcctagagatcaggagctgtactgttagtgatggcaggggctgcactgatacacctgcctctgaatgaagagaaggttttgaggagcaagaaggagaacttatttctagagagaagaatggaaataagggctagagagacttagaaacaatcgcagatacacatccataccagagttacaagaacttacacaggatagcaagcaaactgatgcaatggttatgactgatttggtttggggtggcagaggatccatcccagcttctacctgcaaaagtaagtaggactaggtcaaaggtctaagaaacttaaaaaaaagtgtgtttaaactagctgaactaatacatccagtagataaagaattgcacataaggtatttgtataataattttttttgaattaatgaagttaaaaaatttggggagagagggctgggtagaagagagagaaactcgagaacttgggcctttaaaccctgcaagcataactggggccatttaactaaccaacgtcctagttgaacagagctcattttgagtacagaaacaatagtagcttggaaacttagttctacctaaccccatgaaaccctgtctgtctcctggtcagttgggaaagaacttgtgaggatttcagtaattaaaaaaataatccccttgaagaattagaatgtcactgttctctcgataacccccgtaagtccaagttaaggcaatagcagcctcctccttcaaaaaggtgaacaggaagcatggagttatacagcgggctgagaatcaagagactgaggttctagtcctatctgctattaattagttactaacctaaagcaagtctcttaaacttccagttctaagattctgtgatgtaactcatcgtgatttatatctggaggtccctccccctcactttagtgttagagattagggaggtgggtgtttagctgtgaggattagtgagtacactgaggactaacagtgaagttcctacatggtagaagctagaacagaataggggctattgctcttatctgccttgctttttttctggaaattattagaaagccatacagatatgtatgttaacgtaaacaacaaatccagaggtcgtcttagaattatttgctatcccttgtagctggagcttccttatccactaggaggcaccattgtcaaacaacattgattaggggtcaagagctcttgatcatttaagcaattggagaggaaaaatgtctagaaagaagaaaaaagaggtaaatataggaccctggaaattgtgaaaaatcaatctttgttatctagatggacattagaacagttctcagtttctaaaattcgataaacagtatttcagactacatatcaattttagaagtggcaaaatctttcaaggcagtctttttttcgaagaaacaaataagatatgaaaaaagaccttagaaattactgagccaaatcccatctttattgaggagtcatgatcaacccagaaaggttaagtgtcatgaccaagatctgccaggcttgagcctaaaaccgatgtgtagggggggcatttctcattgattttggccatcccaacacctgaactctcttcaagtatttggagaatccctcattttaagagccttgataggggaaaaaatcccatattctactataaaagctaaaaatggcagatatttgcactactaaacatttagacccacagaactaccacaggacacacttggcatcagattcacttagaaggatacaggacagggggaaagaaaaaacagctttttagtcaggcagcaccaggcattcctctgcagtacgagtcctttcagtagtatatacaataaagttcagtaaatataacagggaaaagaaagatttttaaatagtgttgagaaaacaagttaacagttcagaaatcaatttagattcacccttccccacacacatgcacatacaacaaaaatactacaaacaaaatagagttgatagaagctaatcaaatcataggaaagctagcaaaagataaaattatttaacagatctttagagagcttttaaaacttcaaagaactgggatccacaaagaaaaaaggtatcaatagatttaacaaaaattgaaaaaactagaaaattaatttgcttcaatcttgacataaaaggtttacattctatcgaacataaagagttcaccccaacgaaagggaagatattaagcttcatacacaaacaggcaaggacaggaatagacagcttccaccaaaagaactacaattggtaaagaggcatttgaggatatgctcagtcattttaatgtctttgacagtatatcagaattgctttattaaacagtgaatattccctttctccattgaaaaggtgaaggtttctatctacttgcatatcttaattaacaatcctgaataagcaccattcatattgaaaaaatatgattatatcctatttacagtatcagtgcaagaggaggccttagctccatttatagcacctcagacattcccaaccccaaacccacctactatgttgacacatttcctggtgctccaggccttattgttctttgtcggaacaaatgccttgaaatgctgctgtcctcttaactaccatgtagtcaccaccactcccccatgctctcacccttgcttcttgaggacctgtctcagaggctgactactccatgaagactttctttttttttcctttttttttttttttttgagatgaagtctcgctcttgtcacccaggctggagtgcaatggcatgatcttggctcattgcaacctctgcctcccaggttcaagcaattctactgcctcagcctcccgaatagctgggattacagatgcctgccaccacacctggctaacttttgtatttttagtagagacggggtttcaccacgttggccaggctggtctcgaactcctgacctcaggctatccgcccgcctgggcctcccaaagtgctgggattacaggtgtgagccactgcgcccagcccatgaagactttcttaatctctccttctgtaatgtaggctcttagaagatgggatcttcatgtaactggtccttctatcctctacaaatagtagatgtttaatgattgaatactgaatgaaacataatccccccacaaatacggagtagtttagatggggaaagggtgaaaaagattatgcgtacatgactcctttctttcagaaatgaattcgccaccaacaaatatttgtatatattcatcaatatgtgggatagtatgctgaagacaaaatacctgtttatgctctctatttgtctatagacaattgtacagaccagaaggcacctacccatgaaataaataatagtaactgccaggtgcagtggctcacgcctgtaatcccaacacttcgggaggttgaggtgggaggatcacttgagaccagcctgggcaatataacaagattccatctctacaaaaaaatttaaaacttagccagacatggtagcactacttgtgaggctgaggcaggagaatcacttgagcctgggacttcaaggttacagtgagctatgattgtaccactgcacttcagcctgggtgacagagcaagactgccattcattgacttataaataaatacatacgtacacacaaacaaacaacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaattagaaaaaaaacagaattaaagatttttttaaaaaagactgatttgtgtatgcaaggattacagcatttatcaacaaacttactaaatatagacaattcatttaaattatatcaataatatagtattcatatgtatcatctggaaagatggggacataggctctgtattttaaaaatccccctatatggttctggaacatggggcccccataataggcatgaaaatggatttcacatatggagcctttctttacattatgattttacctacttagttgtaatctcttgtcttccattaagtaactgaaagcctggagcagaagtgaggaagtttccctctttgtaacctgagcattttgtggaggataatgcatggactgtaagtcagcttgcctgagttagaatccaggctctaccccttacaagctgtgtgatctcttggtcaagttacttaacttttgctgtttctcagttttctcgtaagtaaaataggggaggtagtcataatacctatgtcgtagacttctcgtgtaaacattgaatgagttaatgcatataagggacttagaaaatacctttcacgtagtaagcactcaataaatgctagctttaattatttattacagcaaaataaggttacttctgtctttgaactgtatataaaataaaccaagcagtttaggtttggctacatctgcttcactcagtattttgtcttcaggattcagccatattcctttgtgtagctgtaattaatttcctttcattgctatatagtattctatacccattttatctattctactattgatggacattgggttgttcacagtttgtgaccattgtgaacaatgctgctataaacattcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtggacatggaggtgggggctaaattttgaaatcaagtacagcaaaaactccaagaggtgttattcttccagaatatcttgagtcttcttggccttctgcaattccatatacattttagattctgctttagagtttccacaaaacctgttgggattttcattcaaattctgttgaatctatgcttcaacttggaagacatcggctgtttacaatattgagtcttcttgtcagtgaacaggataattttctctccatttatttcatttgtttaatttctcttaaaaaaatcatacttttctccacagagatcttatatacctttcttttagatttatttctacattcttaaagaaacactcttttaaaatttcatataacttacaatgattttgctgaactctgcttagttctaattttaacttagattattttggatattctatatataccatctgtaattagtgactgtttcttccttttctattctcatacattttatttctttatcttgccttactgccctggctaggacctccagaataatattgagtttaaattgttagagtggactttcttggcttgttcctgatctaagagttttttaagttttttaatcacaaatacatagttttaagtgttttgacatttattgacctgaccacataatctttcatctttaatctatcagtgtacacaattatattaattccaaatgttaaaagttttgcattcctcgggtaaactcaatttggacctggtgtaattcttatatattgcctgtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaaaaaaaaaaaaaaaaaacttgtcagaaatggcatctaggcctagagttttctgtctcagaagattaaattactgattcagtttcttgaatcagtaaaggattattcaagttttctaattctttttgttaattttggtgagttttatttttctgagaatttgtcggtttcatatacatttttaaatttgtgacataaagtttcagtatcatcttttatttctgcagcatatgaaatgatatctccttcattgttaatactgggtgctatatgtgtcttttctcttttctttttgttatcagtcttgccagagattcatcatttcacagggaacaacttttagctttgttaatttcttgaatatgtttgtcttccatttcattaatttctgcttctatttcctttcatctaatttctttgaatttaatttgatgatctttatgtaacttatacaggtagatgtttagttcttaaatgtttagcccttctctttttttgagtcagggtctcactgtgttgtccaggctggagtgtagtggtgcagtcatggctcactgcagccttgaccttccaggctcaagcaatttggccgtctcagcctcctgagtagctgagacaacaggcccctccatgcccagctaatatttttattattattatttgaagagatgggggtctcactatattgcccaggctggtctcgaactcctgggctcaagtgatcctcccacctcagcctcccagagtgctgggattacaggtgtgaggcactgcacttggccagcctttcttttctaatatgtacatttatagcagtaaatttccctctaagtactgctttacctacattttacaagttttgatgtgtttactgttattattattcagtttaaaatattttctaatgatttattctgagatacatgtaataaaagtatattgtctagtttccaaatgttaggaattttctagatttattaattgctttaaaatttatttatttacttttttagagatgaggtcttgctccatagcccaggttggagtgcagtggtgccattatagctcactgcagcctcaaactcctggattcaatcaagccttccacctctgcctctggagtatctgggactacaggcatgtgctgccatgcccagctaatttttaaatttttagtagagaaggagtctcactgtgttgcccaggctgatatcgaactcctggcctcaaatgatcctctcaccttggcctcccaaagtgctgggattataggcatgagccattgcacctggcctttattaatcatttcagagaatctatttgttgctttgctttttctctattttgtctctttacttcattaatttctgcttattatttccttctaccttcattgggtttaatttgctgttttttaaaacatgtctcatgatgagatgtcactgacttggtaacttttcatattttctaatattttaagtcagcattcacaatatttctattaaatttctaattaaagttttaaaacaagtttatggatacaaactactttgtaagtaccatttcatctgcattctgctttttttttttaacagaactgatttcctatgacaaaagtatagtgcctattcatttttttaaaagtaaaggtaaaaagaagaaaacaaaaaatttcaaatagaattctacccagtctttaacaccccattttaatagcaaaggcttcacactgcatctacttatacataaatatgcatatatatgtttatacatgttaatgtattatgaacatctatgtcaataaatatatgtctataacatcatttaatggcaatataatattctactctagttaccacaatttatgtaaccattctgttgggaatttaggttgcttctaatttctccctattataaatagctgtgataaacccttgtcattaaaacttgaccagtattcctaattatttcccttggaaggaaataattgagccgaaggacatatacatgtttaaggtttttgtcacacattataaaattgcccttcagaaagttgtattggtgtattgttctatcaatagtagattacctactttaagcaaggtttctccagtgccaagttgtgtatgtaacatggatcaccagcttcttaacctgtaagattggacctatgcccctcctcctttcagccatttttctatatttgtgggtctattaatggcaaaaccctgatcttgaaatgtaacgtaccaatcctgtacaagttttgatagtactcttttcattatcattgttaggaatatgttctgctgggcatggtggctcatgcctgtaatcccagcattttgggaggccgaggcagaggggatcacttgaggccaggaactcaagaccagtctggccaacacagaaaaaccctatctctactaaaaatacagaaattagctggacgtgaggtgtgcgcctgtaatcccagctactcgggaggctgacgcagaagaataacttgaccctgggaggtggatgctgcagtgagccaagatcatgccattgcactccagcctgggcaacagagcaagaccctgtcttggaaaaaaaaaaaaagttctaattttcattatgatgatttcttatttgattaattggctatttagcatgatttctcaatttccaagcatttagggttttctagttattttgttaatttatttctaacataactactttgtggttaggaaacatactctgagtactcgtttcttgcagaagtttttagactgagcttttatctccatagtaagcattgaggtttttggggtgttttttttttgtgtttttttttttggtgggtggggatggggtcttgctctgttgcccaggctggagtgcactgacagagtcatggctcactgcaacctcaatctcctgggctcaagcgatcctcccacctcagcctcttgagtagctgggaccacaggtgtgtaccaccacacccagctaatttttttttattttttgtagagacagcatctcactcttttgcccaggctggtcttgaacttttgtgctcaagcaatctgcctgcctcagcctcccaaagtgctgggattacaggcctgagccaccaccatgcccaaccagcattgaggtttttctgtgctaccaacatgacataccagaatttattctgtaccccatttttcatagtgcagctctatggtcccagccaggagcaaagggtgtttcatcagagccttaacctcttagatcaccctggtgcaaaagcaactggaccctgtcattctccatctgaccaccccaccccctcctacctctctagagttcctaaaagtacccctcctttccaaaacccacattcttcccctagggcagaagcagctcttgttcacctctttgagttgtaatcctttctctgttctcaggactagtttttcactcactatactgttaattctcacaagctttaacaaaaactttttgtttgactgggcacaatggctcatacctgtaatcccagcactttaagatgagaggcccaagcaaaaggatcgtttgagcccgggaattccagaccagcctgggcaacatagccagatcctgtccctacaaaaattaaaaataaaaaaattagccaggtgtggtggtgcatgcctgtagtcacagctacttcagaggctgaggcgggaggatcacctgagcccaggcattccaggctgcagtgagccatgattgtgcccctgcagtccagctctaggtgacaaaacgagaccctgtctccatttaaaaaataaataaataattttaaacatttcatacagtttttgtagttggcgtttttgtcatcctcagaaaaaatgctggttggaaaaatccagatttgctctgtacaacagtgttcttcaaggatatttgcagataagtaccaatctgtcaccagtctgccatgagatacatacagaaattgacagtaaacatttagaaactgttacagcaatttgacattgctgtgaaatcatagcacgtgattttgtgccttcaactccagataatcctgttgccaaagcagcatattttggagtggcatattctgatctccctcaatgtgcagccagtaataccttgtgcctcaagacctgtgatctgttttgtttatttgatgagtttggttttggataatttcttaattatataaataatgcatgtttattataaattttaaaaattcagatggatgaaaaggagagacagctaagctcattcataatcccattacttttcacaattcagactaaactgcccttaatttctctctgcatacagtatagaagtccacctcccccatactcttccataggagggtttcttctccctctcctttcattccctcagaatggagccaactaggaaaattcacaatgtgttctttgggggttcttgacagccccagaagcaccccaagatgggaagccaaagagaagagcaataaaagatgccttgtcagtttgtagaatcattatattatcaaataaagtttatcaaagaattgagtcatcaactttgttcaaaaggttcaaggttaggatatcaggatggtatgtattatgaatatgtgtattttaaatttcgttgaataaaatttgcataaataacagtatttttagtttttatttctatatctcatgaaatttaaaattagtagattgcttcttttactttaatatcaattaatattataaataatcaaatagctttaataatagaaaaatattttcacagtgatgcctctctttcagagtaacccttcaaagaatgtgcctgtatatttactaagttgcacaggtggttttgtttgatatctgtggttatgaagcattgaattaaaaaaaaacatataatggctgaaagatcccatttacaatagcaactaaaatataacatgtacagggaaaaagcctaataataaatactttaaaccaatataaagaaaatcgtaaaactataacttagagacatgaaaggaagtggagagacatatcatgttcattgatgagaatattagaaaatgttaatttctagaagttaacctatacatttaccatctgaatcaaaatacaaagattttttatagtttgacaaaatgattttaaaagtcaactgggaagaaaaaaatcataagaaaatgttggtgaaggccagttgtggtggcttgtgcctgtaatcccagcactttgggaggccgaggtgagcagatcacttgaggtcaggagttcgagaccagcctggccaagacggtgaaatcctgtctctacaaaaaaatacaaaaattagctgggcatggtggcaagcacgtgtagtcccagctacttgagaggctgaggcaggagactcacttgaacctgggaagcagaggttgcagtgagctgagatggcgccactgcactccagcctgggtgacagagcaagactctgtctaaaaaaaaaaaaaaaaaaaaaaaaaaaattggtgaagaataatgagatttttttttgccaaatattaaaagctgctactacagtattttattttgtctgtccatgtttttgtttttgttttgagatggagtctcgctctgtcaactggagtgcagtggtgcaatctcagctcactgcaacctctgcttcccgggttcaggtgattctcctgcctcagccttcagagtagctaggactacaggcgcaggccaccatgcctggctaatttttttgtatttttttagtagagacagggtttcaccatgttggccaggctggtcgcgaactcctggcctcaagctatccgcccgcctcggcctcccaaagcgctgagattacaggtgtgagccactgtgtccggccctacagtattttaaatggtaacttgatgcaagaataggcaagtcagtggaagaaagtagaaacctaaaaatacccccatgtgtgtatgcacatgtgtagagattgtcatttcaagtaccagtatttcagatatgaccagacaaaatggattgatccttgctgataattatagcacagggcagtaaataatttccaagtatttctcacggactggttccctccttagtctttatacttctcaccactttgctgcctcctccccaggctccgtcttttccctcatcccttctgggtccctccagaaagtcctctagctctcagaacatctcccaaattctttttggaaacaccagagtccattgaggcattttatttgtaagtatatattacatccctagaaaaagaattccaggattttccctcctatatgttttcatcttgcttcttcatggtccataatgccagctgaggtcgttagtacagtgaatccaaactggtgggataggaacaggttattctgccattttactagatctttgggttgcacatcaaatctgggatctggggctgatcactccacacttgtttaacctacctcaggttcacaacaattttcccagctctatgatcatcagtgatttcaaattcaccaatgtaaccatgcttcatcatcacagttagaaactggacagtaactttggagcacaacctaataagaacctggtgtttgcctctttttggtattgttgatgctctggatagcatcagccaggacattcatgcacaccattatggcagcatggagagatggcagaaagagcctaaattcttattgcttcattatgcaatcagtttagctctctccttttcctaacccctctctcatctaagttgaatcgtgcttaccctcatatatcacaattacaaaggaaaacgcctaagcaaaactgattccttcgctatgagatgttttttagtcctcatagatcaactaaccagcttaaactacagccagtttttaaaatagcgtttcttttctccccacaggacaaagaaatgaaaaatatttactctctgtagtaatcaaggaaatgcaaattaaagcaatcatgaatgacttttttcctcttatctaattggcaaagatggaaaaaaaataatcattatcctagtagagcaagggacacattcacacatggtagtgggagtataaattgttaaactgtttctggtcttgtgtatgtatcaaaagtgttattgtaggccgggcgcagtggctcatgcctgtaatcccagcactttgggaggccaaggcgggcggatcacgaggtcaggagatcgagactatcctggctaacacggtgaaaccccgtctctactaaaacaaatacaaaaaattagccgggcgtggtggcgggcgcctgtagtgccagctacttgggaggctggggcaggagaatggcatgaacccaggaggcggagctcgcagtgagccgagatgcaccactgcactccagcctgggcgacagagcaagactccgtctcaaaaaaaaaatgctattgtatataccccttgtcctagcaactcagcttgtaggaattttaccatacagataatcagagttgctcaccaagatgcatgatcacgttcatccaggctttatttctgatggtggaaaatgagtgctgccatactagggagtagactagaccattataataatgtttatagtagactaggcaactataaacattattttggagaagaatcctatttgacattggaaaatgttccttaggtgtgaaatggaaacttggtaaagtttttagagcctgtataaatgtgaaagtattttcattcatttatataaaaccacaccgagaatcaaataatagaatcaactgttcattaggtgtctacagtgtgtcttctgctgagtattaggtaggggtacattgaaagtataaatatattttttcttgttctttaggactttacactatcatggaactgttgtagggcttaaagatgtgcatttgttccttgcacacccagtaggtatagctataatcaatgggaagagcacaggacatagctagacagagatttcgatcttgtccctatcacatacttgtccactcacttagacaaattatttgaaaatgatgctgacctcatggggtggttataagtatgaagggaggcataacaaggactgcttcctatgatgcctcatgaataggaagtatgttagttcctttactttcccttccagaagtttctatttcctcagtataatatctgcagcaggtatattgggaaactgaactactgaatgaatgaatgaatgaatgagatactggatttaaaaatatgttataagccttaaagcattatgaaaatgttagctgttaatatttgcatagtttcattaatatgtataatatggcaaaattcatgtatacatatataggtgtatgtggggggagggggaggtgtttgtatgtgctaaatgttatggaccatatagagttgttatagaatgaaaagcaaaggaaggcattaatatggctggtaatcattgagggggcttccagggaaggtaggattggaatgaaaccttgaattaaggtaggttttgaaaatgaaaagcaatatatacaaaagtaaaaaagaaaatggtgtactcagggagtgataataagaccattctgcctagagaggaagattttcttgaaacatcagtggacaaggtaggtagaagaggcaaggtgtggccaagacaacaagaggccttacttatctagtaagaaatagaaaactactgtaagttctaagacaatatcgtgacattgcgttaccaacacatctatgtgttacaatatgtttgtagcgatgaactttgggaatggcagtgtaaacaaaaataaattttattttatatatgtcattgttttttccttccacagtatatagcctgaattttccatttagtggtaataacaatagcaagattgttttttaaatccttgtattctacataactgaatatttttggaatttgacttaaaaatatgcacacaaccctagcattgctgttttctgatgcttctttttgtgaaaacctaaagaaaaattatagtcaattttatatactcaatgttatttgatattactgttagcctactcttcctgtttctttccctgcagattttcaatgtgaagatgactgtcatgccctttataatttatgtctatatttcattgaaagaaaggagatttaaataacataacccttagcagtaaatcaactaataacttagttacaatgtattcactttcagtgttgtcttcctggaatttcctcttttcttatgttctttttcacatttttttacagtatggatggagcagatctgtgttttgaaatcgtaaagcgagctgacgctggttttgtgtacagtgaagctgtagccaggtatgtattgtatatctaatcaccagaggtcaagttgaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggtcaggagatcgagatcatcctggccaacatggtgaaactccttctctactaaaaatacaaaaattagctgggcgtggtggcatgcacctgtagtcccagctactcggaaggctgacgcaggagaatcgtttgaacccaggaggtggaggttgcagtgagccgagattgcgctattgcactccagcttgggcaacaagagcgaaactcagtctcaaaataaataaataaataaaatgaaaacgtgggtttataatacaggcttacattttcagtactgctgtctttcccatttctgatgatttttgtacaggaagcggggatctaatagctcaggaaccatgtagaattctacttgggtttttttatttttgttttggcaaatctgcctcattagttcttcattttgccttttagtgatatcaaattatctcacaataattaaggaaaagtaaagaacagtaaaaggaagagaaataaaagcaccatttttaaaaatatatttgcttcaggccagtgtgagacctaccaatcaaatggcagctgttgttctaagtggagaagttgtttgtaaagacctaatgactcaaaataagaaggaaatatgggccgggcgcggtggctcatgcctgtaatcccagcactttgggaggccgaggcgggtagatcacgaggtcaggagatggagaccatcctggctaacacagtgaaaccccgtctctactaaaaatacaaaaattagccgggcgtggtggcgggagcctgtagtcccagctactcgggaggctgaggcaggagaatggcatgaacccgggaggcggagcttgcattgagcagagatcgtgccattgcactccagcctgggcgacagagcgagactccgtctcaaaaaaaaaaaaaaaagaagtaaatatgaaaaatcacaggagccatgcacgtgctgggccacttgcttatacatttagagcaacacagctttctgttttggttacattcaatcataattacccactcctgtaggttgcctttttaatacatggaatacagcatccctccttagtcaccagccatagtatgttgaagggttcaaactcacaaacatattaagtttttttttttttgcggggggtgcgggcggcgggggacggagtctcactgtgtcatccaggctggagtgcagtggcactatctcagctttctgcaacctctgcctcccaggttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattgatttttaaagccacctgtataagctgttaaaatggtgaaaggaactttccagagtggaccagaaaagagtagcattgggaccagtagatgacattgcaaagagagaggtttggaggcagtttattaaaggttcttcctctgaacaataaaaaaaagtaggcggggactcagaaagtattattatgtgtgtttgctattgcagaggatcaatgaccatgcaacaagggcgcgtagattcttccattggtttaatgacagatgacttctaatctttcttcgtcctctctgattctgtgatttattgttaggaaattcagcttgtatcagtattctagtgagaccgactgcaagaagactctgagacaccaagtaatcaaattgataatgttgtttttctccaactggctgagcttcaagaggagcagcaaagcatggcataaaataaaactgtgttcagtccttagtgcaacccaattagttattacctccatcctttcaggggtgatgagttgtggagtgagctaacacacaagatcagattatcaaatcaaactctcagagatcttcttaactagtaccaagctttactaaataatctcaaggatacaggcagtcagaaggctcaagtgaagcagagaagggaagggcagccccccacgtcacttcttactgcctcagaaatgcacctctggcccagaatagatgaggtttatactggggtttgtgggtttccacacacaaaggggagcattgcaaatatcttcattttacaccccagagatttggatagctccattgacattctccaggaagccatctgtgcctcagagatcccgtgttctacttaccatagtaatccttagccagagatatcctattaagggcatttcagagataaggtctcttctgcctagcaaatagcattaggcttttcacctgcattgacaagaatagcagactgaatcacctctcttctaccatgctgcacccctgaaatgcctccttccaaaggcagtaaatgcattgctggccagctttttccttccatggagttattatcttgctgatccttaggaaagataaagataaacaaatatattgctgagtttctctgaaagcacaggtctctatgatgcttcatgaagtgaagttttttgattaaaagtttagtcagcaacttcctagaacatgtgggcagattttagttcttgttttattctgcttgcacactttgacatgcattgcctcgcaggatcatgactgggagggtggagaaagatagttcagttctgttataacttgggaagaaaaacagttccactgtctccacacacgccgcaaagattctgctgtgtacatacgtttgggtcaagtaattgagtgttctcatatgcaaatgaaaaaagcctcattcattgagtttggttttgtgttatgagactttgagataggaattttctttaggttaaagataatttaggtggctgtctcagtgctttgtatccaaaatagttcattctgtgggtacaagctatgtccactttaactaatttaaatttacccagtatttccatgttgacatctagatggacaaataagctgttcctaaatctttgattgaacttaacaataataatattgtactaataatgtcttaacctttgtagcatggtttagagtttacaaagcactttgacaggtgtagtctcttagccatttcaaggggttacagatcttccaaagcctgatttgaaccagtaatgggccacaacaccaagttaacccctcatttgaacaaaacttatggccaggcgtggtggctcatgcctgtaatcccagcactttgggaggctgaggcaggctgatcacttgaggtcaggagtttgagaccatcctggccaacatggtgaaaccctgtctctactcaaaatacaaaaactagccaggcgtggtggcgcatatctgtaatcccagctacttgggaggctgaggcgggaaaatcgcttgaacccaggaggcagaggttgcagtgagccgagatcccaccattgcactccagcctgggagacaagagggaaactccatctcaaaaaataaaaataaaaaataaacaaaacttaattacaggctacaatggcccaagcaaagagtatatgagcacaaccccttatatgtgcatttgcaaagtaagataaattaaaacatcagagctaatgattacatgagcctagctctctggcttaaagccccgttgtaaggagcctgtgattagtacaggaacaaggcttgtgattagtacaggaacaaggcttgggtttgtttttgtttttgttttttctcctacctttcatttttaaaatggaacctttccaattaattgtaatacatgaaataatgcatatgctaactagagaaatattcctgtgagcttgattaaatggtatcatgccaaagagggaacttgatggaaatgtcttttaattgtaaagccaggatagggattttttttttttttttagtcctgagtcacatacacatgttcaaggtcacttgtatcagaaatataagatctggaaacaaaacaaaattctataaatattatacagtgaacagtgttaagtctattgcatttctgtcatgctggttgggaaggaaaagggaaaaaatgagaaaagaaggggaataggaagaaaagagacaaatatggagggaataaaatacagaaaatgaaacagatactcagagaaagagtaatagggcaattatagaagaactttagaaataggagaaggaggttctaaagtggtactgaatcaactgctcttgtcacacatggttgctagttaaccccattaccattttttaattcctgttctttaaaatgctgatttcttctttgttcttcacctgtgctccatgagggctcctcagctggccatgtaaggagtcaggctttctaggacatgtgcctagaattaactccactttgttcaagggagccccaactaaaacttgattatgttacaaaaagaaattgtccgataagggtggctcttccctcatttgtcctcacagctaaatagaagtaagatgaagagcatcttattatttgctggcagatcaaaggctcccactgcttgagtctgaatccttggggcagccctgagcactgtttacataacgcagtccagtttaagtagaattacctgagtattggggaaaaaaattgtcatgttttaagcttgaatttttagtttgcaaagcaaatttacttatgaactatgtgtaattcttttgacttagatagcttagaaaatatagagcatactatttcttcatgaagcccataaacttttgagtctgccaacattttcattattaagcctcactttacaccaatcctgtctgctcaaatcaaatgtgtccatggacagctaatatgagagtgggagttataaactaggagcactgtatattaagttttaaaataaaaattgtttacagtttttagatttcttttgttttttacagccattatatgagacagatactggaagctctacgctactgccatgataataacataattcacagggatgtgaaggtaagtcatttgttatcactaactttaatgtttgtgaagaaatactgatataacaatgataatcaagaattcttctttaatattgtcataaagaacatcttaattttacttctaagtaaaaatgtatttaactgctttgtatttgggaagtcattgtactaattcttactaggaacactataatttcaatttatttatttttactgaagtgttcatgcaatctaaaattgtattatttctcttttgccattgtgtgtgagagagaaatgaaaaatccaataaataggaaaaaccaaacaatatcctatactgagttaattgggggggaaattagaatttggtttatatagtaaaagttaatcataacatattttcataatattgcaatgcagaatagtcagcattgtatttttttgcagatagtttttaaatatagtatgaaatcataattatacatgtaatacgattttatgcttggaataccggtattatcattattcagtctttctgcctatttcatcccagtatcgggttaatgagaactctcagttcctggttctttaacggtgtcaagccaaacatagagggaggcaagaaatgagaccagtaggccttcctcctgatccctagcttctcccaaggcccagaatcactagggagcccctgaggtccctttgaccctgggctacacttttaagctctgatattttgtcactggcctttctctaacctccagcatgcacatacatagtgttccttccctcaagatatattattaaaggcctggcttcttcgatgtatttaatactttaaatgattaagaaaattaagtagagtttaattaaagtgtctataatgtttgggaaattttcacagaaatccttgtagttaaaagctgagggaaaacatgagcaattccaaaaccatctagtaaaatattttaatagcaaatgaaaatcactggagaaatatacaaaatacacattagtgtaaattagttgtaaaatatctcactcatccttttcagatgtgttaagaaaatgatattgttattatcagaactcaacaccgagcatctcaatgggtccccctttatgaaaaagtattctggccaagcccggtggctcatgcctataatcccagcactttgggaggccaaggcgggtggatcacctgaggtcaggagttcaagaccagcctggccaacatggtgaaaccccatctctactaaaaatacaaaaattagctgggcatggtggcacatgcctgtagtcccagctacttgggaggctgaggcaggagaatcgcttgaacccaggaggcacaggttgcagtgagccgagattgtgccactgcactccagcctgggcgacagagcgagactccgtctcaaaaaagtattcttcagttatccaaaaagaaataaaagtgtggaaaggtaaaaggcgggaaattgtcaactgtagtagtttgctgtgcagttattttgcattaattaatgtaagaaagttcatatgtagagagtaaaatatatctctttgtatatattctaaactatatacaagaaaaaaatgataatttaaaaacctaaaatgtgttcatgtaatagcattatgttaagaactgttttgctcaagaggcaattttattttgaatgaattattctcgaaagataattatatcaacatcatataataaacaatgattgacaatatattctactgtaatactttcaataatgtagtcagcttttgattaactggtatttgatatgacaacctaaacctaattaatatccaaaagtagataatttgacctcaccttttaatttaccttctgatttatttatttaacaaatatttgagtgcctactttatacagattactgtgcttggagccctaaaagtattatggtctcagtagggagataaggctcggtatctcttatctactgtagcagatcaacacatgccaaaacatagtgacttcaatcaataactgctgcttacttgctcacaattctgcagtttgggcagagcttgataggactgctcaattctgtttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttagggctccaaaagagcaaaaatggaaggtgctaggcctcctgaagcaaactgacactgtgtcacatcttatgcatttcattagttgaaacatacttcacaaaaaggtcacaaggctagtctgagttcaaggggaagaaacatagattcatattttgattgatggagtgccagatatatacaaggatgggagaacttgttcgtggccacctttagaaagacaaataattattgtgcaaggtagaaggtgataagtatcattaaaagatgaggtcagagaagtttcctgggggaggtcacattggagcttgttcttgaatcatggggtagttatatggagacaaaaagacatttcaggcagaaggaacagtttgtgcaaaggcccaaaagtagtcttacgttggagtatgttagattagtttattatttctaaagtacatgctaaatagtttagaggaagcacgtagaaacatgccaaggaatgaaaaagaagtaattctcaaactgcaaataagtaagaagaaaccaccccaaaaattgccattgttcagttgggagacacactcaacacagagcacacgttaatgttgatattctttttttgtttgttttttgtttgtttgtttgttttgttttgtttgttttttgatacagggtctcgccctgtcacccaggctggagtgcagtggcgcaatctcggctcactgcaacctctgcctcctgggctcaagcaatcctcatgcctcagcctccagagtagctgggactataggcgtgcgccaccacacctggctaaattttttttgtagttttttgtagagacgaggtttcaccctgttgcccaggctgctcttgaactcctgggcttaagcaatcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattctcattctctctctctctctcataattcttggcatatgatccaaaagcattacatttcccaaggatcctgttattatatttattaatacttttttctttacttttttacaaaaggtatttccttttgtaatcattgtaactgagtcttaaaaggattatttggttagatttgaatatatggtaccatgtaatctatttttgggaactgcttgctctgaagaagcagtttcacataaaactgcataaaaagcaatcatataatcctttgaaattcgagagatgtgtgaacatagtgctgggcctccccacagccacacttagtgacatatcaggctatattctttgctgtgggaggctgtcctgggaattgtaggatgctgctaagcatccttcacccactagatgccagtagcatctccccctagttgtgacaaccaaaaatgtctccaaacattgctaaatgtcccctggggcacaaaaattgtccctggttaaggcccactgtcataatagactgttataattctcaagatttgcctccctacaggtattaattaaggcatgcatataaatttctatttttttctgtcatcttcttccctttaattctactttttcttgtgaaagaatgtgaaaactttcattatgtttctggtatttttttttcttcctctcacccctaaattaaaagtactttagaaagaaatagcacagttgtcaaggtaaatgcaactcctggctctttgccttctttcatgggctctactaagcactgagagtttgtggaattttctcctctctcctaactcttgcaggcagccttagatcatgaggttgtggggagacttagttttagacctttctgtcactctgacctactcatgtataattctaataactgaagttgaagtgaaacagtttctctgagaatgcaaattgctacccacaatcactttctattctgaatggtgcctgtgcccagaaggtctgggtgctgtttttagttcttagaactgtgcaaaccccagtcacacacacactcagccagaggccagagtgtttctgagtgtgcttcctttaaatggttttccttgctaacctgtgtgaacacgcctggctgctttttggttcccttctggtctcagttctccttttacctatttaaggccagactttatgataaatttgtgtttatcatataacactggttggcatgacattgtggatttcttaaagcattccgtagtctcttgttctccgttactgatgtttcttttacacctgataccacaactccccaaagtttatcatgttgtatagagaaatttaaattctcataaaacaaaaacgtatttattctttatttattttatttatttatttattttttttgagacagagtctcactctgtcgcccaggctggagtgcagtggcgccatctcagctcactgcaagctcaacctcccaggtccacgccattctcctgcctcagcctcccgagtagctgggactacaggtgcccgccaccatgcccggctaatttttttgtatttttagtagagacggggtttcactgtgttagccaggatggtttcgatctcctgacctcatgatctgcccgcctcagcctcccaaagtgctgggattacaggcgtgagccaccgtgcccagccactattctttattattatattaacattggttaatcttctgcatttcttttataagattttttaacataatgtgcacgttcagttttaatgtggcattttaataattgtacttaggaagatctcatggattacatgattattataaatttatcttgtgtttctaactgctatacttctctttgcccagcctactcctacaaaaaaagaaatcaactccttggttttaagtttctcagcctgagcaacatagtaagaccctatctctctctctccttttttttttttttttttgagatggaatctcgctctgttgcccaggttggagtgcagtggcacggtctcagctcactgcaacctccacctcccacgttcaagcaattctcctgcctcagcctcctgagtagctgagattacaggcgcctgccactacgctcagctaattttttttatatatatattttttagtagagacagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtgatccccccacttcagccccctgaagtgctgggattacaggcatgagccactgtacctgactggaagttgtatttttttaaaactcctaagtccagtgagattattacatgcagtatagcttatgttaaacaaacattactgtcttagtcggatgagttttggtctcaaaactcatgtaagaataaaactacttagtctgggcacaatggcttgcccctgtaatcccaacactttgggaggccaagatgggcagattatttgagctcaggaattcgagaccaacctgggtaacatggcgaaaccccgtctctacaaaaaaataacaaaaattagccgggcatgatggtgggcacctgtggtcccagctattcagaaggctgaggtaggagaatcacttgaccccgggggggtggaggttgcagtgagccagatcacgccactgcactccagcttgggtgacagagtgagaccccatctcataaaaagaataaaactacttttgtaactgtggagaaatctgtgcatctcaggaactctccctgatggactttgagttactctatgatttacatgtctagaaatcactagattggacacttccatttacagctagcattcagggcggtcacctcaagttcccaaatctcctttgtctctgcacattaatgagccaaaaatccaattactactataaacgaattgatactcactgtaaatatttgaagccagaatgtgttcagacttttctcagaacattttcatgtctcagttaagcatcaaagtagaaaaggaaaaaaaaatttactgggtttttgtgtgtgtgtgtgtgtggttttttgtttgtttgttttgcccccggaataacctctggtgatttttgaacacatggctcttgggcaatgtactgtgaattgcttttacagctctaactcaggaacaaaacatgctatgagattaaagccttggaaggattacgtgaacttactttaaacttcattttggacactgaagtaattactatgtgaagaaaaaaaggagtctttaagcagtctctaacaaagtggcaagttactattaatggttgattttattcagctgtttttgtttggttatctgagaagagaatatcagtaccatggaagtagaaatagacaagaagtttatagctccaaagtgcttatgatctctttgggcagatagtacacgcttttttttttaatcataatatatgtacttattacagaatatagtcaccatcatttgtctactgacaagattacatgaaagaaaagaaattaacattaagaaatgcttatctttaaatgttcacttaaatattagaaaaaattggggtgatttacttaactatgcacatatacatacatacatacatatatatatatatatatatatatatttttttttttttttttttttttttttttttttgagacagagtctcactctgtcgcccaggctggagtgcaatggcatgatcttggctcactgcaacctccgcctcctgagttcaagtgattctcctgcctcagcctcccgagttcaagtgattcttctgcctcagcctcccaagtagctgggactacaggcacacaccaccacgcccagctaatttttgtatttttagtagaggtgggtttcgccatgttggccaggctagtctcgaactcctgacctcaggtgatctgcccacctcggcctcccagagtgctgggattacaggcatgagccaccgcacccagcccacttcaatattttcatcagtaaattagtatactttagagttgtggtgattaaaataatatatgtaaagcatataagtagaatgcttggcaaacagcaagtgcttactaagcgttagctactcataatagtaacagctgatttaataataggatctgtaaataagatagtattttctgctctacaaatgaagaaattaacacgtacagaggataagttaatttgcctaagattgtccagctaaataaaaagtagagccagattgaacccaagaagtataacttcagagatcaatctcttaactgcaatactattacactcccttattattcattcatttatttcacaaaaaattaactgccaggtactgtttgtcactaataacattatttatattgaatacagaagaaaatatgcacaatgtgatgaagatgggcatataatgacatagctttttactttgacaaagcctaatccaaatatttaagcatttttataagtatcatctgctttaaaaatatagtcaatgaatattgcttctccccaataacatgagccagataatttcaaataaataatatgtttataaaaccttggatttttttcactgtattattcatgcatttaggtaagatgtgaatgaggatatttcttatttatttttttacttatttttatttttttgttttgttttatgagacagagtctcgctctgcctcccaggctgtagtgcagtggcacgatctccgctcactgcaacctccgtcccgggctcaagcgattctcctgcctcagcctcccgagtagctgggattacaggcgcccaccaccatgtccagctgatttttgtatttttagtagagacagggtttcaccatgttgcccaggctggtcttgaactcctgacctcaaaatgatccacccacctcagcctcccaaagtgctgggattacaggcgtaagccactgtgcccagctacttatttttaaagattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccattggaaacctttcaggaaatagatactcatgaaaggcatggcactgcacacaagtaagtttgcagtcacaaggtgtgacaggtagatgtgcgttgatgtttttttacctatttttgttaaaaatatccattgagagagagtgtttccaaaaacaccaacaatacaaaggaggatgtaaatgattggtaaagccatggaagagatcatagatggttgaatacatgttgtattgttgttcatttatgtcaggttttcttgaattttgtcacaggagctagaatagaattgcagatatttaatattaaaattatttttggtacagtatttaagctgaatagtttttaaaaaagaaaaacattgaattaaataaaatagtaacaaaaatgtattggatggaacgggaaagtatagatggcttcttaccttttctaatcacgattgtccggttgaaataaagacaaaaagttacttattgtgatggataatgcctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaacataaatgctggtttttacttttttctgtcttatatttaaatctttctcgcttcaaagggtacacatgaagtgctgaagaatcatatacaaactgcttttattcttatttttctccttatttcctcacttctttcaggtgagaataacaaaagttactggattctggtcaaataagaaccatgatctctattcagaatgtgccatattctctgtgttcttcaccatagccttctgagcaccacattctccactctttcatgatctagagcaaggtttctcaatcttctttttaatcatgttctcttttgataaacataaaaactgtaccatacacaaccctttgaaattcttatatccccccagcccctcagggcaattttactctctacccccttcagaattatggtttgatttattttctgcatcttggattacagaaattggggttttttttcaaatatgatattataattttataataactttttaaaccaatccacacccaaagtcttgaaaacttgaggactgtgcagtgtctgtgggtttaaataacaagattcttaattaatgtttaccactgtctttataattttatttctttgctatttttatttagaaaacagtccatatgcttcattgtaagtttgtatctgaatctagtgcaacctgatgaattataatctggtttcagttagtgtagaccctggtataaatatataaaacctaatctgtaacttcaccagttcaaaaatcagtcagacagtgaaatgagccagtttatttaagaaaaaattatctgctcacagtaggttttgattttacataaggattggagcttccttttatgatgctgttaaagaaaagcagtagctcctaccttgtgcagataatgcatagtatactaaaaactgcaaaggtaatggtgcttctgtatgaatattaaatgcttccaaacaaaagggacatagacttctgcagaggctagctttatcagacagaagttgagtctctgtaggactctcagtgtagcagtcaacaactaggtcaccatctttaccttcccaaacttgtatctactatgtacatctccttcaaaaataaacttggatcataaaactactagataactattttccagaatttggaaagtactattaagaaatcaaataaaaattacatgttacagatgcaaaactggtctccagaaaatgtctctaagtctatattcccctcaggagaatgtctatctcaagtcactcatgcatacattttgtctctgctaatttgacaaatgaaaaaagttctacaactcttaacttcagttactaatgactgtctacatagttaatatgctgactgcctttcttaatgatcagctttcaaaatttaaaccattaggtcctgtttatttttatagagtttaatttttaagctaaaaatgaataataatcactcttacctgtatgagtagtttatgccaactaaggttatattgttcagggcagtgatgccaaatttcagacttaaaattctctgatcttcactcttccaatatctttagtcagtgtgaatagattcttgcatgacaccaactacagtgggaggaaaaggggaaattaaacagaatattgaagaaattcaatagttatggtcaatgtggcaactgcctcctcaaaaaaccctcatttctctatttctgtagtgggaggaagtggtgaacaatatacatattatacttccttatgattatttcatgaactagttacactccagtaacctttgtttgcacgattgactgaagttaagttcacaggtttaatcccccatggccagttttatatgacacagtgatagaaggagccactctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattgaaagatagttgtaatattatctgttcaggcataagcgtctttggtccgaaaaaagaacgctcttgttttcctccattgtctccaaactcagtaaatgataccatcactccttcagttattcaagccaaaaacttacgaatcatccttaattcctctttctttcacatctcacatctaatcaattgctggtactacagcttctactatcactaccatcattcattagccacatttcatgagagcttactatgtgccagatatctcgctatgtgccttacatccaagtcttatttggttttcacaacaccctgtgaaatgtctcattttaaaggtgaggaaaactgaaactcagaaagatctcataagttgcccaaggtcacacagccatctgtcctcacaggatggtgattggctcacctcaaagcaactaattcaagaacaagtccatagctgcaatgcctttttgtgatctagcctctgaagtcaacagtgtcacttctgcagtattctattggtcacacagagccagccctgcatcagtgtgggacgggtaaatatcaggaggtgatgatcactgggagccatcttggaaactggctatcacagatgtcaatcaaccgttgaaacaaaggaagagtcagaagtactgcttaaaaaccgttgtcagtccactggttgtttattggacaagcatacctggataggtgtaagttttgccagttcttacactattttggtttttaggtctatttttgttaaacagtgtaattcattcaacaaatacttattggagtttctactatgttcctagcagcatgtggaggtcacagaagtaggatgtttagtcacaagctaattgagggtctctggaaattgagcagattccacaagcaagccaagaatttagattaatatgtgatacagatttcaaatgctctgtgaattagagaagggcagaaacagtgactcaaagtggttctgaaaggctttgtgaaagcaaatggaaggaaagagaggagaacataacctagtaagtgacagttttgtgccaggtatgggacagagcattttatgactaagaaccctagagatgtgtggtgggagtcccattttacacgggaggaaattgaggctcaaagaggttaaatagcttgcctagaggaatacaattagtaaattagctttaaaatgacctcattctctgccttagaaagaaattattggttgttctagcaggtcaataagggtaccttatggtactcacaatagggtcatgttttaagtatttttaactttgttcagatagggtttcctgttctgatttatgtatttgtgtatcctgttctagacttgaggtagcagaaactgaccatggaagaaatcaagtccagtttttttctgtctttgaaaactctggactttgttaagcaaactattattccaacaatggcagtataaattctttaggattcagtgattttgagttccccaattgaaatatatgtaaattttattttcattcttctaagaaattaggaaatattgttacaattggtaaaaagagtaaatgtcagggaatactagattaataaagtatgttacaagtattctgtaaaagtggcccctttggacttttctcattcaaatcaccaatagttttctttggttctcattcatcttgcccatccgtctcttcaaggttccccttctattgtccaagtccaaatgctcttggcctaacagttctagttgattcctgtatcatctgccaaatattgatctcctaagtgttctgctgtcacccttaggatttacttccttgaggtgttagagttatgtcctacaattgaagttctgtcttgtattaattttcctgcttttgagatggatttgtgtatcaagtgtgttttttaatctggccccaaaattcatctggagtggttcagtgagagtgtttcaaagggcaggcatatacttacctggcagaggagataccatcatcaaagggcaggcatgtggacatttattttggcaatccatggtgggctatacatagcaaggggacatgagagctttcctgactcacatggattgttggggttagaattagggtcccttatcaatttccctcagagccagaacccagaggacacaggacagcttagtcattcctgaagccatgtgcttcatctagaaattattttaggctatccaaactagtgtttaaactggctgcaactggcctcttaagtactctcactaaccaatcaggagctcagggcattgggaggctggtatgcagaaagagaagacatgactaatttagtacacattagaatatcatattcaaaagataattatttctttaaatcaggggcagtggtaagtaagccttgtccagttcaacatacacccaagccagtggttatctttaggaggagtgagacacagtgcagttactcaaagctatggtttgttcaaggctcactgagccccctgccctctccaggaagtggtgtctggccacagccttgtttccagtcacactgttctcaggccctcaccgcctgccacaagcagctctgatcgtgggtgtcccacccttaatcagagtgtgaagaaaaacctctccttgttctgaagagctggtttctcagcaagcaatgggagcgtttctctcaagaattacttttaaaaacagcagaaaatacagtctgaagtttgtaaatttataataacacagaaaagttatcagcttttgtaaaaagtaaagcagaggttcctcttcgaagactttcctccccatttaattaggaataaatagtaacttctcttagaagtgaaatttattcaaagacctgtgctaacattcttaaatatctgctagccgtgataaagaaatcaatgtactttatgttcttagctcccacaatttagcctaaatatttgccctggcatgcttatactggtgcaagcaagcattgggtcatagcctgttcctcttccttatttgcaggtttttacttttctcagcattccacaagttacttcctccttcttttgttctcctctgcctttgccttttttaagaagttctaagttgctagccaatcgggacagatacagaatgcgaggtcccgttccagccaatggaaaccggacacagcagtagggtggacacgtcagcttataaatgaccctgtctcctttgttcagtgtactcttgtggcaaaactgctggcgagtgtaccctttctgcaggaagtaaaaatggccttgctgagtaaattaaatttatgttcaagtggtatttctttatggtaccggggaacaagcatttcaaacgcttttaagaaaagactaatgacaaaacagaaatggacttggtgagttgaaaaacacatacacaaactcaaagggcattttcttattagtttgcatttccttgtgcatccagtgaaccaactccccaggagttggatccatctctaaattccgctagtaacttcaccttcagtaaccgattgcagcacagctgctgctccaaactgtgggtgaccacccaggaattaaaggttcctcatctcccaaccctttcatcctttgtcttaccaaaccacatgtttccatgaacctgaaccagggccattccagcaaaccccacttcattgacactgagaaagagtagagacaggcttggcttcagctcacctccactagagcactcccactgatcacaaaacccacaccactacctcaaatgctaatagttcttaaagaattccaggaattggccttatgagataactaagattgcctcaggaaggaatgctgaacaattgatttacagccttgttgccacaggccacgccaccaggtggcccattactcaagataaccatagcaaccagatctgctgacctgctttgctcagcccagcctgcatacccttcccctgttaccagttcctgcactttgcctaataagaaagccctatgactcttttcagaaggaagcccgggaattctctctctcttgtgctgcctcccttttgtttgggcataagctccagtgaagctttgtctatgaaagcgcttttggcctcatatcaatttctattgcattgagagtccaagaacccatgatcggtaacaatgccaattgagggtagaaaaaagaaaaaaaatcacacacaaacccaaagtgctttttctattctctcattcaacaagagtctaaacagatgacctctgtgaccaaatgtgtggggatttctcccaatgaacaagcaagcaagcaattcagtggacaccagctgtgtgtcctctaattcagttctattctgacactatctacctggagatagcgtcagatcccacaggttgaaggctgagtccccaagacttcttcctaccttcagatgccagtggcaagccccaggttgtttcacctgtgcttctgaccgacaggctataaatcaaagatcccacagcccctctttgggtccaattaatttgctagagcagctcacagaattcagggaaatacgtttaccgatttattataaagtatattacaaaggatacagttgaagagatgcatacagtgaggtgtgggagaagagagggacgtggagcttccatgccctcctgggcgtgtcaccctccaggaacctccacatgtacagctatccagaagctccttgaaccctgtcattttggggttttatggggacttccttacacagccatgattgattaaagcactggctactgttgattaccttaaccttcagcccctctcccctctctggagggttgggagtagggctaaatgttccaaccttgtcatcctgccttggtctttcctatgaccagccccatcctgaagctacctaggagctgccagaccgcagtcacctcattagcatacaaaaagacatcactttggagtttttgaggattttaggggttgtatgccagacaacagacgaaagaccaaatatatatttcatagtatccagtccaccctctgtcttggatccctcacatcaaaaggatgtacaactcaaaagataccgccaaattactagaatctcattcaatcagtaataatcagtccagcccatcatattgtatgaatgtctcccaaggcgaggccactcaggtttgcaggcttccattcagtcttgtcagagtgctctcggcaaacatatagcttcaccctttacagcagctggtataattaagctaggagacagatatcatttcttgctctaagcctctttcaaggtattaatataatactgggtttctttcatttcataacccatttattctttactctcactactatttttccttatctctataaactcccaaacttttccacctttggatgggacaatagaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagccccactcatgttgaatgtgagcacacacttgcgaaggcaaataaggcagctcttcgtgctttcatctccctctgttttagacaaccagtgttttcattgcctgttccactctctatcaaaccgttactctgaggaagatatctctctgcccattgctgaacattataggctatataatgtgttcctgggtctgaagaagtgacagccatccaaatctgtgcaatatcttctgctctagcttttatggcactctgagcaaactattattctgagaagaatatctctgcccactgctggaacattatgggctgtaccgtgtgttctttggcctgaagaaatggtgttcagctctccaaatatgtgcaatatcttctgttctggcttttttatggtattctcatcattcacatcttccaccgggcaagcaaagcccagtccagaatcagtgtctactcctgtcaaaacccatttgtggcctcccagggctaccagcatcagcctcacttgccagcttgttcagggctttcccaccagggaaatctgccccacagccatgggcaatgtctgtctcttttgctggcagacagaacagtttttattggcattttgtgcctaagatggtgcaaaagaaacatgtctaaatgcagcctatctctgcactgttgcagtacccgtttatccactcatttcacagacccaggtggccacttcaagggagcacccagggttgtctgcttgtgatatcaatcactttctgaaccaggatcttttttttttttttttcaagtcagagttttgctcttgtctcctgggctggagtgcaatggcgcaatctcggctcgctgcaacctccgcctcctgagttcaagtgattctcttgcctcagcctcccaagtagctgggattacaggtgcgcaccaccatgcccagctaattattttgtatttttagtagagacggggtttcgccatgtcggccagggtggtctcaaactcctgacctcaggtgatccacccaccttggcctcccaaagcgctgggattacaggcatgagccaccacgtccagccaagaaaggagctcttctgatgggcattgacatgttctactttaatgcactcctcaaatttccatagggccattctccatatgggcatccctttaataaataggccaggtttccactgcccttctgcctgaccatgtggccaggccactgagtcagtaaaaaaatcaaacacaggggtttttgctattgttcatttctgcagaatgcaattcagccaccaagctaatttggtcttaccttctttgatcaagagtggcatccttccaaacaagattgttcaccttggaactgtcatttacacaccaagcaactctttgttggtcagttgagagctgtttacggggccctgtccaagtctcagtagaatcccgcagttcctcacacagttccagagtcagtcctaggggaaaagaggctccctgcatgagagtatttcctctttgcacttcccagggaggatgctcctgtataaaccatttccattttattatggaagtgttctgggcactgccatccccatttgaatgtttctctgacatcatgtgagaaagcatgggtatttcaggtgtcaagatcattttatgtccttcagtcataggggttaacttcagttaatgtcccatagcaaggtagtaaatacccccaagtggaaattctctactgcaaagtcccagtagttgtcactgggagatgctcacagacttctgagtaagccccagtaaacgctgacaaaggggtagcaaatggagaatttgtccctatgatattccagcttctattctacagattgtgggcttgggtaatcttactggtttgccatttagcatgttcaattaatattgctacaagggtgttttacaatacaaggtaagagaaacattccccagtcagacacaatatccccataatacagtcaagtgaaagagatacaaccacttcatgtaaagtgtgttcaaatgtaccaacttaccttaattttctcaatgcttactttcctaactgtagcctctattacgactttaccaacaggttttgagtttacagtactaggtaggggaagtgttccccacccagacataatatccagttccatcaaacattcaggtaaaggagacataacttctttacataaagcctgtttataaacattctaaatctcgtattcctaccaacccttactttctgtcccagtcccagaatttctcttcttcactcccagaccattttaccattttctccttagaaaaaagctttgaatccccagcagagggttgagccaagggaccttagcccttttgtcaatctttgtcttgattaacctgcctcaacactgctccaagtaattgttggtcagctttctcattgtaatctcttcctctcattttttcaatttctcctaactgggataaatacaccaaacctgtttggatcctcttaccgttaggagaacagcagaatctccctaccaaccttctatagtgatgacctttgttttaaccccatcgatttccactttattcatcccattttttaatagccctctaaagactctaccctgcttagatgagtcccatgactctcctttctttttcctcttagtttcaccccatcaatgttttcttcattcaccttatttctcaataaccatttagactttccaccttcctgggatgagtcctgtgactctcccctctgcctttccccagtctcttgttaattacgctcatgttttcattggtgcccatacaaaagaggctcccttagccatagcatttactacagccagagtaatggatgtattcagtgagtgaatatctcagtcatcataaagccagtcccacatggtctacataggaagcaaatgagctgctgcttcagggtacaccacttggcatttataggtgaaattggacagtccccttctcagggtaaacaggtccagtccaccacgctggccattcccttggaaataacctcctgtgtgtctggaaatctacctttccatctgtgattgttcaataatgaactgcaggtcctacctcaaccaaacatgctcttccactcttgagcatttaaaaccaaagaaactgctctgacagttccttcacagtataccctccagtttcaatagtttatcagttttaccctttccccacattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagggctattatttaaactataaattaaattccttcccaaggctagtttggcctatgcccagtaatggacaaggacagtttagaggttagaagcaagatggagttggttaggtctgatatttttcactgtcataatttccttagttacagttttgcaaaggcagtttcaatcgtaaaggtacttcagtgtccttgcataatttttccttgggggtcagctttgaggctagtggcctgggctcagacagacaaagtctaacctagcattctcctttaatttcatttagctattagagataaacaccaaagaatttagtatttcactttttcatattagtctgcataccctcatgcaaccagtgaaccaactccccgggagttgcatccatctctgaattccaccagtaacttttacctttagtagctgattgcagcacagctgcagctcaaaacagtgggaaaccacatggccacccaggaatcaaagattcctcatctcccacctttttgacgcaggatttttcttggccactttgccaatcagggacctccatggccagcaacgcccccctacctggcctttgcttggccatgggcctgctgaggcgtcaggcccactcaccccacctgtgctatggcttgtacctgcgttcagcagttcccaagctcctgtccttatccacgaagaatgaggatacgctgacaatttgaagggtgaggatgggtagggaagaattttattgagcagcagaacagctttcagcagagaggggacacgggtggcccccccacccctgcagtcgggtggtttgtctctctcagtgtggctgggtccatggtattttatggattcagaatggggcatgtgtgctgattggtttgtgagtatgcagaaaaggttaaagcgaagacaccactcaaaggtgggcacaacagtgtagaaaaccaattagggaagggtaggtatatgtaaaataggtgaggggcggggatcaatcagaggaaagcacaccaaacaggaagacaggttctcaatccagtccatggatttacccgggacatgtaggtaggctttaaactgtcttcagcttgaaggtcaatttcactgaggactcgcccctatctgtctaggcattttgtctgcctcctgctgctgtcactttcattctttctcttcccaaaccacatgtttctgtgagccaagtccattctagcaaaccctacctcactgaaaccaattcatagtttggaaggaaaacaaaactcacaaagtacttttctactctttcaacaacaattaacacagatgatttctgtgaccaaatgtgtggggatttctccccaaccaacaagcaagcaagcaattctgcagttgacaccagctaggtgtcctctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctcacagaactcagggaaccagttacatatacccgtttattataaaggatacagatgaaaagatgcataatcctggggcacggagctttcctgtcctctctggacagaggcaccaccatctgggaaactccacaagttcagctatccagaaactctccgaacactgtccttttgcggttttatggaggcttcattatgtaggcatgattggttaaacgattggccattggagattaatttaaccttcagcccctctcccctccttggaggttggggatggggcttaatgtcccaaccctctaatcctgcctagtctttcaaggctaccagcctcatcctgaaactacctaagggttccagccatcagtcaaccattagcatacaaaaagacatcattctggagtttctaaggattttagcagttgtatgcctggaaagagggttgaagaccaaatatatattttatagtatcacagacctgatcatcaaagtttcactatccttcagctttggcttttggcttttcatataagcttgagtgtgctggctaaacattgtcttttaggaatgcacagcatagaaactctagcgacttcagtggcagtcataagaactggaatcatttcaggggtggtagttgaaaagcagacaggaaattagcaggtttagaataggggagaaactttagcattgaattacgtgaggcaaaaatatatttgagggacaaattttgaattttgacatcttcaaatcagtcaaacttggttcatattatgcttcagaactaaccattcttttctgtagattctttaaaaagccaaaagtagataaagatttctatgaataaagcagttgaggatagaattccaaaaataatgctgttccattgtatcaccccaggtacaaaacacacacacacacacacacacacacacacacacacacacacacacacacaaaatctataccctgggaaacagtgacttggattgcagtgagatttagcgaatttaaaaggcatcatatatcagtgcccagaattctccacttcactgtctctttctagggccaaggtttcctggccattttattaccaatcacttcttttgaatttctagatacaattgtcttaaggtgaagtcccctgctccatgtaacttcctgtccttaatcaaggggaaaaaaagagatagatgtcaagggaagagaaagaagaattgaatatctcatgtcttccctcctatacccattagtgtctgtattcattttctcttaagcgccccaagcatgaaagtcacaggtttctctgagaaccacatttagaaaattaataataataagtgacagccactgatctgcttttatatatatattcatataattttagaaatatctctgagatagattctattattactgtcactttctagatgatggatgtgggtccacagaggataacttgcctacagtgataaaactgctctattataaggtctagatttgaacccagatagtctgactttagagcccacattctttactgttttatatggactctcataatatatgataatactcaatagaatctagtttattgctttaaataaggagaccagctatccccaatgaccaaaaatatatctcatttatgtacttgtttccaattttcaatctcgagatttattaactcctgccaactctccactgtaaaggtaccctgttttcattgtaattgataagtaatctgaaggtgatattttaagactctatgagtatactgtgtttccctttcacccactggattttgacattcttcgatgattctcttcttgcctaaatcagctgtttccttggtggtggcatcttggtaatcttttggtgaatggatatattagatttgaagtagtccttttaagacatcttttggtgagtggatgtattacatttgaagtagtccttttaagacatcactctaaacaagtcttgttgttttatattatttctcaaacagcactgtatgtggcatagtttctaatattttcatgttgcctcttcttccctttcctctatcaaaagccagcctaaaaatgtatggttttaataaacctacaaataaagtattgaacttggaagtataagttctctagagttccagaaatatctggagaaaaaaaaaactggaaagaagaaacctgcgttaaattttataataacactgaaaaaagtctttaagagggtcacttttttaatagtgccttggccagcagagggtaatatattaccagccctagttaaaccacttttgctgacgcataaactgcccacattgcactattttccagctagaaacataaagcaatagaaaagtttggggattttttgaagctctaatacaacaataaatttcttttagtagctgaaaaccactttacacatgatagaaaaaaagtaattgtatagacaatggatttctgtccttaagatgaaagcccggtgccactcatctgcccttaatagggtatgtcctttagggatagtttttgttttgttttgtactagtgattatcacaagagttacttttgtaaagtattcacaactacagttatcctagtggtagaaagaaagtcttacatttcagtatgtgaaagtttttattactgtatcttttagtttttctttaactttttttaatcatagaaattgatggacatagttttaaaagtcaaataacactgaaaagcttgtaataaaaacatgttatgtctattaataaatgtaatttaaagtattttcacctaatgaagacagtataggagaaatcacctctatcctcgactatagtcacttcctcctgtcagtgtaacaacttacgctacatatcccttccacttaagtggtaattttttttttttttttttttttgagatggagtctcgctctgtcgccaggctggactgcagtggcgcgatctcggctcactgcaacctccaactccctggttcaagagattatcctgccttagcctcccgagtagctgggattacaggcacgcgccaccacgcccagctaatttttgtatttttagtagagacaggatttcaccatattggccaggatggtctcgatctcctgacttcgtgatccaccaacctcagcctcccaaagtgaagagatagcttataataaccattccctctttattcagctctcttcatcagggggagcatgtacttgtttttatctcctagaacaagtggtttgttactaaatcttcagcagctccactactccctgcccttcattggtttggaaggtacattctgtctctctctctttctctctctcgctctctcatgcacacacacaaagctttcaagtaaaataactcaaggcattgtcttttttgttaaattactatatttattgtcatctttttagaaatcagtgctacacatattcttcatttatattttttatgcatcatttatctattgctgcatacttaactacccctagacttggtggcttaacacaagaaccatttattcactctcaattctgcaatttgttctagactcagctgggtagttctgtttgtctcacctggtggtcattcatgcagcttagtcatctgtcagctcagctgaggctagctggttcaacatggcctcactcacgtgtctggagcatcacctggaagagttgagcaggctgtgcccctctctccatgtgatctttcatcctgggcttctttacaatgtgatggtctcaggttccaagagggcaaaactggaagctgcaaggtctcttaaggccttattcaaatgtcatacaatgtctaccacattttattggtcaaagcaagtcttaatacctgcccagattcaactgggaaagtagactccacctctggatgagaagagtggccaggaattgggggcaatttttaatctaacacatttccttggatgtgctttcaactttaatgttctaactagacttgttatattttctccttgaaatgcagtgaattggctctttctttagggattactatagtatgtgtatctcagagttcgtagtttcctgggtaatattcctaaaagaaaaggaaattttgctttgtgagagatacccaccctgtcccactttggtcttggagctgtcatgttgttttggttgtttcttgtattaaaaggtatattcagtgtgccatgaatccagctgggtacagtggcacttgcctgtggtccctactacgtgggagactgaggcaggaaaatcgcttgagcccaggagtttgaggctacagtgaactatgatcgtgccactgcactccagcctaggtgacagagtgggactgtgtctctaaaaaaaagtatatgtgtatatgtatatataatatgccatgaatccatgatgtttcctttgtgctttttatcttctataaatcctctccctttaccttctctttccagaatattaatctaacttttcaataaaaccagaagaaaagtctgttgctcttgcttcccaatagctagtttgatcctgagagctggataagttcattgacatcttcaataccagagcttaaaaggatgtagaaagatgattagtctagcatggtggggtagctttccctcctaccatgcttattccctcctaccattattcaaggtttcattattttcaggatcataaatgtcaaactactgggccatgagacttgcattcacttacttagctgcatcctctccctacttgccacatctttttggaaccctgtaatcagtccccacaagagctgaccctgtgtgttcctgtgtttttcaagtttcactagccacaaaggggaactgaatatgaacatgcatgcaaacctcaccagttccctttgcagccagctgaaagttatttttcatgtagaggaaacagtgtttttcttttgagaacaaactgaatttccacacaaatatgaagtgtttcatcttctgacagttcagaggacccaagagaagagggcaccaaattgtgagaaaggccattaaaagagaaactaggaaaacaaagagacaaactgaattggggaagagagaggtgctgctgagtacaggaaaggaaaaaagcagaccacggggaggggtgccggggtgctagaaagtctcaataagtaatggcacacaggacaaggcaggaaatgtaggaaggaactgtctgcaaagggcctataatagctatgccagcagtattaatggaaggcattaagaacttttggtttagaaatttgctgttggacaaaatttcaaaatataccacatttacgtgattactgggcctgcctgagttcatgctatggagccaggtttagatgaaggtgccttgtcctcacttcagaatgcaatatggtgacctgtttggtgtctctgattagacggagaaaaaccaagaatcagatatgtattaacatctcttctaattttttttttttagaagatctctgtcacccaggcttgagtgcagtaacatgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgcaaattaaaaccacaatgagataccatttcatacctaccagattggcaaaaattagtaaatctgataaaaccaagtgttggtaaggttgtgggtaaacaggaactcatttctgccttgtagtgagatgggcatataaattggtaaaatcactttggaaagcaatttgtcaaaactgagataagctgaaaatgtacatacccttacaaccaagcatttctgcttttaggtgttagccataaacttcacacatgggcattgggtatacaaaagaattcacttgagcatggtttcaattagtggaaaaagtggaaaccaccaaattgcccattgttaggggaaatggagaaatgaaccattgtttattcatgcagtaaaacactacatcagtgaaaatgaatgaacaagacctacatgagtctacatagataaacaaaatttgagtgaaaagagttacaaagaatgtaatagtaagataccatttgtgtaaatttttaaaagaaaaagtgcatattgttatgcatatgtatgttgtaaaagcacaaaaatatacgtcagagtgatatacaccaacttcaggaaagaggtttcctcagggaaggatgtgaagtgagctttaatatatctaacattttggatgatgtatacgggtatgaaaaaacttttaagtaaaacgaaaatgttaacatcttttcaattggggtgatgggtacttagctgcctgttatgttgtgtttttccatttttgtatgtttgaaacgttttataactaaaaactatttatatgtgaaattaccaaaaaagaatataagtgtaacagttaactgttgctcccaaaaaacttgcatgacttattaaagcaaaaagagattccatgtatcatcaacacctgtatccaaaccataattagaaggcctttccatcttctgatggttctttatgcatttcatgggccagaagcaaaactaataagggtaggatgctctaatttgattccattttttttcttctattcaacctgtatgagtttgttctggattatcgtacatgtttcagagagagcttccagagtatataaatgtgtgatggttagaagactagttttaaagattgttttttgtttttgtttttgtttttgttttgagacagagtctcactctttcatcaggctggagtgcagtggtgcaatctcagctcactgcaacctccacctgccaggttcaagcgattctcctgcctcagcctcccgagtagctgggactacaggtgcgtgccaccacacccagctaatttttgtatttttagtagagacggggtttcaccatgttggccaggatggtgtcgatctcttgacctcgtgatctgcccgccttggcctcccaaagtgctggaattacaggcgtgagccaccacgcctggcaaagattttgtttctttggcatcacacaattatgatgagtggtaagcagaaatttttgcccccaatacatattaatggcaatttatgtttttttattttattgtaatttatttatttatttatgtttttgagacgaagttttgctcttgttgcccaggctggagtacaatgacacaatctcagctcaccacaacctccgcctcccgggttcaagcgattctcctgcctcagcctcccgagtagctgggattacaggcatgcgccaccacgcctggctaattttgtatttttagtagagacggggtttctccatgttggtcaggctcgtcttgaactcctgacctcaggtgatccacccaccttggcctcccaaagtgctgggattacaggcgtgagccaccgtgcccggcaaagattttgttttttttgacatcatacaattttgatgagtggtaagcagaaatttttacccccaatacatattaatggcaatttatgttttttaaaataaaagacatctcagcaatcaccattgtgcttggacagaactaaacaaaagtgaaaagcattagcagagacaatgtcagtagaatggaagtctaccaacttgcatccctacatatgtaaaatacagttgctgcttacatcacaatgccatgaagattaactgatgataatgcatgggaagcacctagaacagtgaagggcacataaataaacaaatgttactttgcttcccattcccttgcatgtgaacttgaagtggggaaataaaaggaaaaatagaagtttcgaacaaacttactacctcctttccagttctgtgctcactgttaccatccccaaccagctctccaagtcttcatctgaaaacatggactgactgaggcactatggcagccactcagctgggccatgtagctatgacagaggacactacatcatccaacatgggaatgccgcatagtttatctctcgtctgagttgacataattcagattatattccgagtttcaaatcttttcttccgattaaaaatacccctacaagcctctttacaagtgaagtttgtttgttggtggctgaaataaaaggctctccagtaaatgtcatatctgttgtgaatatttttcctgctttgtacttttgcttcagtttttatggtttgggacaaagaatctaaatttttaagtcaaatctatgaatttttccctatagttatttctattattttgtttgaaagttctttcccatctacagatgaactagtcattttttaatcttttatggtctcattatttacacttaattcttgagtgtccttataaattttggggtatgataaaaggtaaggctgtaaattggccttttattttaaataggcacagcactattatttattaatccatcccttccttcctgatgctttttgtgatgtttcctatatatgcagtgattttctctgagggaggagaatgtatgggggtcacctgagctttgcaaaaacacacttaaccccacctttgcaagattccagcacatcttgactaacaggaaccttttttttttttttttttttttttgagacggagtctcactctgtcgcccaggttggagtgcagtggtgcaatctcagtggggcatggtggctcaatgcctgtaatcccagcactttggaaggcaaaggcgggcggatcacctgaggtcaggagttccagaccagcctggccaacatggcaaaaccctgtctccactaaaaatacaaaaattagccaggcatggtggcacgcacctgtaatcccagctactccaaaggctgaggcagaagaattgcttgaacccaggaggcagaggttgcagtgagccaagattgcaccactgcactccagcctgggtgacagagtgagaccctgtctcaaaaaaaaaaaaaaaaaagtcatatacgtattttgtacttttctcatatatcatctaggatctgcttagacatgtgtattcagttccacagataagtttatccttgtgtctgctccccagtgttatccttactgaaggataagaatatattttaatatctgataaagtattatattttgaaaacctaaaaaataattagcccattaacatgttgctgcagcatccaggttgcttgttgggagaactctcttcatattgcttttcttttgtgggataactttcagtaagtctttcgttcaaatagttatattacctctacttttatgtcagcaggaataaagaatccattttttaaagttgaaaataaaactgtactggaagaggattgtctttttctactgacctaatcttagaaattcaaccaccatcaaacctggctctatacagcatacttttctaaaactaacagcaatattcaacactgaggtctcactctgacagccagacaattcattttgcccatatttggttttgcatgtatgagatgttatttagaaagctgttctgaaggtctttgcaaggtaaagatacgtatatacttctgaatttccttttcctgtatgcttctagaactaaaccttgggttaggagaggtaggaactgtttcctgcttgcaaatactaatgcttagtaagaaatgaaagattatatgtcataagtagccttaactttggtaagacagtagcatattttttctaaaaatttagaaaccttctcaggattcaagttactctaaggcatgttatcagatttctctcagtaagcaatctgttataaatagacagattgatttatatcaaaatgtattttattccaaataatatagcaataattaattgagtatactttaaaattttcttaagaatgccattgtgcagagctttatagtaatcatctagtataatgagacagcttctagaactatgagtgtatttatattcattttaatgtcccttaaaagtgataataattgataatataatttcaccaaactgtatacaatgagatatgtaagatgtttaccagtaatgtaaaataaatttttaagtttgaggacatgaaggaaaatagaagttttcataacttaaaaccatacaaacagaaatgctaaatttcatttagatggtatgtgttaacattgtcagggcaaagtaattaatataattttgtcacctttttctgaccctctaatttttctgcaaatttcagtatttatcctcaaatattacttatttttaaaatatacttttgctttgacttattctttattcagttaattatatttgcgggcacttattgaaatatagttaactggccgggcgcggtggctcatgcctgtaatcccagcactttgggaggccaaggtgggtggatcacttgaggtcaggagttcgagaccagcctggccaacatggtgaaatcccgtctctactaaaaatacaaaacagccggtcatggtggcgggcgcctgtaatcctagctacccgggaggctgaagcaggagaatcacttgaacccgggagacagaggttgcagtgagctaagatcacgccactgtactccaacctgggcaacagagtgagactccatctcaaaaaatatatctatatatagttaactgagcactgtatacaagccaaatctcattaaaataaactcagttctgatcaaaatcttcatggtcattcacattgatttctcagccaatggcctaccttaagttttaagaagtattctgactctaaaaaaattttatacaccatgatagaaactttcagatgagtccttggagtttgtcctaagatgcttttacataaattcagtcaataacattcaggttctgtgtatgaccaaagaactggacaaatgctggccaaactttcaagaatgtttgcctaatgacaccccctagattgcaactgtatggtgttctatacagctatattcaaatggactaggaaaaaagctaattactcccaactttttttcttgtaagcaccccttccttccctttctccctatcttattcatccgtccattcttcttaattattcaataaatgtgtattgatctcctatagccaagaaacatactaagctccagggaggcaatgacgaacaagactaagaccgctttcttttagagcttgctgtcctgttattttttaatgtacatgaaaattgcagagtttgctccttttaattctaatttgcaggtttttattgttgtaaagtatttcaaatacccaggagtttaccaaaaataatataatcacgtgcctactacctagatttaagacattaacattttgccatatttgcttcaaatttctccagatataaccattaagttggtatgtatcttgtatatattatcatacatgttttgtatctttattttatatgtattgatccataagaatgtggtattgttttctaccaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaatgtggtattgttttatgtttttatattttacataaatgatttcatgcagtacatacccttttgcaattttgtggggttttttttactcaacattatatttgagatatacccatgttgatgcatgtgagtgtagttcatttcattgcatcgctacatgatattccatttcgtgagtaaaccagttcacttctccatgcctttgctgttatgtccttatttccagttgtttcgtattatgaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggttttgtgaacaatttctttccagtagcaagatgatacatttagctgtgaagaaatgtagatgaatcgaaaggcatgatagggaacaaaacatatagtaaaaatgataagtacaataaaggagttacgagctgtagtggcatatttaccagaattaggaaattttgacctccttttagaaatcctcaatagattcttcccaatcttaatatatgaaaggattattagtaagaaaattagccagaacattaccacaagaatgaagttaaaaatggcttctccttttgcgttatgcttatctctgtaatggaaacacattgtggaattatgccctcctttcttaagtgttaaaataatcatagttaggaatccaccaagagcaagcatccatactatacaacagacataaatactttgtttggttgttattgccttccgttgctgtatagaccgattaatttttatatagcgatccaaactgatgaatccaagcaaaataatgctaatgtacatgttcatataaaacagtgttcccacaaccttgcacagaatcacacctagtgtccacttgttttggttaatatgatacattattcggaaagggaggcagaagatgagtaggaggtctgcaatggctacgttaagtagataaatttgaatggaatttcttttacggtgaatacccagaaatacatagagggcgattatgttcccaaccagtcccacgatgaaaataacagagtaggatgtggttaacacagtagatagcaatttttcatccatgggacaggtagtaacatttggtgttgctgagaagttttgtggcggttggtcgctatgattggttataaagcgcattctgtgggaggagtaaggccagctgctgactgaagttgtcgtcattgttatggtatgacttctcattgtcttctgtggagatcaaaaagtgaaagtgctaaatgacatattcctcatgtgtagttcttatgtcttcagatttttcctacaacggaatgccaaacattgagtcatttgctattttaataacagttactttaactaaaagtgtaaataataggctgggcttcccagcacacgcctatggtcctagctactcgggaggctacagcagaaggattgcttgaacccaggagttcaaggctgtagtgagctataattgagccactgcactccagcctgggcaacagaacaagaccccatctctttaaaaaaaaaaaaaaaaaaaagacagtgtaaataataaatgatttattttcagacattgcgagaaactttacttttatcctactgtatgtagtaacattattgtatcattaaacaagcagcacatagtgtggtatctcatggagtttcatgctctaacctttcctgtggccatggcctacattgaagttctgtttcatgtattatattaaaataactcaatttatgagatcatcttctcttagggaagttcttatgggaatacagatggtggtgaagagaaatgacagctcatatttctcaaagatgagcatcagtttctctaaaggtatgtacagccataagagagctgggcccactgctggccctgcccagcttcagaaccacttcctgccttgactttttccctcatatgtggcattcattcattttgacatgtattgctacatggcgtgtgacttgtggtggtctcattctataagtgggaataaagaagaggatcctaaatttcttttcagcctaagaccaaggtaggggtcttagggcatgcaattaacataatagactaagagaatacagcacctgcaaggttacacagactcttgtatcactggacaggagaaaaaagtaaccaaacaaaaccaagttagctggcagctgccagttagccactcctaacctagaagcatagagtaataacgtagatgggaaacagcatgtgcaatccaagattttgaaagtaacctgaccaaagcttaaatgtgccctgggttcaataatttgagacttgctagaaccttcgaagagatagtgtttgaattctacttgtttgtggcagcagagaatatttgcaaagctacttattattggcccattgactgctgtaaagagcttagtctgagagctggtcataacaagtaaagaaagcatttctggaggtctcatcacattcctctcatagagtgactgccctatttctctacagcagccacttagcagggttaacataaagatgcccagagcaaggttctcaaaatcagacccaactaacttgtgaccaagggcaaataacttaatcttttctatgccttagttttctcatttgtgaaaatgaaaaatgcataagaagaacttaatcctggcacatagtgactgcttaataaaagttagctttaataaacaccttttgattaatctcattttagtaaatatctcacacttggctaagtactgtgtgggaaaggaaggtgaataagacagagaccctattagtaaacattttggaggagtggacattcaaaccctgactgctaccatgcaaagtggatttgaattacataaattaagtccctgatttgatcttatacacagagaaaaatagcctttcttaaagctctacacataatttgattaaaaacaaagcattttggtagagggtaacattaagatttaaaatgttgtaaagttggggagcattgattccacagaagaggaactggctggtgaagaggaagttatgtaatccctggtaagagcctgtttccagaattcaggaaagtggagggagaaaggaagggagcggggaaggactgagtctagtctgtcatgtgtctcaactgcaggaagacaaatttcagaaagtttatagaaaggtataggcatgtttcttgtgatctaagattctggtttttgtttgtttgtttgttttgttttgtttttgagacagagttttgctcttgtcacccaggctagagtgcaatggcgtgatctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaaggaaatcatttttttctaatgaaatgatctctcttgggaggcaatataaggatcttaccactggagatttttgagactaccaccaattgggttctttgtagaagggattatcagtggttctcaatcctggctgcatattagaatcctcttgagggttttttaaagataccagtgcttggctccttccccagatattctgatttaattggtctggaatgggtttcaggcactggtttcctttaaaagctccttaggggattttaatgtgcagtcagaattgaactcttaagctagatggccaaaccattaactaatatttatttagtactttctgtgtaccagacactgtgttaaacacatttatattacttcctttacataattcttgcaatactctgtgaggtaggtatcacaaaagaggtaatgaaagatcaaaaggttggccaggtacagtggctcacgcctgtaatcccaacactttgggagactgaggctggagaatcacttgagaccaggagttcaagaccagcctgccagccaaggcaacatagcatgaacctgtctctaaaataaaaaaaggaagaaagaaagaaagttcaagaggttatgatctttactcttggccacacaactctttttttttttttttttttttttttgagacagagtctcactctgtcacccaggctggagtgcaatggcatggtctcagctcactgcaacctccgcctcccgagttcaagcagttctcctgcctcagcctcccaagtagctgggaccacatccagctaatttttgtatttttagtagagacggagtttcactatgttggccaggctggtcttgaactcctgacctcattttccgcccgcctctgcctcctaaagtgctggggttacaggcgtgagccaccgcacccggcaggccacacaactcttaaatgacagtgcccaagttaggactcagatctgacttttagagcccatgatgcttttcaccaaatctcactccttatcacatagggtcagcattttctttattaatattgagttctatcagcagtattttgacatgattcctttaacatacactttaacaattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctctacaaaaagtataaaaattagcgggtatggtgacgtgcgcctatagtcccagctactcgagaggctaaggtgggaggatcgcttgagcctgggaagcagaggttgcagtgatcctagatcactccactgtactccagcctgggtgacggagtaagaccttgtctcaaaaaaaaagaacataaaaaaaaaaaaaattggccgggagcagtggttcatgcctgtaatcccagcactttgggaggccgaggcaggcaaatcactggagtccaggaattcgagaccagcctggccaacatagcgaaaccctgcctctactaaaaaataccaaaaaaaaaaaaaaaaattagcagggcgtggtggcacgcacctgtagtcccagctactccggaggctgaggctggagaattgcttgaacccgggagacagaggctgcagtgagctgtgttcatgccactgtactctagcctgggcaacagagcgagagtctgtctcaaaaaaaaattttttttttaattaaaaatcacaattacattctgttttaaacttggtgactgtttttttttctcctttgaagttggttagtacattacaatgtcattcactatataaggctatttactgatattttttaaactacctgtttgatatgttaagaattgcttgtgaagacaagaaacaaaccactgtgtttacataggggattaatttcccagtgggcattacttgtgacccatgtgctatattgaagtggtcacaatagttttgtaatagtagatagtgttttttaaatgttgttacttggcaaatcctattcacaagttcaaaaacctagtattagtgcattgtacccccgcaccaccacctactcctgcagttttttttcaactggctcatgtaggagtactggacccagagggcaggacccaacagattccactgtgactccagatgagcagaagcttttaaaatgcagtttgggtatgtttgtgaaaatatcacattgctatgttgaaatacatacctatttggtaatagtcgcaacctttcaccgtttttagtttgacttgataatgactgaatctattcagggcatgcttcaaaattgcattaactgctgtataaaaaatgaaaattgaaaacatattactttggaaataatactattaatagtgtgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagcacaagcactgaatttctgtttcttaagttttcatctgtacattattttagcatattttcatgtattcctttaagacctttgctaaaacaaacttgtattattaggactagatgagatttctgatggtgttctccccttttgatcactatgataaactctcccgagcaaattaaaacatcacctgtattttaagcgaaataatgatgggattctgcagtcttggttttgatcctagtccaaaatttaaccactatctgtccatctatgtaactgctggccctgcagtttagtgttatttccctttttttgttgtcatttgaaatgaagaagttagtttttattctccccataattgttatcctgcagcttgtttgcactaaatatttgactcattgggctgtatctaacattctaattatttctgggtacactcttctgaacattatattctccagagctttttgtttgttataaatatgatttatgggacaggatatttttaaattaatagaataaaaatgttttgtagctcttacttccccttagaacctctgagaaggaaggtggttgctgtattagtcctgcaatattgttgtattggcaggattttattttattgtggtacaatatgtaacattaaatttaccatcttaacttttttttttttttttttttttgagacggagtttcgctcttgttgcccaggcgacaagagattgtacaatggcacaatctcggctcactgcagcctccacctcccaggttcaagcgattctcctgcctcagcctcccaagtagctgggattacagacatgcaccaccatgcccggctaattttgtatttttaatagagacagggttttgccatgttggccaggctagtttcaaactcctgacctcaggtggtccacccacctcagcctcccaaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacaggatttccttcttttatcaaactgcattatattccactgtatatgcaccacattttccctatgcattcatctgttgatggatttttgggttgcttccacctcttgactaatgtgaataatgctgcagtgaacatgagtatgcatatatctcttcaagatcctagcaggaattttttaatgactaaataggcatttaactacgtgcattctatttcatataatctagcatgaatatatttttttctatattattttcctacacctaagacaacccttttcaaaacactaattgttttaatcttcagtttcctcatattgtgaccacattttctcctcaatgtgagtcagcacagctaccaccagatttgagtataatctttttctagttctttctttatataagctttttcctgttcattctgaacattctggtttgtctctgcgttcttagctcattttcgatatgtcctcttcccttcacgcttcctctttctcttgttgggattataaggtatttatattaagatagaagtagaaaagaacaaatgtatacgcttgtttggtgccatctattactgatatcactgttctctttaaatcccaaccctggttaaattcagctcaccacctactccaggcctgaaccttgccatgtaaaatgaggactgctggatacaaacactcaatgatgctgattggtctcacttcaaattcatgactacaaacctcaagtgggcccctgggctgccaacagtcctagtatatttccttagtccagtggttctcaaaacaggggtcccaaacgagttgcgtcaacaccactcagaagcttgttagaaatgtatgttcttagctgggcatggtggcgtacgcctgtagttccagctacttgggaggctgagatgggaggagcacttgagcctgagagtttgagtctagcctgggcaacatagcaaaaccttgtccctaaaaaaaaaaaaaaaaagaaagaaagaaaaggccaggtgtggtggctcacgcctgtaatcccagcatgttgggagaccgaggcgggcagatcacctgagggtcaggagttcgagaccagcctgaccaacatggtgaaaccccatctctactaaaaacacaaaaattagctgggtatggtggcacgcacctgtaatcccagctactcaggaggctgaggcaggagaatcgcttgaacccgggaggcagaggttgcagtgagccaagattgcaccattgcactccagcctgggtgacagagcgagactccgtttcaaataaaaaaagaaaaaaaatgcatgttcctgacttcatcccagacctgtgagccagaaattctggggatggggctcagcagcctgtgtgattctgatgctaaggtttgaggaccactgcttaatcagttcattcttctattccttgaaaatactttttcacacctgtactcttctcagactgccaggaacccctctccttcctcactcccacctggtgatcactttttatttcactgagaaaatagaatcactcagaagagaattttattgtcttccagtgtccacctctgctagtatatacaaatgtctctctaagaaacaaaagccgggcgcagttcttcatgcttgtaatcccagcactttggccagctgaggtgggcagatcccttgagctcaggaattcgagagtagcctgggcaacatggcgaaaacctgtctttaccaaaaactacaaaaattagccgggtgtggtggcacatacctgtagtcccagctactcaggaagctgaggcaagagggtggcttaagccccaggaggtggaggctgcagtaagccatgattgtgccactgcactctagcctgggtgacagtgagaccctgtctcaaaataaataaaataaaaaatttaaaaacctccacaaaaaagctctaggtactactatggaattacctgtagaatatattgttatgtggaaattttgaatatttgtacatattttcttatttttaaaaaactgaaggataaactgaaaactgataaaaatagttaccaatggggaagaaaagattgggagtgggggaagagtgcaaaagctagacctctctgaatagtatctgttttacagtttgtactttagaacctatgtacatgttttatacaattaaaacaccaaattaaggcaaaatctagttgaaacaaatgaacctcactctattgcaaagtgaaagcataaccacaaggagaattatttttggtaacttttaaaatagggtaggggtttttgttttgtttttacgtaattttagacttatagaaaagttatgagaacaagtacgaggattctagataccttttactcagattctctatgttaacattttttccttcatttgtttaatccttctcaatctctcactcttatccatttatgtatttcctaaaaatagggaattcctttacatagctgcagtacagttatcaaaatcagttaatttatgttgacctaatatcattatgtattctacagaccttgttaaaatttcatcagttgtcctagtaaatatcctttataacaaaaataaaaacaaaccgggcacagtggctcacacctgtaatcccagcactttgggaggatgaggcgggcggatcacttgaggccaggagttcgagaccagcctggccaacatgccaaaacactgtctctaccaaaaatgcaaaaaattagtcaggcatggtggcacgctcctgtaatcctagctacttgggaggctgaggcacgagaatcgcttgaactcgggaggtggaggttgcagtgagcagagatcatgccactgcactccagcctgggtgacaaagtgagaccctgtctcgaaaatatatatatattaaaaacaagatctatctttttagtctcctttaatcactttaacctggaactgtatttgaagaatataggccagttactttctagaatgtccctctttgggtttgcccagggttccttcatgattagatctcgttatgtactttggcaggaataccacagcagtgttgccaagttctcaatgcatcatatcaggaagcacatgctatcaatcagtcccattagaagcagtgttaacttcgctagtttctgctgggtttctcccttgtaaaattactagtttcctgtttgtaattaataagtatgctgtagggagatatttagagatcacataaatatcttaccactcttcaaacttccactcacaagttagcatccttgatgattcttacctgaatcagttacgataatgaaaactgacagattccagcatttcttctacatttaattgattttctacttaaagcttttcctccttccccattcatgtatttgtttatttatttacatcagcatagactcatggattctttacccagtagtaaaatgctattttgaccgggcatacctagtgggatatatcttaaggacaaaaagaaccacaaaatcttaaacagcattcagtggtgttgttattgataatgtaggtattactattattttaaaactttcacacacacatacacacacattctgaagcacaaagcaaatgagtaattatgttagtatcattaggtaccaagattacagttgacccttgaacaacatggggattggggtactaatccccgcacagttgaaaatccatgcataacttttgactcccccaaaacttaactactcctggaagccttaccaataacatagttgattaacacatattttgtgttatatgcatcaagggagcctcaagtgatcctcaagtgatcctcccacctcgaccttccaaagcactgggatcataggcatgagccaccactcccagccggtttgataattatagaaagaggtttggctttaaaaatgtcaaaatagcaggatgcagtggcacatgcctatagtcccagctactcaggaatctgaggcaggaggtttgcttgaacccaggagttctgggatgtggtgcattatgccaatcaggtgtccacatgaagtttggcatcaatatgatctcccgggaggggggtaccaccaacttgcttaaggaggggtgtgaactggcccaggttgtcagcggagcaggtcaaaactcccgtgctgatcagtagtgggattgtgcctgtgaatagccactgcgctccagcctgggcaacagggcgagactcccacctctgaaaataaattaaaattaaataatgtcaacataacaggaggatcagtttttgtcagcaaagaggcagcagatgagttctcagatgccattcagaaaagtattgaagaggagcaatatctgcctgaacaggctgttaatatggatgaaaagtgccctattctggaaagaaaatgccacagagaacatctattaataaggaacagaagcaagcaccaagatttagggcaggaagggatacactaactctaataagcatagtcctgatataattccaactgcatttgcacaaaacagtagagtcagcctatctgcctcacttgaggtcaggagtttgagatgagcctgggcaacataacgagacactctaaccccccaaaaaatgtttttaattagccaggcatggtggcacacacttgtagtgccagcttctctggagactgaggcaggaggatcgcttgagcccaggagttcaaggctacagtaagctatgattgcaccaactgcactccagcctgggtgacagagtgagaccctgtctcttaaaaaaaaaaaaaaaatttatcaaactgtcttttgccaccattgcattctccagcttttagatccttcattttttttttttttttttttttttttttcctgagacagtctcattctgtcacccaggctggagtgcagtgtcagcctcctgggtttaagcaattttaccgcctcagcctcctgagtagctggaactacaggcacgcgctaccatgctgggctaatttttgtatttttagtagagataaggtttcgccatgctgcccatgctggtctcaaagtcctccactcaagtaatctgcccaccgcagcctcccagagtactgggattataggcatgagccaccacacctgaccccttcaccttctttttgctttaagttgctatttcgctttttctcaaattatgttagaatctataggtatgtcttttttatacccacataaaagctgcattttcaatactacttaaaaaggtatttcacaaaaagtgcaagattttagcacctactggtgttagctgcaggagtagcttcatgaatttcctttcctttttttttttttttttttttacaatggtccttatgttggattcatttatcttgagatggcagccaattgcagttgcagacctcaatctacaatacatatcaagcaattcagctttttctttttttttttaagatggagtctcgctcttatcacccaggctggagtgcagtggtgcaatctcggctcactacaacctccgcctcccaggttcaagcagttctcccacctcagcctactcagtagctgggatttacaggcgcctgccaccatgcccggctaatttttgtgtttttagtaaagatggggtttcaccatgttggccaggctggtctcgaactcctgacctcaggtgatccacctgcctcagcctacctttttcttgtaatgtcatgactttcctctgtttcttaggagcacttctagcatcaccaatggcactttttatggatcctatggtttaaggtattgcactaaacacagtgaaaataatatgagaactgtgagattacttttactgtgatatgcaatttattggagagatgaactgctcaagcaaagataagtagcatcacacaacatattaggtgaatactcgcaagacttgagctcactgcaacagcaacaggagggagctgtgaaattattacagtagtataatatgtactacagttaattttatggttatgatttaatattgcattctttgtatttgttcacatttctcttgactgaatggcaccgtttacagtctgtgtaggtgtaagttttgataaattttaactctttataatagatttgtgtacatttttatagtactaaataataaaatagtatctaaatatgttttatgcatttatgatatagctttttcttaattttttattccagaagtcatccttcacctttttcttaatttttaaaatagttctaggcaacatggttggtccacgagttttttcaaattgttacgaatctccaaaaaaaactttcaatatattttgttgaaaacaatccatgtataagtggacccacacagttcaaacccatgttcaaaagtgaactatacttgccaaatcaaagaattaaagtaaaaatgctataattgaataggaagaaatattagcttgaacttgtggtttatttatttattttttttttttgagaccgagtttcgctcttgttgcccaggctggagtgcaatggcatgatctcggcttaccgcaacctccacctcccaggttcaagcgattctcctgcctcagcctcccaagtagctgggattacaggcttctgccaccacacccagctaattttgtatttttagtagagacggggtttctccatgttggtcaggctggtcttgaactcccgacaggtgatcctcccgcctcggccttccaaattgctgagattacagacgtgagccaccacgcccagcatggtttatttttctcctaaaaatgcattcttttttcagcactgtccactgaaaagccaaagtaataataacccagtaaaaataatatgcctagtacccacatcatggatttatttatatattttattttatttttatttttattattattatttttgagacagagtctcgctttgtcgccaggctggagtgcaatggcgcgatcttggctcactgcaacctccgcctcctgggttcaagcgattctcctgcctcagcctcctgagtagctgggactataggcgcatgccaccacgcccagcaaatttttgtatttttagtagagttagggcttcaccatgttggccaggatggtctcaatctcttgacctcttgatccgcccacctcggcttcccaaagtgctgagattacaggcatgagtcgctgcgtccagccaattttttttttttttttgagacaaggtcttactctgtcacccaggctggagtgcagtggtgcaatctcagctcactgggttcaagtgaagctactgcctcagcctctcgagtagctggaattacaggcatgtgccgccacgcccagctaatttttgtatttttagtagggacaaggttggccgggctggtcttgaactcctgacctcaagttatccacccaccttggcctcccaaagtgctgggattacaggcatgagccaccgcacctggcccacatcatggatttaaatcgttttttgcactaaaaagaaacagggctacttagagaaatggctgattccagatctggggcaagaaatggacatgacaagcctggaacatcatcttgtgactgaaagcaaggaagttatcagacttctggagtcttacaaaaatacagaagaactgacttaaaggggctcccactggcccaaaatgggacaatttgagcacaaaaatttgtaaaggcagcaactgattaaaacacattaaatatataaaaatctgtaagttcataataattaaaaaaaaaacacctcatcagtcacctttggaggttgcctagaaactaacttggtattctggaaataaattataacagctttattcataatatccaaaaactagaaatagcctaaatgtctgtcaacaggagaatggacaaactgatatattcatacaatgcaatacttacggcagtagtaaaaagaaatgaactactgatcacaacaaaatgaatgaatctcagaacatgctgaatgacagaagccttacataaaagaatacatacttacggttttgtgtctatcaagttctaatataggcaaaacaaacctatggtgaaaaaaatatcagagtagtggtttgcactgggggagatggcagcagagattgaatgggaaggggatgagggagggaggtttgtgggataatgaatttttttagggatttgggttacacaaatgtatgcagttcatcaaaactctaatggtacgcttttgtgcatttcacagtatatacattttttaccttaagcataactttattttttttttactttttatagaagttttaagagacagggtcttgctgtcacccacgcaggggtgcagtggcacaactgcagttcactgcaatcttaagctcccaggctccagtgatcctcctacctcaagttactggtcccaagttactgggaccacaggtgcacgccaccaaaactggcttttttttttttttaagtagaggcataattttaaacaaatattaaatttcaatgatatgtgtgctaaggtgtattaaaaagtaagatggatagaaggataaagagatagatatttgataaagcaaatgtaacaatatttaattgtagaatctaggtggctctttacaatataattctttcaattttctatatgtttgatagttttcataacaaaatgttgaagaaaacctccattttggcacctctaattatgggtctaggcatcaacatctgctaacatcattgagtgaaaagttgatggtgaatcttataatgatgggtcaggcagacaacacctgaacccactgctcaatcctgtcactaaaagtaggatagccaggtgctatgttcttcctgttgcaatacaatagatatatcacctatgaagtattagtgcataaaactaaaattgaatctgaatctaatcaagattctagatctaactacaaatttacaggaaatacaggagagtaaaaaacattaaataataccatgtaggtaccattagtcaagtacagattgtgggggatttcacaggaaaaattacctagtatcttaacaaatcaatggcatgaacattggaaaaaaaaaagcataaggaaggggatctgttacagagtaagagacactcacaagacatagtcatcaaatgcaatgtacagaccttggatcctgtctagaaccaaccaaccgtaataagacctttcttctttttttagtctgttctactccttcaagttattggtagagaaaagacatttttgagacaatcaaggaaaactgaatgtggactgagtattagatgatactaaagaagtattgctcattttgttggacttaataatgatattatggttatttttaagtcctgtgttagaaatactgaactattaacaggttaaattacatttatgttaaaatacttctggggaaaaaaagtaaacagttggggatagatgaagcaaaaatgaaagaatgtccttgtttttgggtttttcgtttgtttgtttttgttttatttttgcctggagacgggcaagttgcccatacatcccagcaggccaggggaggagctgaaagaatgtcagtaattgccaaagctgggtgatagatacatggaagtttattaatctattttctccacttgtaaatgttaaaaagaggcatcctcagcttcacactttcttctacatcccatttctccatttttactacagtaagactgtgaaagatatctgtatttactgtcactacatcatctcctcccattctctcctgaacctggtccaatggggatttttgcctccatcgtgccaccaaaaccactcttatcaaggtcaccagtaacttccaaattgccaaatctaatggtcagttctcagttctcattttaaatgacctttgtaacattgatgactactaatcattcctacttgaaaaagtttcttcacttgacttccggataccaaactgattttcctcctgcttcactgtctagaccttgttttctttgctagattttttcttctgacttcagatattggcgtgcaccaggactcaatcctctgactcttctctatgatttcctaagcaatttcattccttaccatggctgtaaatatcatctgtgtactgttgattcccaaatttacacctctaatcccagcttccccttaatgtcatcttataaaatctcaaactcaatacgtatgagaccaaattcttttttttttttttttcatttttctataaaatagagatggggttttgccatgttgcccaggctggtctgaaactcctgggctcaagcaatcttcccgccttggctccccaaagtgctaggattacaggtgtgagccaccgcacccagcctgaaaccaaattcttgatccaccttacaaactcctccctcagtgttccctgtttcagtaaatggcatcttcattttcactcagttgctcagaccagaaaactaattgttataattgacttgtgtctttctctcacgctcatatccagtagcaattcctgtcagctttacctttagaacataaactgaatttgactacttctcatcatctctgcttctgtcactctagtctagtccaagtcaccatcttctcttgcctgtgcaactgcagtagcctcttaattggtctcctttttccctgtttcttcacaatctcctcacacagcagccagagtgatccttttaaaacctaaaactgatgatagtactcccctgttcaaaaccttatggtgatttcccatctcgctcaacataaaacccagagttcggagagcaggccagagcccaggcccggcccagcggcgcccgccaggtagacccaggcgaggccgcgtgccggcgcgaggggagcccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttttaggagcccgtaggtcatcttggagggtcgtctcaagtattgaacaaaagacggaaggtgctgagaaaaaacagcagatggctcgagaatacagagagaaagttgatacggagctaagagatatctgcaatgatgtactgtttcttttggaaaagttcttgatccccagtgcttcacaagcagagagcaaagtcttctctttgaaaatgaaaggagattactaccattacttggcagaggttgccactggtgatgacaagaaagggattgtggatcagtcacaacaagcataccaagaagcttttgaaatcagcaaaaaggaaatgcaaccaacacatcctatcagaccaggtctggcccttaacttctctgtgttctattatgagattctgaactccccagagaaagcctgctctcttgcaaagacagcttttgatgaagccattgctgaacttgatacattaattgaagagtcatacaaagacagcatgctaataatgcaattactgagagacaacttgacattgtggacatcagatacccaaggagacgaagctgaagcaggagaaggaggggaaaattaaccggccttccaacttttgtgtgcctcattctaaaatttacacagtagaccatttgtcatccatgctgtcccacaaagttttttatttacgatttatgacaggtttatgttacttctatttgaatttctatgtttcccatgtggttttcatgtttaatattaggggagtagagccagttaacatttagggagttacctgttttcatcttgaggtggccaatatggggatgtggaatttttatacaagttataaatgtttggcatagtacttttggtacattgtggcttcacaagggccagggtaaaactgcttccctgtccaagcaaagaaaactgcctacatattggtttgtcctggtggggaataaaagggatcattggttccagtcacaggtgtagtaattgtgggtactttaaggtttggagcacttacaaggctgtggtagaaacataccccatggataccacatattaaaccatgtatatctgtggaatactcaatctcaatgtgcacacctttgactacaactgcagaagtgttcctttagacaaagttgtgacccattttactctggataagggcagaaacggttcacattccattatttgtaaagttacctgctgttagctttcattatttttgctacactcattttatttgtatctaaatgttttaggcaacctaagaacaaatgtaaaagtaaagatgcaggaaaaatgaattgcttggtattcattacttcatctgtatcaagcacagcagtaaaacaaaaacccatgtatttaactttttttttttaggttttttgcttttgtgattttttttttgatacttgcctaacatgcatgtgctgtataacaatccaagcataattgttaagaacacatgtattaaattcatgtaagtggaataaaagttttatgaatggacttttcaactactttctctacagcttttcatgtaaattagtcttttggttctgaaacttctctaaaggaaattgtacattttttgaaatttattccttattccctcttggcagctaatgggcttttaccaagtttaaacacaaaatttatcataacaacaaaaatactactaatataactactgtttccatgtcccgtgatcccctctcttcctccccaccctgaaaaaaatgagttccaatttttttgggagaggggagattgattagaaaaaaatgtaatatgttccatttaaaattttggcgtatggcattttctaacttaggaagccacaatgttcttggcccgtcatgacattgggtagcattaactataagttttgtgcttccaaatcactttttggtttttaagaatttcttgatactcttatagtctgccttcaattttgatcctttattctatttgtcaggtgcacaagattaccttccttttttagccttctgtcttgtcaccaaccattcctacttggtggccatgtacttggaaaaaggccgcatgacctttctggctccactcagtgtctaaggcaccctgcttcctttgcttgcatcccacagactatttccctcatcctatttactgcagcaaatctctccttagttgatgagattgtgtttatctccctttaaaaccctgcctatcctgaatggtttgtcattgtctgcctttaaaatccttcctctttcttcctcctctgttctctaaataatgatggggctaagttatacccaaagctcactttacaaaatatttcctcagtactttgcagaaaacaccaaacaaaaatgccattttaaaagaggtatattttttcttttagaatgtaagctcctcaagagcagggacaatgttttctgtatgttctgttgtgcctagtacactgtaaatgctcaataaatattgatgatgggaggcaaaaaaaaaaaaaaaaaaaaaaacacccagagttctcaccacagtttcaaggccctacacctttgatcatccctcagatcacatttcccaccgctctgccccttgctctcatgcctttccagacacactgggcttccttcttcttctccaaacaaccctccttattcctgtgggcctttgtattggctgttcttctcatctggaacttgcttccatgtggcttgctttttcacttcgttctggtctctgttcagatattacccattagagaggccttctctgaccccaactaaaatagcaattccctagtccccatccctataacacctccttaccagcttaattttacttcctaacaagtaatactacctggctttacattctgttaatttgcatttatggctctatttgctttcttaaattcaactctttaggccaggcacagtggctcatgcctgtaatctgggcactttgggaggccaaggtgagaggatcacttgagaccaggagttcaagaccagcctgggcaacatatcaagacccctcatctctttttaaacataaattaatttaacttaattaagttcacattttataacttgtcttaaggattcaagaatgactgaatctacacagaggagaattatataaattcccttgtaacattaacttaagcctaaacatcatcaacatactattaagggcatacagaactttggagttctgatttcagcttctactccttcctaaggtgataacagttacacagccatggccagaagaccctgttggagtctagtttgcacttttttcttctgtatcatgttcattcttttctaggcttgctcacttgctgtgtcccatactggaatcatgctaggggtattgccatcttagtctgttgtcattgttctctctttgaaccaacagaaagttctaactaacagcagtctatcagttgatttcggtagaggtttgcctgctctcccatagactcttcttgctactttgtgtcatgctgtggtttgctcactattcatttctacacttgccttccttctttctctggctctcacatacacacttgtatttcctggctcatctctgtttgtgctagactattggaaaagtctttaaacttctttggacagaaagaataacttccaaagtagaatcctgatgctcccattgggcagagtaaggattcctcccacctgtgtgtcatcatcaaacacaggtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaaccctcattgttatcacaaagcatatgatataaaggagccctggtcaagcaggataccccttggggagaggatgtctttgccctggactaggaatcaggcaagtggttttctttccccttctcctttttcacctcccacccccacagagaggaaaagcagatccagagaagacatgcccaggaagagcgttgaagtccctgggaacaaggcttaattaaaatcattaaatctgacccatccatgtagtactccttggcttaagggtggaatgaataaagcaaagaaaagaggactgggcagggtggagaaagaaagggccatggctatcccctaacaaccaggatacaatggctctgtaggtaaaatcagaggtttcaagaaacattttggaagtgtaaaatatattttttcctaaagaaatctagactgtcactcaaaggaagacaatattgcatagtaaggcaaaaaaaatgtatctgtgtttcttgaacatccatgcttccttagtaattcttagcactgtactctaaccttacaagcaaataatacctaaagaacattggatggaacaggtatgtatttggagaaatcagccagacgtgagaatatgacaaataattcaagcatccagaataatttagaagtttttaatgtgtttctctattatcatgttatctaattttatgtaaactgcattgttcatcttcaatgaatccttatcttcgggtttgttttttgtttgtttgttcgtctgtttttcttttcagccccactgtgttctccttgcctcaaaagaaaactcggcacctgttaaacttggaggctttggggtagctattcaattaggggagtctggacttgtagctggaggtaagactgctttaaaaaaaaaaaattcttcaaaacctggtcacttgcgactggtataaaactttcaagctacatattagcccaacctcagtgtttcatacctcattccaccccaccccaactcccaaaaagcatcatcagatagtttttaatttaataactctgtagtcataactagaatcttagtcccttaagaatagactcttttttctctttgtacctccagtacttaagagactgtacaagattaaaacagtgttcagagaaaataagtttgaggcatagtgccttttaaagttgaactggccaaatgaagtcaaatctaaaatgtgtagattagccacttcctggtttacactgatggctaatttttaatttcatactgtttgcctttttccatttatcaaagaatcctgctcaagccatcagcctgtatattagcaaagaataagcagatgtgaatgcaggctgattttattattagccaaagcaaaacataatttttaaattcccatgtcagaataaaaagaaaaaagttacaaattatataatcttgcacagcacatttcatataactcaattccttatagctagaacatcaagcagtaacaacatagaccatcttcagaaaaatgagccataggtcatagttgtaatttttttttttttctttcagacaatgtcttgctctgtcacccaggctggagcgcacagtggcacgatcatggcacactgcactgcacccttgaccttccaggctcaagtgatcctcccacctcaacctcccaagtagctaggatcataggcgtgtgccaccatacctagcaaactttttttatttttagtagaggcaaggtctcactacattgcccaggctggtctcaaactcctgggcctaagcagtcctcctgcctcagcctcccaaagtgctgggattacaggtgtaagccactgcacccagccaatagttgtattctttaaataattttttcaccacagtgccctctaaaattaaattacattcaaattttcttttagtttcacattcttttccagttaatcatttccaataatatgcaaaactgcaagctgagtatagtttcaaagaatgctaattttttcccctaatttaaaactttctgttagtgattggaagactgaccaaagggtcaggtagtaaagcacagtttaatcatagaatctcaggactccaaagggccttaacttctccagtcttgtaactaatgattgaattcttccataatattcccaagaaaagattgagttctggtattaaacctcagagagcaaagtagtcactacatcccaagacagttcatttcatttttggataactccttaagtattaaaaagctcatctttgcatctttctgtaacttctacccagtcatcctaatcctgacttttgaaaccactctgaacaattttcatccttccgtatgataaccgttcatctgtttgtagacaactaccatgtccccctaggtcttatccaagttaacttccctagggtgatttggccattcttcatataaactggttcaaaatctcttcagtatccacaaagtacagggcctgaactgaacactctaactacaggtagtacagtacagccgatccagtgcacagtagcattgggctatcacttttttgtgttctgggccttaaatttccctcgagttccccaaattgcattagctttttggacaactacatagcactgatggttcatactgatcttgtaatcaagtgaaaatcctaaattattttttaaacaaatgtcactgttaagctaactctctcaattctggtacttatacagatcatttctatgttaagactacgtaattataacaaataatttctgatgattatattaccaaggttaatgggatgaaatgaaatgaatttattttatatgttatatactggccatatataatgactttgtttctgttgctctggatctatatcctgttggtatttagaatgtcatgttcttcgtattttattgtacatcttgactgggggggaaaatagatgcattatgtttacctggacattttctccatattaatctttttctaaagtccatgaacctttcacctaaattgtttatttttaaagctaattttgaactcccccccaccgcccaccgctggtatgtcagtattcaaaatgtatttttctccatgcttctagaattaaaatacttcctgatggtcaaaatattgtcatttcttagcacacctttttttgtattcttgaaataactgaatgttacgttttaaaaaatagaatatgaataaattagagataaattatttctcttagaaaaagcttttctgctgtttaaggtacttttgaaattttggtaattaaggttgggcacggtggctcatgcctctaattccagcactttgggaggctgaggcgggcagattgagcccaggagttcaagaccagcctgggcaacatggcgaaaccccatttctccaaaaagatgcaaaaattagccaggcatggtgacaagagcctgtattcccagctacatgggaggatcgcttgaacccgggaggcagaggctgcagtgagctgagatcgcaccactgccctccagcctgagcaacagagcaagaccctatctcaaaaaaaaaaagaaagaaattccgtcaatcatttaattatttatcaactttaaagcagaaagccattttcctgtcagtttgaaatcccagtccctagtcctccaaatagaaaggaattcatttctttatatgttgcatatagtaaaaatcatttaaacatatttacactccccctacctgaaactcagctatttaggaaacttacttatccagaatacaactagaaacctagaaaataactacaatagcagcaaaattattcctacccttaaaaatccactcatgctcctcacaattgagcatctaaagacactctctaaggctgacttgctcccatgttttaaaaagttgtatagattcgtgttccttcataccttgcacatgctattccttctagttggagtgccttttgttattttatctatctggttaactcctactgttctggaaggctgagctaacaattatctcctctttaaagcaggcttaccttcaccatcccgagttggatagccctattccttctctctatattcccataactatctgggctacatacctccatgtagcattggatgcagggacttacatcaaagactgtgatttgtaagagtaagggggaccatggctgagggtatctaggacctagcaagcacttaggaaattgctattaaatgaaataaactggttgctagtcaggttctagttaatagcagattataaaagcaacaaattaggagaacgcagaactaaagcatagtgagagaaaagaaataaaagcctgacaaaaatatatatgatatatactgagcagacaccaaaacttggaaagcgcaacagcctttcaatatgaaagaaatcaactcttgcatacctctgaagttcctgagggtgctttctgttctacagcctaggtctttaatcagtatctacaatgacaactctgagtcatcaagaaaaggttaaattatgagcagcattctgtgtaaaagaagtcaggaaattgtagaaagccatacaaaattatttaactaaggtgggcactgtgactcacacctgtaatcccagctacttgagaggccaaggcagaaggatcgcttgagcccaggagtttgagactagcctggggaaaatagtgagactctgcaaaaaaattattaaaacaaaaaggattgtgcgcataaagattcaaatcacaatgtatttaaaaatgtagctattcagaacaattctccccctgagattctggtaggaaggttttattgtattatcaaaatatataatatttaaatatttgtccaaaatatctcaaactgccatttaatttagtttgctaatttgtttccttttcttaaaattttgtggtcaaagtcctaaaagtcaagaagaagtatcagcaaaaacaaggatttttaggaagttggtgtatattaaagattaactccagtcctttttaccttctactgatttacatgaaataaaagagccttcctctacattctttctaccatggtttttcccctatcatctgtgagcaaattattgaaccaaacaacaggcatcttcccgaagattgaacactaattctccagaattgggtagtcttcgtctagctaaatggagagaaccttctcaggatggctgggactggccatggtcgctctgattattcccaagttaaggcccccattttgagtggcttggcccaggaagtggtaggagtcaagttgagtttcaaagcatcatccaaactgtcagcaggtacctaactggtaccctggtaccaattgaatgatactggtttcccctactcctgctagctcctgtccatcagaacaaggctaattctccagtggcccctccctgtccaggctattaatgaagtatggaaggcttagttcccatccctgcagcttcttcgtgttacttgaggaagcaaaatggggcaatacagaaataaaagtatttctctagccaggtccttctagtcaatagttttcactgatctatcgtacattttaaatgaaaatattttcactactggaaccctgaacttaagcttttctattatggggggaggaagggaaaccatatgatctgcagcaaaggtacatcctgatacacaagctaagagctcttttatctttctgcatcccaactgagtttcataatcatgaacagaacttgatatattctctctagctgaaccagaagatctctaaggtcttttaaaaccacagttctgagttctagataaagtattgcacaatcttcaaactaaaaattatcttgaactcagtatgatgaaagagagagacagagggaggaagggaggtggctgggcttgcatatatctagaagagctgccaagtctagtgggcagtgccccatcccacagtgatcttcctgccgggtacaagcctttcattccacaatagaagacttcttttgggatactgagttaaagatagttatgaatgtgcaaacagctagtatcagattccttacagaaagctaatttttgatagagaaacaaaagaaaactctttaaagaagatgaaagtcaaagaggattgaatgggaggagcttcataattttgcttttgtttatgccatatatttgctctcattctcttcatatgttaatgttaggaggaagctaaaaactcctactataacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaaccttctttgtgtaatttgagaaaggggcttcatttttaaagccttctgcttaatttgtaaagttaaaatggaatttcatccaggtataattttagtcattctttatcttaattttaaatttaggccagcacagctgaaaacatttgccatttacattccaggataaactgaaatgccaggatgacaactgcatttcatgatacaatatagaggcatttcagtgtggcttaaacattcctattcttctttggctattaggtgttggcagcctcatgtactatcacagacttgtgattagtaaatcattactttaactagtaaaaaattgaaaattcattactgactttatgaatagcgatatcacaaacacctaaggacttcttggaaataagtaagcttaaagttgatttcactaccccagcttttagactcctttgccctgtcccacaaggtacgactgacagtgactaggaggctgggcatgggaagcatggggatgtgtgtgtctgggtatcaggttaaggctgtttaagttggggaaattctttttcctctcattattactgaaactcatactttctattcaacctcatcactgtttcattttcagccatgactgacaacataaaaccaaaaacatgtgtatgtaacactggactctaaaactatgaggcccctaaagttttctcttcaattcctcggtaatgttagaattttatatgggacttggaaaaataaaatttaaaaagaagaaaagtaaagtggttccagagttacagtcttatccttttaagccataactgaagtttatggagatgagaatggtatatacttttgttggtttatttacctcactcaccatcagtttatgagtgcatataagtttgtcttttgttttagttagtttaagatatataccaaaactctgttaacagagaaagatgttttcagtgtagcatattctgctcctcccagagtcagctggccactggggaataaaatcaatacttaccaggtaactaaatgtctcaggaaactgcttgtaagtagtcatccctcttcaatccagggaagttgtaagttgctctcaggaatgcacagccaaattctggttgaatttagccaagtgaaatcacagatactaacgttttaaaagaaacatgattagtgatacatcagcataataataatactagcaataatgatagctaactcaggcatagcacatagcatagcatactttacataagtaaagtgcttagaatagtttaattcatttaaccctcacagcaacttgtgaggtaggtaccatataataataatcccccacctgcgtttttgagttataggcatttgctaataatagaattcttcctttgtgtttgttcagttgttaacttcctagtttccaaggcaatgtgcttcattccaacagactctggtattttatttcgtctatttttaaaacattgaatagttatttttgtttcttggtaaaaagacttagactattcacatatgtgcaaaaattaagtcatttaaaaattccctcttcctagtattatagtaagtcagatggatggtggcagctacatcataatttttttttgtacctggggtttgaagctttgaggttaataatttatttacttttttacttggctaacctcacctctcatttatcttcaggactttccttacaaaaagcctaggttttcaccaccttagtttgaagtatagatccatctctaccatctatgatgaatctcggcctttttcttttagtatactgtcatatgattctgtcagcatttatttttctatcttttattatcaaaaatttcgaacaaaaatagtagagagaatagtataatgagctcccagcttcagtaacacagacaatcttgttttatctgtattcaacatattattacattattttaaagcagatctcagctgggctcacttgagctcaggagctcaagaccagcctgggcaacatagggagacctggtctctacaaagagtacaaaaattagccaagtgtggtggcacacacttgtaatttcagctacttggaaggctgaggtggcaggattacctaagcctgggaggtcaaggctgcaatgagccatgatcacaccactgcacttcagcctgggcagcagagcaagaccctgtcttcccaaaaaaaaaaaaaaaatagatttcaaaaaaattatttcatcaccttggtggttcttttttgagacagagtcttgctctgtcacccaggctggagtgcagtggcacgatcttggctcactgcaacctccccctcccaagttcaggtgattctcgtgactcagcctcccgagtagctgggattacaggcgcatgcaccacgacacccagccaatttttgtatttttagtagagacgggggtttcaccatgttggccaagctggtctcaaactcctggcctcaagtgatccacctgcctcggcctcccaaagtgctggaattacagctgtgagccaccgcacccggccacatttcatcaccctaatggttctgagcaaaagaactattaacaaaattcttgatctctatggatattttaaagaaaagtttgatgacaccttttaaatgcagtactttttttttctttttttacctccagcagttgcaaatgtgagaccacattagaaaatactgtttcactggagtatatgctaacacttaacctcaattaacttctttgtaaagggcaaaaatatatttcccaaaccatatataagaagtgtaatgtcatatcattattacagataaccagttagtatatacacagcaagattctaagctgctatgggtttggtattcaaataagtaagattgttttatagccttattttgttcccccgtatagattcaatctccccaatttgttttagctactcttctcagctgaaggaatagaaaatcctgtgttggactgtcttgtaaaaaggacaagggagtatccttctaaacctctactcatttcagaaatcttaccacccctttcagatgatttctcaaccactttgtcaaggaaaaattattcagactttaaagagcacattcgctccaggatagggagaggaaacaagtctacccaagccctgtctaatcacttacctcatttcaaactggtcagttgaccacaatttcactaggatgaaaagtgtgggatttcatccctcccaaagtgtgggattacaggcatgagccactgtgcccggctggataatgataattaaacagccttatggcattagtcttaatgggatttgacaagcagaagtggctactatttgaaattctgcctgttggggggaaaaatgaagcacacttcaattttaagggctatccccaacataaagacacttttcactccccatcttcaagtacaaagtctcacattagtcagagctaatgctagcccttgctcaaattgtgatgattcatttatactgcagtgcaagtactgcagtttcatttggctttaaaatgttgtggagtttattcttcatctttcttccttagaaggtgatgtaggtctctgcctgttaaagccatggctttgcttgaaggtcctggcactgggtagctcacataaactcaccccatcagtaaacctgttgatattgaacaaggaatgagaccctactctgtctctgtctcctttccccacttgccttcccaaccccatgccctaaccactctgatttttttttaaatgattctgggtctcagacatatcccttttcccaggagccttctagcacttggctcacagatccacagcctttctcataagtcctgtgtcttttgaacaattcataattatttttgtttgattttaatcaatataccatgtggcttagttgtctcatctctaaaagagacaaaagtaacttcactgaggacagtattcaagcaaatctgttattctgtgggacctacggtagtagaatactttttcctaaacaccgaagttgatatgcagtgaccaaaatatcctattaaaaactttgcacagttcacaattattgctaacctcgattttttaaaacatatcttaaaaatatttctttaaaaattttaagttttattttagttctttctggatcgatgtattctagtctccctagctaaggatctaaagatagaaactggaataatgaacattctagtcttcaattattgaaaatattatcacttacataacaagaatatgggtatggaatatttactaacacaaattcttatgtagtaaagaacaacagaagaattgcatttgtccttttcttagaatgcaagcctttagaatcaaatttctgttctttgctctcagaattttattcacattgaagcaatataggaatattaaataatagtgaatgttaatgtctcatttaaggtaactatgtagttttcctttcctcctcctcagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttctgtcttaggaaaacggcaggtttttttttttttttttagacaaggtctgacaacattgcccaggctggagtacagtggcaccatctctactcactgcaacctctgctcctgggctcaatcgatcctcccactttaacctccccagtagctgggagcacaggcatgcagtaccacacctggctaatttttgtattttttgtagagatgggggtttcaccatgtcgcccaggcttgtctcaaactcctggactcgagcgatctgcccgcctcagcttcccaaagtgctgggattacaggcatgagccactgcgcccagccaaaaggcagattttaaaagttcattttatatcccatcttgccagtgagtattaaggaaaattataacttgggacagcagtgaaacagtactttttgattaaaacattatacagcccaataattccaggcaattttcattttagatgttagaaagactaacgcttggagaggttaagaatttgcgccaagttggccgggtgcggtggctcatgcctgtaatctcagcactttgggaggccaaggtgggtggatcacaaggtcaggagtttgagaccagcctggccaatatgatgaaaccccatctctactaaaagtacaaaaattagcctagcgtggtggcgggcgcctgtagccccagctactgaggaggctgaagcaggagaatagcttgaacccgggaggcagaggttgcagtgagccaagatcgtgtcactatactccagcctgggtgacagagcgagtctccgtctcccaaaaaaaaaaaaagaatttgcaccaagtcacagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatctctactaaaaatataaaaattagctgggtgtggtggcaggtgcctgtaatcccagctacttgggaggctgaggcaggagaatcgcttgaacccaggaggcagaggttgcagtgagccaagatcacgccatagcactccagcctgggctacaagagcgaaactctgtctcaaacaaacaaaaaaaaaagaaatataaaagaatatataattcaaaagacactgccacattactagaatctcattcaggcattgataattagttcagtccatcatcataatgtatgaataggtctcccagcatgaggccactcaggtttgcaggctttccattgatcttgccaggttctaaaagcaggaatggtcttggtttcaccgtttcagacacctgatataattgagctaagaaacagtatcctttcttgctctgagtctctttcaaggtgttaatgtaatgtgataatggatttccctgaattcataacacatttatttattcctttactctcagctgttaattttttcctcactttattaataacctttggaagaaacattagaatcaacatcgtgctggtctagatggcagacagcaatattagtctagtaattacctcctcctcagtccactcccatgcagggagactaaggttacataggtgccaatttagtggaccgtttttaccaccaggcaatatagctgcattcacaattaacccgttttgcacaacccacccccatcaggtccttaggaattctgacacaaggtttaaaaacatagttacaatttcttgtttaggaatcatccctggttctaacactggtagttatggctctggtcctagaaccactgcatagggaggggcagggggagtttagatgatatgggaaagaaggaaagaaaaaagtatagtcattatatcagcatactcccctcttgtcaagaattgcatagtcataacagcatcctctaccaccccccttccccagatcaatcagaaaaacgaaagaatatctagtggggacactcctttagccccactcatgttgagtgtgagtacacactggtaaaggcaagtaagccagcccttcctgctttcatctccccctgttttagacaaccaatgttttcattgcccattttagtctctatcaaactattactctgagaagaatatctctgcccactgctggaacattatgggctgtaccgtgtgttctttggcctaaagaaatggtgttcagctctccaaatatgtgcaatatcttctgttctggcttttttatggtattctcatcattcacatcttccaccgggcaagcaaagcccagtccagaatcagtgtctactcctgtcaaaacccatctgtggcctcccagggttaccagcatcagcctcacttgccagcttgttcagggctttcccaccagggaaatctgccccacagccatgggcagtgtctgtctcttttgctggcagacagaacagttcttattggcattttgtgcctgaaatgatacaaaagaaacctgtctagatgcagcccatctctgcactgttgcagtacccgtttatccactcatttgatggacccaggtggccacctcgagggagcacacagggttctctgcttgtcaatgtcaatcattttccaaacccagaaagaggctcttatgatgggcatcaacatattctacttattgcacccctcaaatttccatagggccattctccatatgggcatccctttaataaataggccaggtttccactgcccttctgcctgaccatgtgaccaggccactggtgactgtccatgagtcagtaaaaaaccaaacacgggagcttttgttattgttcatttcttcagaatgcaattcaactgccaagctaatgtgatcttaccttctttgatcaagagtggcatccttccaaacaggatgctgtcgattcaccttggaactgtcatccacacaccaagcagctcttcgttggtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcccatagcaaggtagtaaatgcaccgagatggaaattctctagtgcaaagtcctagtggttgtcactgggagatgctcacagactttggccataagccccagtaaacatcctgcaaagggcgagcagatggagaatttgtccctaccagcactccagcttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatctcatactcctatcaaccctcacttttaccctttcttgtttaaaaaaaaaaaaaaaaaatgttgagtccccaacagcaggttgagccaagggaccttgccccttttgtcagtctttgtattgattaacctgcctcaacattaccccaagtaactgttggtcagctttctcactgtaatctctgccttctgactttttcaatttctccaaactggggtgaatacagcaaacctgtttggaatcccttaacattgggagaacagcagaagctccctaccaacctttgatagtattatattgagatctttgttttaaccccatcgatttccactttattcatctcatttctttttatttcttttttatttttttgagacagagtcttgccctgtcacccaggctggagtgcagtggcgcaatctcagctcactgcaacctccgcctcccaggttcaagccattctcctgcctcagcttcccgagtagctgcgattacaggtgcccgccaccatgcctggctaatttttttgtatttttattagagagggggtttcaccatgtttgccaggatgctctcaaactcctgagctcaggtgatccacccgcctcggcctcccaaagtgctgggattacagatgtgagccacagcatccggccctattcttcccatttcttattagccctctaaagattccaccctgctgggatgagtcccatgattctcctctttcttttttctcttagtttcaccccatcactgttttcttcattcaccttatttattaataaccatttaaactttccaccttcctgggatgagtcctgtgactctcctctctgcctttccccagtcttttgttaattacgctcatgttttcattggtgcccatacaaaagaggctccctcagccatagcatttactacagccagagtaatggatgtattcagtgagtgaatatctcagtcatcataaagccagtcccacatggcctgcataggaaccaaatgagccgcttcacctggggtactccacttggcattgataggtagagttggacagtctctaccttctcagggtgtacagaccttacagtggcttttattccattcactaggctgactgttccctcaggaataactccctgtgtgtctggatcacattatacccattgttgattgttcagtagtgagctgtgggtcctgcatcaacccaaacatgcctgtccactctgcagcatttaaaaccaaagaaagtgccctaaattagttattctcacaatccattttagtaaaggattttcagtaaactgatgataccaatctatgaaatgagacaatttcttcacactgtaccctctggtttcagtagtttcttggttttgcccttccctcacatcaactaccttcgtggtaaccacaggtcgtagaggtactgtcatccctgtataatttttcctttgggggtcagcttgaaggctagtggcctgggctcagatagactgaaatctgagcttggtctagcatcaaggcctcatccagcatttgtttcatttctgttcagctattacagacaaccaccaccaagggagtgaatatttcatctttttcttactagtttgcatatccttatgcatccagtgaaccaactccctgagttggatccatctctaaattccactggtaacttttacctttagcaattgattgcgacacagttgcagctccaaaccatggaagaccacgataatgaaccaggaatcaaaggttcctcatctcccaccctttcattctttctcttcccaaaccacatatttctgtgagccagggccgttctagcaaaccctacttcactgacactaactgaaggtggaaaaactcagaactgttttcctctgctctcgcaccacacaacaacaacaatcaacacacaagacttctttcaccaaatgtgtggggatttctccccattaagaagcaagtaatcagccctgctgctgggtattctctaattcaattctgacactatagtatcacatcccacagtttgagggcttggtccccaaggcctccccttcccaccctttcagacaccagtcacaagtccaggcctccagaatgtcagactgactggctacaaatcagagatcctacacctgctctttgggttccattaatttgttagatcagctcacagaagtcagggaaacacttttaccattgtgttataaagaaaattacaaaggatacagatgaagagatgcattgatggaggtataggggtgaagtgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaaggtgatgacatggaatagtattacaggacaattttgagatttcagtggatcttgattctccttaagaatattacttctcagcctgggcaacatagggaaatcccgtctctacaaaaataaaaattaaaaaattagccaagcgtggtggtgcgcacctgcagtcccagtgactcaggagcctgaggtgggaggactgctacttcaaaaatatgcattcacctctctgatactcagtgctagttattcctgatttcccctagaaaagagtagtgaacaatttttagatactttctttgttttgttttgttttttatttgtttgttttgccctcccagatatataatgaacactttagaggtaattcctatttctcctttacttttctcactttctccataacggggatcttttgttcattcaaagctggtttaaatgccaaataacaatgaaaatggcaggcattttagtcatttttcaaatctcttagaaggtggtttaacattataccatacctacttacagtgctttcaaagcttatcttggctaatagcatatttatttttggaaacctttgttcctgccaatgattatagttctcgttctaagtaatttgagcttaatacataataaatttctagcacaagaaagacaaaaaatgtcagtaacttaaatgaaaaagtttaagacggctctttgagctgagtatcgcatgccatgtctaaacaacagtttaacttcactacttatgtcatctgaagatggaaaaactcaattagaatgttatccagctggtaagagcaggcttatgttatatttcagtatttgtccatgtgtatttataaatcattactgtggatgtaagaggtatttttttagaatggttgaaatttaaatatgaaaaacacctggataccttgcaaattgaagaaataaaatgatactggttgcagtggcttgagcctatagttgtctcagctacttgagaggctgagtaagtaattactgagtaattactctaagtaattagagtaaggtgggaggattacttgagcccaggagtgaaaggctgcagtgagctacgaccatgccactgtactccaacctgggagacagagcaaaaccctgtctccacaaaaagaaaaaaaaaaacaaataagatgaagaaaaactttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatggaaaacaaaaaaaaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacctagattcaaaaagcaggtccttagagacctaaaaagagacttagactcccacacaataataatgggagactttaacaccccactgtcaatatcagacagatcaacgagagaaaaagttaacaaggatatccaggaattgaactcagctctgcaccaagcagacctaatagacatctacagaactctccaccccaaatcaacagaatacacattcttctcagcaccacattgcacattccaaaattgaccacacagttggaagtaaagcactcctcagcaaatgtaaaagaacagaaattataacaaactgtctctcagaccagtgcaatcaaactagaactcaggatgaagaaactcactcaaaactgctcaactacatggaaactgaacatcctgctcctgaatgactactgggtacataacaaaatgaaggcagaaataaagatgttctttgaagccaatgagaacaaagacacaacatactagaatctctgggacacatttaaagcagggtgtagtgggaaatttatagcactaaatgcccacaagagaaagcaagaaagatctaaaattgacaccctaacatcacaattgaaagagaactagagaaacaagagcaaacacaattcaaaagctagcagaaggcaagaaataactaagatcagagcagaactgaaggaaatagagacacaaaaaacccttcaaaaaaataaatgaatccaggagctggttttttgaaaagatcaacaaaattgatacaccgctagcaagactaataagaaaagagagaagaatcaaatagacgcaataaaaaatgataaaggggatatcaccaccaatcccacagaaatacaaactaccatcagagaatactataaacacctctactcaaataaactagaaaatctagaagaaatggataaattcctggacacatacaccctcccaagactaaaccaggaagaagttgaatccctgaatagaccaataacaggctctgaaattgaggcaataattaatagcctaccaagcaaaaaagtccaggaccagatggattcacagcccaattctaccagaggtacaaggaggagctggtaccattccttctgaaactattccaatcaatagaaaaagagggaatcctccctaactcattttatgaggtcagcatcatcctgataccaaagcctggcagagacacaacaaaaaaaaggagaattttagaccaatatctatcgggggacttgccccgataatcacgtaggttcttttctatttttcttaagcgtcggccggcatgataaataaagggacagagtacaaaagagagaaattttaaagctgggcatccaggggagacgtcacacgttggtaggatctgtgatgcctttcgagccacaaaaactagcaagtttttattagggattttcaaaaggggagggagtatgcgaataggtgtgggtgacagacatcaagtacttaacagggtaatagaatattacaaggcaagtggaggcagggcgagatcacaggaccacaggactgaggcgaaattaaaattgctaatgaagtttcaggcactattgtcattgataacatcttatcaggagacagggttttgagatcaactggtctgactaaaatctattaggcgggaatttcctcttcctaataagcctgggagtgctatgggagactggagtctatcttacctctgcaatcttgaccataagagacaggtacgcctcggggtgggcgggggccagttcaaagacttactcctaggtgcgcattctctttctcagggacgttccatgctgagaaaaagaattcagcgatatttctcccatttgcttttgaaagaagagaaatatggctctgttctgcctggctctccagcagtcagagtttaaggttatctctcgtattccttgaacaattgctgttatcctgttcttttttcaaggtgcctacatttcatgttgctcaaacacacatgctgtacaatttgtgcagttaatgcaattattacagggtcctaaggtgacatagccttaggctgacaggattaagagattaaagacaggcataggaaatcacaagggtattgattggggaagtgataagtgtctatgaaatctttacaatttatgtttagagattgcagtaaagacaggcataagaaattacaaaagtattaatttggggaactaataaatgtctataaactcttcacaatccacgtttttctgccatggtttcagccggtccttctgtttggggtctctgacttcctgcaacatctctccctttctttttatataaatgtgccatggcgatgaaggcttgttcgttctctcgattttgacgcaggattctttgactggtccagcacactaaaaacaaaccgattaaacagagaaacttaattctaaaatttactacagtggagcccccaataggcttaatctaagtcgtggggtttaatctataaagattttctgccacctgatctaacgcctcagctccaggcagaatggataagtgagcttgagaggcttcaaaaatttgtttctttaattatgtctaatgataaattatcttctttacctagaaggtgtcctttgactttttcctatgaattatcagtctcattataggaatacggggtgatgcagaaatccgaagtattccaatcgcactgcatttgcaatgcgatgttcgagactcactacttgatctctaagccaaataacagactgtcttaaatcattaatttgatttgccaatttttgatcgatgccttgttgagaattccacatttgggtggaattggcttgccaatcattaacaaaatgagccctttgaatagattggtgtaatgccattctagcagtggtggccattgcagtgacagtaattaggcctatgataacagcaattaaagtgaaaacaaatctcttagatctttttttagaattcgctgtagcacttcattaattaaatgtattgagggggaggatacctaaggtctaggtaaagttaccggaacctagattccttcttgagctcgaaccaacattacacttttcctggagtcaaaatgggagttaatacaagtgtatagatgacaattgatgcatcggacggtttgattattcgtctaaattttgatatttcctactaacagtgtgtaaggaggcttaacacaactctgtatgggaatagtcaggttggaggtaagtaaagcagaatgtctgggtctacgttgatactgagagagtgggatggtaatgggaacaacagtcgaaatagttttcttttcctatactggcagtccagacatggcaatagccaatttttaaagttctgggtgttctgggctcagaatggggagtatcatacgaggcctgggggtgggtaatgcctttatcttcctattttaagagaaagaatgagctgatcctcgtatgcacagtagaatgatgattctcattctcctgataagaagtaaaataagtagcctccaggcattcctttccaccagaggagcaattgttttttaaatagccttttggtgcctagtctattactagaccatatgagtcattttttagtattactgcatgtgagttaacacagtcttcctaaattaaagttttagatgggccctcaaaatttttagggcatggttttcctgcaggtttatattgaaagtatggggtatctcctattactcctcctttcatttgttttaaaggagaaagggagagaccagagactaaatgtcctgttttatctgtagctgatgtttccggaagataagcagcctagacttgagttcgtagatggatgcaactaggtgcatgtccgaggcacagaggggggtatttataacctatggtaacattaaatgcagtgccttcttctcctggttgagcagggcaacggtcatctgtggctctaggcatccacacactatcgttagtgtagatttctgcaggagcatctatctaggtgagaggtcgaataagtggaggaaaaggcacataagcctaataagaataattatgtgtagcaggtaaatcagtgtgagaggaaactggtgagacagaaagtataaggaggagaatcattaaataaaacctagtgtaagcgagattgagtgctgaaggaggaagagaagaacagagggatgttattttcaggctaatagaaatggtgagatttttaggtttgtaaggagaaaaagaaaagtaatcaggagaagtgggattagttagatgggtctccattgccttcagggaggattgatttacacctattgtgatttgatgtgcctgtttctgaggaatcagcacagatctcatcatatctgaaggcagtctctgacacagacgtcttttctctgtggttttgattgtcagtattcacctgaagcttgagtcttctggtgggtacttagacaggggattgatgatctcctggtgaaacacaagcatatcctcttcctcatgttataattgtgccaggttcctaggtattggtttgggagtttttccataacactggcttgccttcgtttaaggaaaattttttgcctgtataatggcattcggctgcagttagagtattatctttaggaacatttaaaaaatttaaagtaaacaatgccaaatgtaattgggagtggggagttgttaaatcatgttttggttgttcagactgttgggacaattgggtttttaaagtgcgattgtaagggattctagtagtaggatctgtgatgcctttcaagccacaaaaactagcaagtttttattaaggattttcaaaagaggaaggagtgtgcgaataggtgtaggtgacagacatcaagtacttaacagggtaatagaatattacaaggcaagtggaggcaaggcgagatcacaggaccacaggactgaggcgaatttaaaattgctaatgaagtttcaggcactattgtcattgataacatcttatcaggagacaaggttttgagatcaactggtctgactaaaatttattaggcaagaatttcctcttcctaatgagcctaagagcctataggagactagagtctatcttacctctgcaatcttgaccataagagacaagtacgcctcaagggggccagttcaaagacttactcctaggtgcgcattctctttctcaaggacgttccatgctgagaaaaagaattcagcgatatttctcccatttgcttttgaaagaagagaaatatggctctgttctgcctggctcaccagcagtcagagtttaaggttatctctcgtattccttgaacaattgctgttatcctgttctttttttgaggtgcctacatttcatattgctcaaacacacatgctgtacaatttgtgcagttaatgcaattattacaaggtcctaaggtgacatacatctttctcggctgacaggattaagagattaaagtaaagacaggcataggaaatcacaaaggtattgattaaagaagtgataagtgtctatgaaatctttacaatttatgtttaaagattgcagtaaagacaggcataagaaattacaaaagtattaatttgaggaactaataaatgtctataaaatcttcataatccacgttcttctgccatagtttcagccagtccttctgtttaaggtctctgacttcctgcaacaaatatccctgatgaacatcaatgcaaaaatcctcaataaaatactggtaaaccgaatacagcagcacatcaaaaagcttatccaccacgatcaagtcagcttcatccctgggatgcaaggctggttcaacatatgcaaatcaataaacataatccatcatataaacagaaccaacaacaaaaaccacatgattacctcaatagatgcagaaaaggcctttgacaaaattcaacagcgcttcatgctaaaaactctcaataaactaggtattgatggaacttatctcaaaatagtaagagctatttatgacaaacccacagccaatatcatactgaatgggcaaaaactggaagcattccctttgaaaactggcacaagacaggaatgccctctctcaccactcctattcaacatagtgttggaagttctggccagggcaatcaggcaagagaaagaaataaaaggtattcgattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaatagagagccaaatcatgagtgaactcccattcacaattgcttcaaagagaataaaatacctaggaatccaacttacaaaggatgtgaaggacctcttcaaggagagctacaaaccactgctcaatgaaataaatgaggacacaaacaaatggaagaatattccatgcttatggataggaagaatcaatatcatgaaaatggccatactgcccaaagtaatttatagattcaatgccatccccatcaagctaccaatgactttcttcacagaattggaaaaactactttaaagttcacatggacccaaaaaagagcccgcattgccaagacaatcaatcctaagcaaaaagaacaaagctggaggcatcacactacctgacttcaaactatactacaaggctacagtaaccaaaacagcatggtactggtaccaaaacagcatggtactcgtaccaaaacagagatatagaccaatggaacagaacagagccctcagaaataataccacacaactacaaccatctgatctttgacaaacctgagaaaaacaagcaatggggaaaggattccctatttaataaatggtgctgggaaaactgggtagccatatgtagaaagctgaaactggatcccttccttacaccttatacaaaaattaattcaagatggattaaagacttaaatgttagacctaaaaccataaaaaccctagaagaaagcctagacagtaccattcaggacataggcatgggcaaggacttcatgactaaaacaccaaaagtaatggcaacaaaatccaaaattgacaaatgggatctaattaagctaaagagcttctgcacagcaaaataaactactgtcagagtgaacaggcaacctacagaatgggagaaaatttttacaatctacccatctgacaaagggctaatatccagaatctacaaagaacttaaacaaatttacaagaaaaaaatcaaacaaccccatcaaaaagtgggtgaaggatatgaacagacacttctcaaaagaagacatttatgcagccaacagacacctgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaaaacttttacactgttggtgggactgtaaactagttcaaccattgtggaagacagtatggcaattcctcaaggatctagaaccagaaataccatttgacccagccgtcccattactgggtatataaccaaaggattataaatcatgctgctataaagacacatgcacacgtctgtttattacagcactattcacaatagcaaagacttggaaccaacccaaatgtccatcattgatagactggattaagaaaatgtggcgcatatacaccatggaatactatgcaaccttaaaaaagggtgagttcatgtcctttgcagggacatggatgaagctggaaaccatcattctcagcaaactatcagaaggacagaaaaccaaacaccacatgttctcactcataggtgggatttgaacaatgagaacacttggacacagggtggggaacatcacacactggggcctgtcgtcgggtcgggggaggggagagggatagcattaggagatatacctaatgtaaatgacgagttaatgggtgcagcacaccaacatggcacatgtatactataagtaacaaacctgcacgttgtgcacatgtaccctagaacttaaagtataataaaaaaaactataacatgaaaaaaataaataaaagtaaagttttttaattaaaaaaaagataggaattatttctttgataaaaccaccaaaaaaaagttctattcacttatttcacatcaaaaaagaatttgagtgttagaccaagtaatatgttaatgtcttatgactgttaaatgatacctatttaacacctttatctctctgaattaatgatacttggtgtgaatatttattccaacaaaagtaggccatctaagattatattttcctcacagatggttgagctcttctcacaccctctatagccttaatatatagactgtaaagtatactgtcattttaaaaaaagtgaaaaggatatttatatcaggctaatcaatttgaattttgggtaatgaacacaccaattacccgtgttttccaaatctcatgtgcacaagggactatgaatcatgtacttcattaaagtgcaaggcacattactattgaattttttctgaattcatattacattattattattagtgtcaggagatactatttaattcagaaaaaacagcctggacaacatggtgaaactccgtctctactaaaaatacaaaaattagccgggcgtgatagcgcatgcctgtaatcccagctacttgggaggctgaggcacgagaatagcttgaactgagaatgtggaggttgcagtgagccaagatcatgctactgcactccagcctgggcaacaagagtgagtctctgtctcaaaaaaaaaaaaaaaaaaaaaaaaagacgagataccttaacagacttttttttaaatcttgtgattttactagcttagaaaataattgatatcataattgaagcataattttatttaaaaaaatacattttgactctgtcctcacctctctttccacatcaccttagtgaatggtgagcagaaaaggtgtttgctaaaaatagagttcacagtcagatatgtagtaaacttaaacatatttgcaatatgtaaagaattctcaaaactcaataataagaaaacatacaaacaacccaattcaaaatgagaaaagatttgaacagatacttcaacaaagaagataatacagatggcagataagcacaggaaaagatgttcatcattagtcattaggggaatgcaaattaatgccacaatgagatacctgtaaacatgttttacagtggctaaaatcaaaaagactgaccataccaattgttgacaaagatatagaacaatggaggccaggtgcggtggctcacacctgtaatcccagcactttgagaggccaagacaggcagatcacaaggtcaggagatcgagaccagcctggccaatatggtgaaaccccatctctactaaatatgtaaaaattagccaggcgtggtggcaggcgcctgtagtcccagctactcaggaggctgaggcagaagaatcgcttgaacccaggaggcagaagttgcagtgagccgagatcatgccactgccctccagcctaggcgacagagcaagactccatttcaaaaaaaaaaagaacaatggaaactcataacactgttagtaggaacgtaaaatggtataaccactttggaaaacagtttggcagtttcttaaaagttaaacatactcctatcatatagcccaggcattctactccttagtatttacctaagaaaaatgaaacacatcttcatacaaagacattaatattcatagcaactttatgtgtaatagccaaaaaatggaaacaactcagggtccatcagcaggtgaaaggataaattatgatacatgcatacaatggaataccactcagtgttaaaaaggaatgaactattgatacatgcaacaacatggatagattcaaaatcattatgctatatgaaagaagctggacaataatgagcacatactatatgattcaatttatataaaagtctagaaaatgcaaactaagtgacagaaagtagatcagtggctgactggggatggggatgggggctacaaaagggcatgaagatacttttgagcatgatggatgtgttcattatcttgatcatggtaatggttttatggttgtaaatatatgtcaaaacttatcaaattgtacattttaaatgtgcagcttattgtatgtaattatacctcagaaaagctttttggagaaaacaaaaaaatatatattcagagtctatctctctttcaccctttttattatttccagctggtttcatccaccatcatctttcacctggattactgtaaaagcctcctaactagtcttcccgctttttttttttttttaaaccctcatctccttccaatctattctcggcaaaactactaatgtttatttacagttcagggttgaaggctgggcgtggtggctcgcgcctgtaatccgagcactttgggaggccaaggcaggcagatcacgaggccaagagatcaagaccatcctgcccaacatggtgaaaccccgtctctactaaaaatacaaaaattagctgggcgtggtggtgcacacctgtagtcccagctactcgggaggctgaggcaggagatttgcttgaacctgagaggcagaggttgcagtgagccgagattgcgccactgcattccagcctggcgacagagtgagactccatctcaaaaaaaaaaaaaaaaagttgagggttgaaaatttacctattagttctgtaattgctctggcttggatatcttgtactgtgttgaataaaagtgagggaaaacaagaaaaattacctattgaatacagtgttcactatttgaatgatgggcacactagaagccaaacctcactgttatgcaatataaccatatagcaaacctgcatatgtaaccccagaatctataaaaataaagtcagatcatgtcactctagctcaagaccctccactggcttcctctcctactcagaataaaagccaaaggcccgcatggcctaccccagccttgtcatctctctgatctgacccgctattctccttgaccccttcacatcacttcacacacattggtctcctggctacttcttgaaaattccaaacatactccctccattgggcctttgcattggttattttctctgcctagaccactccctcacctcttctaaatgtcactttctccattgggcctactctgaccacccaatttgtttttgtttttgttttttagaaatggggtcatgctctgttgcccaggctggagtgcagttgcagtcatggctcactgcagccctgacctcatgggttgaagcaatcctcagcctcccaagtagctgggattacaggtgcatgccaccacgcctggctaattttttaattttttcatagagacaggttcttgctagatcttgaactcctagcctcaagtgatcctcccatctcagcctcccaaagtgctgggattacaggtatgagccaccacacccagccaaccaccctattttaaatatcaaggtacccaatccctcttacctgctttacttttttgccttattccatagtacttttgacatactctacaatttaccttttttgtgttttctcatcttcttgcactagaatatgatctacatgagggctggaatctttgttggttttcctcatgtatgccaaatgcataggacaatgcctggcatataatcagctcttgaaatatttatgaaattaatgagtgcttatagcatatgaatcctcaagatacattggcaaattagagtaggaccaaagtggggagaagagtaagaagaggtttaaaatacacatgagggaccaggcacagtggctcacacctgtaatcccagcactttgggaggccaaggtgggaggaccccgtgtgagtccaggagttcaagaccagcctgggcaacatggcaaaaccccatctctacaaaaaatacaaaacttagccaggcatggtggcacttgcctgtagtcccagctactcaggaggctgaggtgggaggattgcctgagccagggaggtcgaggctgtggtgagccaggatctcaccactgcactccagcctgggcgacagaatgagaccctgtctctaaaaatatataaataaataatgggggattcatttatttttgagacagggtcttaacgctgtcacctaagctgcagtacaatggtgagatcctagctcaccacagcctcaacctcccaggctccaacaatcttcctgcctcagcctcccaaagtgctgggattacaggtgtgagccaccacacctggcttgcagtgagctatgatcagcccactacactctagcctgggcaacagaggaagaccctgtctcaaaaaaaaaaaaaaaaaaaaaaaaaaaaaaaagcgtgtcctaattagaagagtctgtaattgttatagtccatgacaacgtagaatgctgaatcagttgtggaattgatttttcaaatgcttgttttacctggcaaatcatgtcaaaggtaacctgaggccaggcagagtggcttacacctgtaaatcccagcactctgggaggccgaggcggaaggatcgcttgagctcaggagtttgagaccaacctgggcaacatagcaatactccttctctattaaaaaaaataaaattagccaggctggtgcacttatatcccagctactcaggaggctgaggtgggaggatcactttgagcccaggggtttgaggctgcagtgaggtatgattgtgccactgcacgccaacctgggcgacagagtgaaaccctgtctcaaaaaaaaaaaagtaacaatgcctttataataattacgatttgttattttagccacatagccatatatatgaaatttacgtgacctattatttcagccctttattgctgaaaatgaaatattattttattactatcagtttaaccttaatatccctcatttcagattgcttaccagtatcatggaataaaatctccaatctaaaattcaatctgagttttatatttaagaattttagctttattatttgttttagattaagcttctgcacttttttaaacggttatatatgttcattatctttcatcttacataggagcgggatcgttacgcctacaagattcatcttccagaaacagtagagcagctgaggaaattcaatgcaaggaggaaactaaaggtaaattaaacaaatcagcaaaaaagccaaacagatatagttaatgatcatgtttttattctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttttcaaacttaaatattttgacaaatgtatgtttagttcaatggaaataactttgaattagaattggaattaggggccgggtgtggtggcttatgcctgtaatcccagcactttgggaggccgaggcgggcggattgcctgaggtcaggagttcaagaccagcctggctaacatggtgaaaccccgtctctactaaaaatacaaaaattagctgggcctggtggcaggcgcctataatcccagctactcgggaggctgaggcaggagaattgcttgaacttgggaggtggaggttgcagtgagctgagatcacaccattgcactccagcttaggcaacaagagcaagacttcatctcaaaaaaaaaaaaaaaaaaaaaaaagaattggaactaggattgaacaactatcagaaagcagtaaataaaatcttacactaccttgatctactagaaaatattttcagctcagatcacttttctcaccttctttattcttcctaggtgtctttctccctcttactactctccctatcctccacctcaccaaaaaaaaaaaaaaaaaagaagaagaagaaaagaaaactggtaatcaccccatatggggagtccatttgactttaaaaggttctgaaaaagaccagacataaagtaatggaatcttttcagcactgagagaaaatgctgagagaccatcccccacccaaccctccagagtaacaaagggaaattgattatcttaacttcttagaattaatttatgtttgacttacttttgatactgaaaaatgttaactgttctctaagtggttgattagatagtagtcttccttagtcacatgactcctgccaactataaaacttttcttcttaagtattttcagatatgccataaattctaataataccattttatttttcaacccctgaaattagtgaattattatgtataactctagacttataaaaacatttatatgaattttgaggaaactattaggctacaatattatcctatagacctgaaacttttaacatggtacccactggccacatgcagctatttaaatttaaattaattaaaattaaataaaattaaaaggtcagtttcccagtcacactagcacatttcaagtgctcagtaaccacagttggctagtggctactatattagacagcacagatgtagcttgggacatttccatcattacagaaggatctattcaaccatgctactatagaacaagggaaatattaacatatcattgttggtgttgattattcccattttagcctttcttctcactgattttgcagtcaagggttcaaagtgactcttctctatttgctttaaaaatccttggccaaaataattattaatgataagccattattgagatggtagccaaagaagtttcccaaaacttttattctttttgccttgatatccacctaaacctgtgtagcctacaaataaaaaactcttttattattcaaagtgaaatttggtcaactgtttttgaagttagtttcctccccaaagaaactattattacacttttttgtcaacttttctataagtcattctaaacctaattgctttggcctcatgtgacattacgctgtatggggttgaacctttcattgcccaaatacaaacatttcaccagagagcttgggcttgccccatcacaagaaacacatgctgtacttctcccggggccacagaatcagacttgggcctaaaatagccaaagtggtgactaagattcatttggacagggccaagctgtcaaaacagagaggggtcatgtggatttaccacatccccttgcagggctatttaaagttttaagacccaccaaacaacctagaactaggaacatcagcagggtcattagtgaatgtgtttggcttctgataaggctgtattcttttgagtagttcagccaccttgttaaaacatgttacacctaccatcctcaaggaactaattcccattctgcctcttcagtggacttctagaacagagattgcaacttccttggctttcagagtccaccacacactttattttcacacaactaggtgctcatcctacccagacactattcttaacctcctcagtggtgggtgacagtttaatttgtaatgactcccttggaagtgattaaaagggagttcacagaaagcggtagaaaattacttttgtggccaggcacagtgtttcacacctgtaatcctagtacatttggaggccaaggcgggcaaatcgcttgagctcaggagttcaagaccagcctgggcaacatggtgaaaccccgtctctacaaaatatacaaaaattaaccaagtgtggtggctgtgcatgcctgtaatcccagctattgggggcctgaggcaagaggatcacttgagcctgggaggcggaggttgcagtgagccaagatcacgccactgcactccagcctgggtgacaaagtgagaccttgtctcaaaaaaaaaaagagaaaaaagaaagaaagaaaattactttggtaacttagtcatgatggaatgatggaaaatgtattttccccattttggttaccacatgtttcatgtgtcgagttttttcctcctaattcatactaagctctggaattgtaatacttcattaaaaaaaaataaaaaaaaagaatcctctagataacaatactttctttaataaactacatcgttctgagcacagaactgaatatgaggacattttctcaaactgaatattaggatacatgagacagactgcatgatctccaggctgtgtggaaaatctgtgctctgtggtctggggcttttgagggggcacacctgtactctaaccctggctgtcatctactgaaggaggtactgaggaaagtggtaactgttgttatctgaggatgtctatccagagaagagactcaggagggaatgtattctgaagtcatccctattgcttcttcaattatttctacccctagaaagcaaattccccacagtgaagtgtgttgaagaaattctatacaaatagaagcaatattctatgtttgggtaagtttattgcagtccatttaagaaatggtgagtcgagtccacgtgattcagttaagaggataaaatcatttatttcctatatatacagaaagcaaggatttctaataactttctacagtttttctttattattattattatttttttttttttttttgagagagtcttactccatcacccaggcttagagtgcagtggcgcaatctcggctcactgcagcctccgcctcccaggttcaagtgattatcctgcctcagcctcccaagtagctgggactacaggcaccaccacatccagctaatttttgtatttttagtagagacgggatttcaccatgttggccaggctggctttgtactcctgacctcaagtgatccgcccgcctcggcctcccaaagtgctgggattacaggcataagccaccgcgcccagcctttattaattttgcaaattgcaaaagtattctctgacttactgattggtcacttgtgttcctgaactgtgcataactacgaaaggtttgtttaggagtgccattttctaatactgtataaagctgtactatccagtacagtagtaaatagccatatgtaactgtttacatttcaattttaataaattaatattaaataaaaagtaaaatttggttgctctgttgcgctagcacctttcaaatgctcaataccacgtgtgactgatggctactgtattagacagcacaggtttagaaaatttccttcatcacagatagttctattgtatggtattgctatagagtcttggtaactgcagagtaatgcttatacataagcagcactttttgataggtcaaccaggaagctataatagatattttttggcaattttctttctgttagttcaacaaaaactaacttaaagatttatcaaagacctttgtaccgtaatgaaacccagcatttacatacagtcctctctgtagtaagggtttgtacaaaggcagtaaattgagatagcagtcgttgtgggcttcagctaatcagagcattaaatctggtatccaaaaggtaacctttgagcctgagcaacataaggagaccccggctctacaaaaataaaaaatttgccgggtgtggttgcacacgcctgtggtcccagctacttggaaggctgaggtgggaggatcacttgagcctgggaggtcaaggctgcagtgagctgtgatcacaccactgcactccagcctgagtgacagagtaagactctgtctcaaaaataagcggggtggggaccttaattctaaaaactgaaaacttattctggtatgagcagttccgcaaatattctggtatgaacagttccacaaataataagtgaagtgattttgatcttacatattgattttacaaatcaattaatttgtgattttttttaagaaatacatatataggccaggcacggtggctcacgcctataatcccagcactttgagaggctgaggcgggcggatcacctgaggtcaggagttcgagaccagcctgaccaacatggagaaacgccatctctactaaaaaaaatacaaaattagctgggcatggtggcacatgtttgtaatcccagctactcgggaggctgaggcaggagaattgcttgaacctgggaggcggaggttgcagtgagccaaggttgcaccattgcactccagcctgggcaacaagagcgaaattctatctcaaaacaaaaaaagaaaagaaatacatatatagatatatgttgttttttcttttttaattgagacagggtctcactctgttgcccaggctggtctcaaactcctggactgaagcaatcctcccaccttggcctcccaaagtgctgggattacaagtgtgagccaccatgtcccaccagtttatgattctgaaatgtagaatatattacttcctgttgggcaatagattttgaaaattatgtacatttaagaccatctctataaaatacttttacatagacccaaaagaatttctaagatatctattctgtgcaattactcttaaatataactatatctagtacacttacaagtctcatttttcattttctctagagaaaatactgcagcctcttttagtcatatatcctgactgaaaattatgaaattaaaggttttagacctatgtttaggttatgtttgagtattatatatgtataggctatgctgactaaactgaatgataactctggttttggctatatggagacatatcaaaagttctgatttaattaatcatctcacctaattatcatctaggacctaattattaagtataatcaacccaaattctttaacatctctaccttgaaatgattttcttgacttttggtcatctctgttcagcctcaacctctccaaattctccaccctttttagggcttttgagttcagtcgtctgaattctaataggatgattatctttcaaatttctttgtcacactcctattggtatgttctggtgatacactttctcccctcagtatatttccctgttcactcaggaatatgactatatattaccttgttatttaggtacaaagccaattattctatatctgatacttgtatattttgtatttagatgttttaaaatgtaccctcctgccatgactgtgtattgccttgttatttaggtacaaaaccaattattttatatccaatacttgtgtattttgtatttaaggtttaaaaatgtacccttctgccattgtgcctatcaaacttcatgatgcgtgtttctgagctcaggaaataccaaaaagggagtattcggtttttggtttttgtcttcaagtcagcaatacatctttgttcagctcttgtgttcctcaataactttgttccctccttaagtgcattcagtagttaaacttagcagaaatctgacctaaccattttcttgttttccacttccttaaatgccacacagaatcatctagccagaagcataccattttgatgtttgacatattgacatttcaagaaaactataattatgattaagaattatttctagttcttaactacaaattaaaaacttgtggtgctctttttctctgaatttataatctgccttctcctttctaggttaatttgcttgatagaaaattacaactttaatattatttatcttaacagattgtgaatagtctaattaactcaaaagtattatgtttcgcccttaaaagatactaaattataccttctaaattaaagcaggtagaaaacttctttgtcaagggtttaataaaccagaaagtttgaagaactacttgtataaaatctgattttttaattgttgtattacattattgctatcgatgagcaatattacattattagcaatcagtagcaataatgtaatacaggggttggcaaactatgacctgggggtcaaatccaacccactgcctattcttgtatataaagttttattagaacatagcaaagtacattaatttgcatattgtccatggctgctttcacactacagtggtagaactgagtagttgcaaaagagatcatatgacctttagagcctaaaatacttactgtctgattatttacagaaaaaaaattgctgacccctagtatagtagaaatccttgaactggggagagtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattatttaaaaaaaaaacaaactacgtaaacaaaactgctagtcataagacagataaatttaaagcatactactattgtttcaaaagcatttgcatctcagggctcttttagatactgttttcctagtagtataggtatttattacagatctttgacaatagtagcaagaacaggccttgaagcgtataactaacatcttaagaaatacagttgtacttcatttggaaataaaaataaagcatctctaaaagcctagtttccgtgtgtgggaaacgtgatttgatatataaaaattccattcccacccagcttttaggaaacatgtataatacgtaaagtaaaataagtttttataaaaagaagaactcaacattcactactgttttttcaacatggtaactataattctgcataagaacctttcatgcgtaactttagactttcagaaatctcaaaagttacctggaatgttaacatcaatatcacttctctctttttgcccttccctttctacagtaagtaaactttgtggaaatatattttattaatgttttctggccaggcgcagtggctcacaccagtaatcccagcactttgggaggccgaggtgggtggatcacttgagcgcaggagttcaggaccagcctgggcaacatggtgaaaccccatctctacaaaaaaatacaaaagttagccaggcatggtggcacacgcctgtagtcccagctacttgggagactgagatgggaggatcacttgagcctgagaggttgagactgcaaagagccgagattgtgccattgcactccagcctgggcaacagagcgagaccctgtctcaaaaaaataataataatgttctcatattagcagatacctaaacacaaacaagttttatctttccagaaaaattcaagagttaatatttaaaatttagacttagactacttaggtgatttgataaactaactaaatgagtgattctacatagaccagcaaaaggctgtgctcatgttctagatctttattagtagagttagtaatgatatgcacttacagaatgctttacaatttgcaaagcactttcattaatacattatgacttttgccaatcctgtaagataagtccattttaatattctttttttttcttttttgagacggagtttcacttttgttgcccaggctggagtgcaatggcacgatctcggctcaccgcaacctctgcctcccgggttcaagcaattctcctgcctcagcctcccaagtagctgaaattacaggcatgcgccaccatgccgggctaattttctgtatttttagtagagacggggtttctccgtgttggtcaggctgatctcaaactcccgacctcaggtgttccacccgcctcggcctcccaaagtgctgggattgcaggcgtgagccaccgcgtccagcccgttttcatattcttactttacagataagaaagcctagagaggttaaatgatttactcccaaataccacatgttctcccttataagtgggaactaagctatgggtacacagaggcatgcagagtagtataatggacactagagactcagaataggggagggtggaggggcaagggatagaaaatcacctgttgggtacactgtacactactcagaagacagattcactaaaagcccacacttcactactgtaccatttatccatgtaaccaaaaaccacttgtacccctaaagctgtttaaataaaaaataaaataaatatgatttactgaagcagtaactcccaacatttttccactctacagtcctaagggatgtcatgcactcaaatggcagtgatttccaactaggaataaggggaggctatgcatatagcttaaaagagtcatatgtagttgattctgttgtgtggcctgatggagaattactatacaaaagtaagacattgtcattgttaaaacaaaaagagggaaaaaagattttaaaaagaaaaatgacacataatcctaccacccagagataattaataacattctggtgtatatgcagtcttttatatccatattaacttttttacccaaaaatgagattataatatacattgattttaaacctttttcatgtaattaatcacagacatcttttcattccactaaacacccttctacaacatcattttataataactgcagaatattccatcctgtgttacatgtttgaattcaagatgtaagtggtttcatatacttctacaattcccgattagtgttattctggtatatgcatatgtaatttatttcaaggaatctgaaataatttaaaaactacctctcttctagccatcatctcctatatatttgacttaatggataatccttaagataaataatttgttaaataacttatttatatttgtgtatttgttttaataatctattttttcatctctttgttttagggtgcagtactagccgctgtgtcaagtcacaaattcaactcattctatggggatccccctgaagagttaccagatttctccgaagaccctacctcctcaggtaattggataattcacttattcacctgtgtgggtcatttggcatttacatccattctctcccattgtgaataaacttttcctgtgcatttagttaaatcctccaacggattctaaggaagtttgtcagcaaccaaatcctgtctacatgtgtcttgttccttttcattttaataccaaagttgctttctcctgtggctccaaaaccaacacttcatttttttttcttttcacctcagtaatacttcttcccctttccacactctagacccagcattgcactccatccaatccaacatcctagtcagtcttttgggatctttctgattaccttctctctcaacaaaaacttctaatataagcttttccccaggtcagtcgtattagatcagactgtgggcagcactgctttgaatggaatctttcagtgtagagctgtcttgtgagttatctcctgaaacagttaccaagttcttctttctgtataaaaatctataacacggccaggcatggtggctcatgcctgtaatcccagcactttgggaggccaaggcaggcagatcacctcaggtcaggagttcgagaccagcctggccaacatggcaaaaccccatctctgcaaaaacacaaaaatacaaaaaaaaaaaaaaaaaaaaaaaaaagccaggcgtgctggcctgcgcctgtagtcccagctacttgggaggctgaggcaggagaatcacttgacccgggaggcggaggttgcagtgatccgagatcatgccactgcactccagcctgggcgataatgcgagactccatctcaaaaaaagaaaaaaaaaatctgtaacacatgcatacaagtatccaaaggggaagaacacagaagagttatttgttttgatgaactgtatataagtacccctgaaacaacctgccagtgttcacaaaatcattttataagccagtgcagtggtgtgcatgtgtagtcatagctactcaggaggctgaggcacccggctcagggggatcacctgagctcaggagtttgaggatgcagtgagctgtgatcacaccactgctctccaacctggacaacaaaatgagacctcgcctcttaaaaattaagagataaaaggccaggcacagtggctcacgcctgtaatcccagcactttgggaggccgaggcgggcagatgatgaggtcaggagatcaagaccatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgctgacttggtcattatccagagcccttcccacatgaaaggcagggatctagttgtgtttataggtgtggtccccagtgcttcttattgtttcacgtctgtcttttcttccactccattttgttccctccacctgtaacttcttttgttagctgaaacctctgtcttctctcctcacactcagattacagtggaccctatttaaggggagtggatccagtaatggtttgtattgtcatactgtggctgtatgatataatcacatgcttataatatatttaggataaatctctttgagattttaggtcaagatctctactaccattttcatctttagaaatggagctaaaggctgggcatggtggctcatgcctgtaatcccaacagtttcagaagccaaggcaggaggattgcttgagcctaagagtttgtgaccagcctgggcaacatagggagaccctctactttgtaagaagtcaaaatattagccaagcgtggtagcacacacctgtggtcccagctactagggaggctgaggcaggaggatcacttgagcccaagaggtcaaggctgcagtaagccgtgagtgcatcactgtactcaaaactggatgacagaacaaaactctgtctcaaaaaaaagaaaaggggccaggcacagtggctcatgcctgtaatcccagcactttgggaggccgaggtgggtggatcacttgaggtcaggagtttgagaccagcctggccaacatggtgaaacccccatctctactaaaaatacaaaaattagccaggcatgatggccacgcgcctgtaatccacctgaggcaagagaattgcttgaacccaggacacggaggttgcaatgagccgagatcgtgccactgcactccagcctgggtgacagagcaagactccatctcaaaaacaaaaggaaaggaaaataaaaagagtaatactctatgcatttaggaaaatatgaatatttaaaataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctcaaaaaaaaaaaaaaaaaatcaatgttgaaatattcttttctcatatttcaaatcaagtaattcagaatcagaacccaacgtttgatgtctgaaatcccaaacagttccagtgattgtactcatggaacatgagggctcactttggggtcagctgggggaccatgcttctggtggctcatgtagtgggccgaactgtggcttgataacctgcttgttctaaaatcatactgtttgttgtttgtccatatgctgccttcctcctaggacttctagcagcagaaagtaggtatccctttgttttcctttaaggtgtatcttttatgcaaaagtgtttggctttgcatggttcgtaatcagcttgactttttccttggctgtttgtgtgtagttgtttaagtattaattttaacactgcctggtcataaaattaaaacttggatatattgatttttgaggcattgttgcacaaacaatattaagttctcacttctttcataagaggaaaaaagacagtgttaaaatttcaacggcatttaatacttcacatctgaatttcacatacgaatacattaattctggggaaagagtaacatttattttagagtttgctttcaagaaaactttcagggtaagtgaatttttctttgacaattacatcacctgtaagtggtctttattgcttcctgttactgagtccattttcagtttatttggacctgtgaaataaattctgaaatcatatctcttaacaacttttaccatcagatagaacatttataaggaataatgtaatagctagattttaattacaaaggggcataatttgagtttgggagaaaattaaaatgtaagaaatgtacacacagttgagtacatgtaaaactgaggcaatctgaataagatgggtggattgtatcaatgtcagtattctggttatgataatatactatcgttttgtaaaatgttaccaatgggggaactgagcaaagaatacaagggatctctctgtattatttcttacaagtgcatgtgaatctacaattatctcaataaaaattctaattaaaaaaataaacctttacctcaaagataaatgagaaagcctgggtactaatgattgaattcattttcacattttcttacattagttatctgtagctcaaattgcagctgatttaatataaatcttatagtatattagttacctattgttgggtaatgaattaccttaaaacagcagttgtcatctcacagttcctgtgggtcaggaatctgggcgtggcttagctgtgtgcctctggctcaagatctctcatgagattgtggtccagtgctgctatctcaccggaaggcacaactgcaggaggaatcctcttccaagctcactcacatggttgttgccaggcttcggttccttactggctgtggtcctcttcacagggctggctgttcacagcatggcagctcacttcccagcacgaaagataaaagaggggggcaaaagtgagagacagtgcccaagactgaagacacagtctttacagcctaatctcatagtgacgtcttatcacttctgcactattctgttcattagaaatgagtcagtaagtccagcctgcactccaggggaggggactgattacacaaggctggaaataccaggagaccaggttactggggcccatcttagaggctgcccaccacgtacaaattaataactattaaaatgtaagattcttcccgtctagatttagcgctcctcttttttttttttttaaatcagccaacctgtcatgttatttgagaatgggcatcttggatgtatcagtagtgattttccttagttgtaaagctttacacgagtgggtacttaatagcagaatgttattaaagtactttgaaaaatctgtgctcgaagatgtttctatatggaagcataaactattttaataatcataatggcattagagattataacatctatacgctgacagaatacatatgcagagtttacttcctttaataaatttcaaggtatctgtaccataatccacatatggagaatctaaagcatgtatcaccatatgtaagttctcataacttgagttggatatggcacagatgcttatgtccaaaatacagtttccattacaggattcattattgcttataacttgattgataacaaagaatttgctttgtgcagtgggaataaaaagtgttgaacagggtgtggtgatagagggaagagattggctgcaaagggacaagagagaacttttttgaagtgatgacagtgtacacttaaatggcgacttttaacttaaaacagtataccttagtaagcagattttttttaaaaagtattgtgcttgcaaggaggggctttgattgagtaggtgataatgtgtgtgtgtagtaatacaatgtattaattgatcgctaatataatagaaaaggtattgattactcttagaagaagctaggctaggttcagattctagatttgctcagtgatgctgagtttcatagctatacattgtaaattaagaaatacacacacattgagaatttaatgtgttattttgtgaaaatctgagaagcaggaatgggatttaatgatctcaactgtcatccatctgaaaaacctaacttgtgattttaaataagatggcatactgccttccactattcccttttaaaaacaggaaatgtccctgcttttatctttatgaagttttatttatgaataaagtttgtactatttaaaaaaaaaagaaatacacaaatctttattgaaacaattacagtgaaaacttgggtatatcaaaactcattgaatggtacacttaagatttgtgtatttcattctatgtaaattttacctcagagagaaaaataagcattgcaatctttgctgaagtctttaagggtgaagtgtactaatgctggccactgccatttaatttgaaatgaatgaaaaatacgtgaactgatggatagatgggtagacatgtgataaagcaaatacagcaaactgtcaacatatgtaggatctaggtggtgggcacgattctttcaaactttctgtatgtttgaagcttttcgtagtaaaatgtaaggggaaaaacttttaagacatactcagcctactttaacactgagaactttttagtctaaacatttgactgtttatttttctgtcctccttttggtttatttttacttggtcaacctttttatgagacttccactctcgtaatgagattattctagactcaaagcttttattgaccttaaaagcatatttctctttaaagaaatagaaacattttttaaacagttgacatatttatgctttttttgactattatttcataatagtagcagaaaacttttgaaaaacttgtttgtactggtgagattatttgaaaaagtagaagtattcaaagttaaaatgtgcaggccagtcatggtggctcatgccttgccagcactttgagaggctggggtgggaggattgcttgaggccaggagattgagatcagcctgcacaacatagtgagatcccatctctatttaaaaaaaaaaaaagtatgattataaacctgatttttagatacaaactttattgccaaatgaattatgaaaacaaaatactattctgaaggcagggcattatagtatctaataagttcatgaatgtggaagtttggaccaagggctaggaaaaaaccttatatggtaaatcaaattgagattaaagagagaacagaaattaggcatcacgcctgtaatcccagcactttgggaggccaaggcgggtggatcacgaggtcaggagtttgagaccatcctggctaacacggtgaaaccccctctctactaaaaatacaaaaaaaaaattagccaggtgtggtggcgggtgcccgtagtcccagctactcgggaggctgaggcaggagaatggcatgaacccaggaggcggagcttgcagtgagccgagatcacaccaccgccctccagcctgggcgacagagtgagactctgtctcaaaaaaaaaaaaaaaaaaagaaattggacatcacctcattaccaaatgcaaatcattctgatgcattgctgaggataaaacatgattttgtgggtgggggacagtctattatggaaggaacactgaattaggagtgagacctgggttctaggatttgatcttctgcttattgcctgtggcccttggaaaggttatttaaccctactgagcctctggtttttcaaatataaaaacacttgctgaccaagcatggtggctcaatgcctataatcccagcactttgggaggctgaggcgggaggattgcttgagcccaggaatttgagaatagcctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctactttaaatgcctgctaacagatgcctttgtgctttccagcaaagtatctgctggtcctgtcaacacagctttgatcctgtgtgggggtggtgaattcctgctcatccacctctctgcggctccccaactcctccctaggcagcctgtgtgtcagtttgtttttacctcttctataccgtttacttcagggtataatatgcctacttcacacaccagtctgagagccccttcctcagggccggtgatcatatctctgatttctctgaagcccttgcctagtacctagcaaaaagcaggaatattcaataaagattttggggccaggcgctgtggctcacgccagtaatcccaacactttgggaggcctaggcaggcggatcactcgaggtcaggagttcaagaccagcctggccaacatggtgaaaccccgtctctactaaaaacacaaaaaattagctgggtgtggtggtgtgtgcctgtaatcccagctacttggaaggctgaagcaggagaattgcttgaacccaggaggcggaggttgcagtgagctgaaatcatgccactgtatgccagcctgggcaactgagtgaaactctgtctcaggaaaaaaaaaaaaaaaagattttggttattgtctgacccaatagggcattgttcaagttcttttccaacctccatattcatgcataaaccacacaacttcttgttgaaggtttcctgtatgtttcctagcatagcctattagtgtagtaagttaggcaaaacatagactttgaagccaaacaaacccaggattgagtcctggctccaccatttactagttatgcccttccatgaaccttctgaagctcagttccctatctagaaggtgggataatatatctgccttactgtgttgtcctgaggatgttcctggaacataataaacactcaagaattgggagctgctgttagtgtttccttaagtacttaattcagtgcatactttgtagatattataaaatgaataaaataaagagctgccttaaggaccttacagctaagggaaaaaaagagtgaacaagcacgcacataagtaactcatggagtgcgctggtggtacaggaatggcatggagcacttgggaagttcacagaccaacaaatgatacatccctggtctggtacagccaaaattgcttcctggtcttgagactgaccatcttagtattcacttgataaaaggttgtttttgctttaatcttatattattaataaactgctacataaactgtatatcagcatgagcaatgctggtaaaaggccgagcacagtggctcaggcctgtagtcccggcactttgggaggctgaggcaggcggatcacttgagcccaggagttcgagaccagcctggccgacatggtgaaaccccgtctctactaaaaatacaaaaattagctgggcgtggtaacctgtagtcccagctgcttgggtggctgaggcacgagaatcgcttgaacccaggaggcagaggttgcagtgagctgagatcatgccgttgtactccagtctgggtgacagagtgagactctgtctcaaaaaaaaagaaaaaaaaaactcagtaagatttcagtaagataactgagtgaagatgataattaggtttctgtggtatcagctgaattttttaatatacaaaaaaggcacttgattagtatttttgttattgtggtttcataagtccagaagtttagaactggctttagtaacttgataaacctagcatcatttaattctgttgttgatgacatgctggggtcaggggttcagtgggacatttgggactaatttcttcacatcatctcttgctttccaaggctttcagtaaaggatgaagagaaaattggcttttaactaatttccagattttttgatggaggggggggcactctgaacaaagtaaatcctgagaagatcaggtagaaggaagtggattgggttaatacctctttaggaataacagaggagatgaggactgatttctgccatttatctcttttatcccacttaatatccacttaatgttttcagtgaaaggataccaatagcctggcaggcataattcaaaatttaatattatccagccgggcatggtggctcacacctgtaatcccagcactttgggagctcaaggcagaaggatcgctttagctcaggagtccaagaccagcctgggcaacatgacaaaaccccatctctataaaaaatacaaaacttagatgggtgtagtggtcccagctactctgggggctgaggtgggaggatcacttgagcacaggaggtcgaggttgcagtgagccgagattgtgccactgcactccaacctgggcaacagagcaagaccctgcctcagaaaaaaaaattatccaggccaggcgcagtggctcacgcctgtaatcccagcactttgggaggccaaggcgggcagatcacgaggttaggagtttgagaccaacctgaccaacatggtgaaaccccgtctctactaaaaatacaaaattagctgggcgtgttggcacgcacctgtaatccccgctactcaggatgctgaggcaggagaatcgcttgaacctgggaggcagaggttacagtgagccaagatcatgccactacactccagcctgggcaacagaacgagactctatctcaaaaaaaaaaaaaaaaattatccatagttccttcaacagacgaatggtcaaacaaactggtacatccacacaacaacctggatgaagccccagataattatgctaagtgaaaaaatgcagtcccaaaaggttacatactgtatgatttcatttattctttttattttattttattttattttttaatttttagagggactcctccttgcagaccagggctaccccataggcagtatgcccagaataggagcctcatttattatcaaaatgacaaaattgtagaaatggagaacagatgagtagttgccacaggttaggaggggatagggtaggaggggaatgagcatggctataaaaaggcagtatgagggatccttgtggtaatggaatgttttatagctcgactgtatcaatgtcaatatccaggttgtgatattgtactacagttttgcaagatgttactattggaggaaactgggtaaagggcacatgagacctttatgttattttcttttacaactgcatgtgaatctacaattatctcaaaataaaaagtcaaattttaaaaaatagctacagtaatttccacgtggacagccacacagtatgtggcttaagacccaaatctttaacataattaaatagagctacaaaaatcagtagcttatatagcattttgttttgttttgctattgtagaaaaacttggaaagtatggataagaacagaatgaaatagaaataggacagtaaagataacaactgtaacacttttgctgtgtttcattctgttttttgtttttccggagtttgcatatatgttttgtttggttttttatcgtaactgggaatatacagtttatttagttttgcattctgctttcttgaattcttttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcctgttctcaatgagctgttgggtacacctcccagacggggtggtggccgggcagaggggctcctcacttcccagtaggggcggccgggcagaggcgcccctcacctcccagacggggcagctggccaggcggggggctgacccccccacctccctcccggacggggcggctggccaggcagaggggctcctcacttcccagtaggggcggccaggcagaggcgcccctcacctcccggatggggcggctggccgggcggggggctgacccccccacctccctcccggacggggcggctggccaggcagaggggctcctcacttcccagtaggggcggccaggcagaggcgcccctcagcttccagacggggcggctggccgggcggggggttgacccccccccacctccctcccggacggggtggctggccgggcggggagctgacccccccacctccctcccggacggggcggctggccgggcgggggtctgacccccccacctccctcccggacggggcggctggccgggcagaggggctcctcacttcccagtaggggcggctgggcagaggcgcccctcacctcccggacggggcggctggccgggcggggggctgacccccacctccttcccggacggggtggctgccgggcggagacgctcctcacttcccagatggggtggctgccgggcggaggggctcctcacttctcagacggggcggctgccgggcggaggggctcctcacttctcagacggggcggttgccgggcggagggtctcctcacttctcagacggggcggctgggcagagacgctcctcacctcccagacggggcggcggggcagaggcgctccccacatctcagacgatgggcggccaggcagagacgctcctcacttcctagatgggatggcggcggggcagagatgctcctcactttccagactgggcaagccaggcagaggggctcctcacgtcccagacgatgggcagccaggcagagacgctcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccatctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctaaggcaggagaatcaggcagggaggttgcagtgagccgagttggcagcagtacagtccagcttcggctcggcatcagagggagaccgtggaaagagagggagagggagaccgtggggagagggagagggagagagagagggagagggagagagagagggagagggagagagagagggagagggagagagagagggagagggagagggagagggagagctgctttcttgaattctatatcatgaagatttctctgtgtctttgaaattcttcaaaaacaattttcatttggctacatattccattatatggatattctataacctacgtaatcatcctctattagatttattttccattttgtatgataatatcattatatataaatcttccatttttttccttaaggtgggtttttgtaaatggaattactaaatcgaagtgcatgaacatttttaaggctttttgatatatgttaccagattgctttctggaaaagtggtactgatatatattctcaccaataattgcatgagaatggataaggtctaagtcaggaagaattagaaacagagttctggagcataaagatttttatctttatcaaaaatataatttctcaaccacagcactactgacattttgggccagataattctttgttgtgggggctgtcctgggtattgtaggatgtttagcagcatccctgacctctacccactagatagcaatagctgccctcccgctgtagttgtaacaaccaaaaatatctctaaacattgggaaatgtccacctgggtaacaaaattgcccctggttgagaaccactgatccaaagacttaaatgtgcaatgagacacttattcttagagtttctctactgtgtactaatgttctgaagcttagctccttggagctctttttttgtggagtatatatgtgtattctgcatattgcctgcaatgtaaaagaggctgatcttttttttaaggctgtgtaaatggctttgttactcctcattgtgtatctttccctactgacatctgcctggtttcctggttatgagaagaaacttaaagtgatggcacttccatttgctttgccctacaaaaatgatttgccttgaaatttaatatggtatttggaagtgtcagtcagcgtccctatactttgtctttatcttctgagtaagaagggtaagagtaaaacagaatgagaatgactttggatctcttgagtctgtatgtaaaggaaaaaaaaaggagtggactgggatttttgttaactaaagttcaagtcttaaaaactaagaagcctattttaagcagcaggagttcccagttgaaggtctgttccctgtatctacagctggctttaccttcagttcttgatggaatgcacctgggtaaaaggccaacctcgtttctataatatttcagaacatcttggagtcctgaaacccatactctcttcctgacataaaacttgctgtgtccagatcttctagtgcttaggttatacttgataaatttcattaattcaaagaagataagctgcagtttcctctgaaaaatgaagagcacacaaatacattaataagaacatgaactctctgaaaatactgtgtccttaaattatatgaaactcatttaagtctatccttcagtaaagacactagcctttgaagttctgatatgaattcattgttcttaagtgtaagatttaggtttaaaaagttagtttgacattgactttctatactggctgtttcttttctgtttgtcccccttaggagcagtctcacaggtgctggacagcctggaagagattcatgcgcttacagactgcagtgaaaaggacctagattttctacacagtgttttccaggatcagcatcttcacacactactagatgtaagtctgtctttttattattcttcttttttggtgaattgaatattggccgggcacggtggctcatgcctgtagtccaagcactttgggaggcagaggcgggcgtatcaggaggtcaggagactgagaccatcctggccaacatggtgaaacgtggtctctactaaaaatacaaaaattagccaggtgtggtggcgcatgcctgtagtcccagttaggactgagctgaggaggcggaggcacaagaatcacttgaacccgggaggcggaggctgcactgagccaagatcacaccactgcactccagcctgggtgacaaagcaagactctgtctcaaaaaaaaaaaaaaagaaattgaatatttagcatacctttttactttacatgaattctcagatgtctatcataacaattcttttcagttgccttaagcctatgagaaatgtgggaaatcatccatcaaaaattcatgattgaaatacagtatatggccgggcaccgtggctcatgcctgtaatcccagcactttgggaggccaaggcgggtggatcacctgaggtcaggagttcgagaccagcctgaccaacatggggaaaccccatctctactaaaaatacaaaattagccagttgtggtggtgcatgcctgtaatcctggctactcgggaggctgaggcaggagaatcgcttgaacccaggaggcagaggttgcagtgagccgagatcgctccattgcactccagcctgggcaacaagagcgaaactccatctcaaaaacaaagaaaaaagaaatacagtatatgtacagtacaaatgcaacagagcctagcaggctacaatgggaaaaaatttatatatctttatatttataaattatatgtacataatgcatgcaagtggtatgtgagttttaaaaaagagtagagtacaatcctactttactgaattatcttgtatttctgttaaaagaatccattgaggttagctgtgattactttttattgctttgcacattactttaaaacattatacctccagcatgagtataggagagagaaaagcaaatgagatactttgcaataggctgtattcccacacacatttcatatttaacattgttttgttccatagattcaatgtcttctccttaaaacataagcatatactccatctttaaatattacaggctccactgacagcagactgggatacaaaggaaaaaacagaagctgaccattttcatttcagtcacattttaagtaaaatacctttcttagagaacttggttcacttcagcaatgaaaactcttgggtggtttcgatggtatttgaacatgttagtctttttacaagaaaaatcttcccttaatgagagaatcatacttgctttggggtgcctagaactgtttggtgctgaataattcaccatatgatgtaaatgaagctaaagcaaaatttcccagaatgtgttctacagagcatggctctgggaggttgctatgggtgttgccatggtgggagggggaagtagatcttaaatttattggttaaattatttattgactaaataagtttgggaaatgctacattctttagtctttttatacagatccacaatgggtgttggtatattgatagctctgagatgatctaaagcaaagaaacctttttaactttctttatcagcatttctcaaactaatttgggcacagaacttttattcacaatcctgttgagttctgttttgatgaggaccagtttgggaaaagctcagctaagagtgtttgttgcattatgcttcagctttacactaaatgcagccgtaggtatctaacagttgcttctttccccaaatgtggtcagttcaaattaattatcagattttcatggctagtttggcctttgtatatagtgtacatattaattagggctgactaactgttataacatgtgattctaaaatttgagtggcttaacagaatagaagtttacttcttgctcacttcacagtccaatgcaggtagatgagggaggtcttttccacaccgtcattcagagacccaggcctcttccactaggtcacactgctatttcccagggtcttggaatcttctactgtatcctttgtacctagccagcaaatgagagaagagagaacatggagaatcttgcagggtcaagcttggaaatgggtttatctcacattctttggcaactgctagtcacgtgctcacctggatgtgagagctgaggaacgtagtttagaaatgtgctcaggaagataaggaattgggtcttctctttagtgtaatttatcttaagtagtatctattcactgtcattgctgcagaaagttttcacaattgtgtatttcccactgaagtttataccctttactagaactagttagtgcaatatttagaaaaggctacagcagtgtgtggagattttgtttattttattgtggtcagtgcttaggtcattgccaggtagatttactgaccttcttttgaatcaaggactttttgtaacaaagactttttgtaatttaaacactgagagaagcccaaattggtttcaaagttgtattttttcttactgatatagcaaggtatctgagcacatcaagcttgagattgcaggggagaagcaggaacattactggcttacacaaggaaaggggcagctattcagacacgaataactgctgcactgtttggtataaattgtcacaatttcagaagagattcttagatgttagtgagaaaaacatacttaactttcctttgcatttgtttacattataaagaagtatctgccttattggcatctgccctgtcagtgcaggtcaatttgaaagaggagctgttggactgaaaatgaaccatgcctattaaaaaggtgcagtataagaccaggagtagtggctcacacctgtaatcccagcactttgggaggtcattgtgggaggatcacttgagcccaggagctcaagaccagcctgggcaacaaagcaagaccccatctctacaaaaaatttaaaaagcagctgggcatggtggtgtatgcctgtggtcccagctactccagaggctgaggctgaaggatcacctgagcccaggaattcaagggtgcagtgagccatgatcacactactgcactccaacctgggcaacaaagtgagactctatctctaaaaaaaaaaaaaaggtgcagtatcttctgaattttgtaaacaggtgccatacatgagctccagtcaaattaatgactatgaggccgagccctggacaatatttgcatgcatgtggttctgaatctccaaactgagctatttctaaatgaaagtttaggccaggtacggtgactcacgcctgtaatcccagcactttgggaggccaaggcgggcggattacctgaggtcaggagttcgagaccagcctgaccaacatggtgaaacccatctctactaaaaatacaaaaatgtggtgggcacccataatcccaggtacttaggaggctgaggcaggagaatcacttgaacccaggaggtggagattgcagtgagccgagatcgtgccactgcactctagcctggtcaacagagcgagactccgtctcaaaaatgaatgaatgaatgaatgaatgaatgaatgaatgaaagcttaatcatcatgaatgaaataaaccatcattagaatgtgccctcataccctacatcccataaataaggcttattaagctcatttcacagctaacaggctacattttaataatataatcaatgaagaattcaagtgactgccatatagagaaatctaatcatttaaaaaattttaatatttaaatgtttgtggtatacattaaggaagaaaaatggctatgacgaactcttgaggagcagctgttaaaatgttggattttcagtctgggtgcagtggctcacttctataatctcagcactttgggaggccgaggcgggaggatcacttgaggtcaggtgtttgagaccagcctggccaacatggtaaaaccctgtctttactaaaaatacaaaaattagctaggcatggtggcgcatgcctgtagtcccagctacttgggaggctgaggcaggaggatcacttgaacgcaggaggtggacgtagcagtgagctaagatcacaccactgcacggtagcctgggagacagagcaaaactctgtcaaaaaaaattgggcctttcatttttctttcttcccatgttccacataccatggttgatttggaattgttttattttgcagaatcaaaacgaattcttctgcctttttttgtttgttgtttgttttttgtttaagacagggctctcccaggctggctcactgtagccttgaccttctgagctcaagcaccctcctacctcaaccacccaagtatctggaccacaggtgcaccaccacactcagcccttttttttttttgaagagacaggtctcaccatgtttgcccaggctaccaggctagtctcaaactcttgggctcaagcagttctcctgcctcggcctcccaaagtgctgagattacaggcatgagtcattgccccagcatgaattcctttttaaggattccaagtagggacacccagggggcatagttttatggaccatgaattaattaaggctaattaatcccactgagccattttaggaaatatctttaccatttttatgttatttctgttaactcaataacattctaaatagctaggtatgaagccataattttaaggctgacaaaaagaaacaggattaagttcctaagaaaaactaaagattatctatgacttctttattttttctagtcatgttcttaaaataataacaagctcaaaatttgaagaagcattattagaatttgtttacaggaaacaaaactgccaaactgaaacatttacattaaaatggagaagtactgtgattctactgaaagggaaatgctttctgaaaacctttgaatttgagtaaaacacatttagtttaatctgtagttagaaactgatacagaaaactctaaatatttgctatccaagtggttccagcctggcacacatatgcagcttctcattttgtgggaagaaatacagaggcatgaggaactgcttggtccagcttgttgcagtatgcctgtatttaaaaattaaaagcactggtgctaagatgatcttcgtatgaaatgtatagatcaattagtaaagtacaatttgacattagtttgctaggactgccataacaaagtaccacaagttgtgtggcttaaaacaacagaaattgattgtctcatagttctggaggctggaaagtcctaaatcaaggcattggcaggggcatgctccctccaaaggatccagggaagaatccttccttgtcttttccagtttctggtggttgcctgcaatccttgtcattccttgacttgtagatgcatcattccagtctctttttccgtcatcacatgtcattctctgtgcgtgtgtgtctgtgtatttacatggccttcttagaaggacaccagtcattggacaccctaatctagtatgacatcatcttaattaattacatctataaagacacttatttccaaataaggtcacattctgaggttctgggtaaacataaattttgagtgagggacaatattcaccccagtacagcatggaaaactgatttaaccctgaattaattcttcacgtgtgagtgcaaattacacaaatctaatataaaataatgaaatgttaccctgtcatccattaattatgctttattgggaattggtgttaaagtgttatttatgtcttgtaatgatattttgaatcagttatggattggaatttgtatgtgatacattggaaggtcagtgggtgggtgagtttttgatggactgaaaagccatgttttttggattaaaaacattttacaaatattatttggtagtagttttcagtcttctcagtttctagtataaattttcctattaaaataataaatgtttagtttgtaaatcaccagtgttacaaaacattgttaaatgacacatctctctgccaaactttgacaactaagttttaaacattaactggccatctgtcatacctctgaacagctgttagcatttgttacgcactgctgtttccatagtaaatgcccccacctaattaagattatttttgtaagaagtcttaaaattgtggtttctgaaaatataatgggtgattagattaatatagcaatttattgatgaatttttaaaattgcagtagcaattaatttaggagtctttataatattaatttataagtagacttttataatagacttagtaacttttaaatattgcattagcaattaactgatacttggaatctttcatattttgtatggccaacatctttattataattttttaccgtttagggagagttagcatttttccatctggcctggagttagccatggaaaactacaattcttgatttactatttcgcttttttgagatgacattaaattagtagccatatttagaagagcttatttttagaactcagaagtttcctaaaggaaaaagatggaacttctacaataatctggagataatgtttttgagcaatttggggtctgagaagtaagttaaatacaatgttaggtttggatatttaaagagattgccaatcaggaaatgccaaagctaagtttcccaagaatttgtagtccagccaatttgcatttaaatgtctagaataataaagcctatctgaggaccttcagaggatgagctactagtaatttctcagggccccatccagtcttaagagtcagctttggcaattatgaaaccagctgcacagtgggcccctgcccagtggtggtggtctttgtgcttcttgcctcctggggctgtagactgaagcgcattgctgttccctttgaatttgagtgtctctccactgttttctaactggaggggcaaaacctcccatatctgtttctctccatgtattgaagtagtattgtcagtgtaaaagtacggcatgaaacaaaatacctgaaagctagaaataccatatgtcgtgaatattctcaaagtatttttccttctttcttaatgtaaataaatgtcaataaacttagcaaaaaaaaaaaaaaaaagccgctaagcatatggttctttgttaagcagcaatagaaaactgatagaaccaggaacaagatgaggattgtccactccccacttctattcaccattgtcccagagactctggccagtgcagctaagacaagaaaaagaaattcagggcatgaagattggaaaggaagaagtaatatcatcctttcccagagttgttatcttgcatgtagaaaatactaaggaatccacaaaaaatctaatagcattataggcaagcttagcaaggtcacaagataccagattaatatacacacattatctaaatttctatatgtgagcaaaaaataacccaaaaataaaattaaagaaatattcacaatattataaaaagaataaaataggaataaattgaacaaaaaaaatgtaggatttgtatactgaaaactaaaaaatgctatgaaagaaagatctaaataaatgagcagagatatactgttggattggaggacttaatattgttaagatggcgcttttctccacattgatctatagattcagtgcagtccctatcaacatcccagtaggatttctttgtagaagtcaacaaggtgatcctaaaatttatataaaaatgccaaaacaattttgaaaaagaaaaaaattggataactgatttcaaaacttactataaggctacaataatcaaaatagtatggtgttggcataaggatagatatacagatcactgaaacaaaaaagagtccagaaataaaccctcacctttatggtcaatttattttcaacaagattgccaatgcaattacatggaaagggggatagtctttttttttcaaatggtcctggagcagttggagatccatatgcaagaaatgaacttagaccctgtctcataccatacacaaaagaaaattgcctcaaaatggatcatagattcactttaagagcttaaaactataaaacttttaaaagaatataggaataaatcttcattaccttgggttaggcaaagagttcttagatgtgacacaagggaatttggggggattacggaaatgttcttaagctggattgagatggtggttgtacaactatataaatttactatcatcccactagatttcacagggccattacactaaattaaaatttagctttgtggctaagaatttaccactgattcaaaaatactaaatatggttttttctcccaagaactgttttattaaccagcgtgtagttgtgccttatggaagaagtccaaattgtgttttttgtttgaaaatgttatgaattacataactttatagattttcaatatggaagacaccttagagcaacttattttagttcattccttctacattcaagtacatatttgccatttccaaaaattcacagctttttgatacttttttaacatcaattttttggtcttttttgttgtggcaagatatatataacataaaatttgccacttgcaccatgtttaagtgtacagttcaatgacattaagtatattcacattgttatacaaccatcatcactatccatctccagaactctttcatctttcccaactaaatgtctgtacccattaaatactgactcccattcacccctctccttagcccctggcaaccacccttctactttctgtccctatgaatttgactactctaggtaccacgtatataagtgaaattatccagtatttgcccttttgtgtctggcttatttcatttagcatgatatcttcaaggttcatccatgttgtagcatgtgttagaattttcttcctttttaaggctgaataatattccatcgtgtgtgtatagtacattttgtttgtctactcatccaatattgatgttttgtggttgataattatgtactaggaaaaaccaaattctcagaataaggctgtctaatcgtagggaattctgcctcgttccatctccacacaattactctttctaggatgcaagttaaatcttatgctatacatcttcgtgaaggaatgtgtgatttccactgaaagtattaatgactacggaagtccctccaattcccttatttgttcagataaattacttcttaaagcagggtttagaatttactctagaataccaagaataatgaatcagcttgtcaccagtatcagtgttacccactgagtgccattctctttttatgacaccatgatcaactttaccaaaaggcaaaggaatttgcagaaagccttctaagtacaataagcactgattcttctttatgctatgctcaaggaaaggaggggtttccccctagaaaggaatgtgatatgctcagttaaagaatgttcgatggagtggcttgcagcattcataatccaagaacatagctgttttcttctctttgtggcccttcaaacatgatctcataaaactcttctgccagactgcctttgtgctattctctttaaatttttcatgacagaaattcatttttgctacagctacaccaagtacaaatgcttggtgtttacctatgcaaaataaaaaaggtagcaaaagccaaaaataattaaataaaatattatctgacacacctaatgtaacataaatgttaccttttaaagcagcacattaataattgtatgttcatttaatgtaaatatcatttaactcttgtagttgcttaagaagagccaagctaggaaatgtgattttaacactttaaaaaaatagaaaggaaattaatatcatagtgaaaatttctcatagttgggcaagctcttgtatctgatactaaaaagtaccgtatttcagaagattttattaaaacaagataaaatctgcctatattatatcatgtaactggtttttttcctcatgctttcttttgctcaagaataggcattatgatttgtgttttacagggcttaattttagagttatttgaccacttgaaaaaggcatagagaacagtcaagctaggtcatctgaggccagtgtttgagtttctcagaaatagctgccaactgaccagaaatctgccacactggcctatgttgttaggccaccaaaggcacagtcttcttggattgaactaggaggtcaagcaagtcttaatttcttgaattcaaaaataaatccctgtaagtgcgatgttctaataggattagaacaaaagcagccctgtatacagacaaataaaacctaaacaaaacaagggcctccttagaggttcttttgctgtcaggatccaaaggatttttgcagctttttcaggaaatcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactccatcctaggcaacacagcaagaccccgtctcaaaaaaaagaaaaaagaaaaaaacttcttcctagtgtttaattgtagctccttaagtttttgaaaatgccattttaaattttgcaatgtttctttcacacttacgttgcccatcatgcaatctttaggccactgctaaatacactgctcttctccaagcttgaactacatgatgtttaatgatgccaaggatctttgaaaggactctgtgtgtgtgtgtgtgtgtgtgtgtgtgtcagggcctcagtctgtcactccggctggagtgcggtcatgcaatcatagcacattgcaacttcgaccttccaggctcaggcaatcctcccacctcagcccttcaagtagctgggattacaggagtgcgccaccacacctggctaatttttgtattttttgtagagacgaggtttccacatgtggcccaggctggtctcaaacacctagcctcaagcagtctgcccaccttggcctcccaaggtgctgggatgacagatgcaagccactgcacctggcctcaacaagtttatatgtaaacttgagcaagaaaaatagatttttagatcttacaaagttttctgtgatctccaacttcagaaaatcagttccagtacagtaattgaatatcagttctctgtgtttcagtattaaatcagctttccctaatattttgctcaatttcaaatgtatatgagaaaatacctgttatgtattgatggctgatctgctcagttcactgaaaagatgtgacattgaaactttgttcctatttacccacgtaattcacagaaactgaagaaagttcttaataagatagtcagtgtttccagaacaagttatttcaatggtcattattgctacacagtgtaattccgtgcacactgttattatctgttttattaggatcatcacagacacattcattaaatattttgcagctaaatatttgattcttgcaaactttcattcttttccagcaggaaacttcttcagtatctataaagtaagtgataagatgatggttgctaatgaacatcaatgttctttgcaaccctacaagcctatgcctacagtatagttgcaaaagttatcaacttgtctgaaacagtatacattctggtccttagatttggttttctctgtgcaaaaaaagttagtgggacatacaactcagtgataattattttatagcttcttaccatgcattccattttaaatgttgatcttgataaatactgcacataaactatgagcaaaacacaggtttctatttgataactaagaaatcagaagataatgtgatataatgagtatgataaaaaatgaaacttgatttagtgctttgaatgtaaataaaaggtgacatattaactgattttatcatctttatgtttgaaagtacaatctcaggagatttgaatttaatatcactaccaagtttattctgcttcatttgaaaacccatgtcaaatgtagaatgtgttctctttatggaactgtggcgacacttcctaagacagaaagatgaatgaagcgtgtcggtgtaggtatgtgtggtcatatctgactcagtaccagagatttgcagagagcaggcctatctgtgagacaatatgagacagtctgtttcccttgcagctgttcacatttccttgttttgccctggtgttgtgtgtacatgttttttgttttttgttttttttaataaaaagtgctgaatttgggtaatgataatttcattagaaaaagagagtaaacagtaacagattcattcttgttttccctctagggataatttattaacattcttccttctctcttcctcccccttcacacctcagctttacaaatacacctgataccttcaaatttcaggaaagcaaatagcaaaaggaaatacattttgtcattccaatataacttgaatttaagcttctagagcagggattcacaaactatggccctcaggccaaatccagctggccacctgtttttgtaaataaagttttattggaacacagccatgctcattcatttatggattattaacagccgccctcatacaacacaacagggtttagtggctgtgacagagatcatatggcctgcaaagcctaaaatatttcctatcttgccaggataggattaggatcctgatattctttttttttttttttttgagacagagtctcactctgttgcccaggctggagtgcagtggtgtgatctcggctcaccttaacctccacctctcgggttcaagcgatcctcctgcctcagctaccttagtagctgggactacaggcatgcaccaccacacccagctcatttttgtatttttagtagagatggggtttcatcatgttggccaggctagtctcgaactcctcacctcaggtgagaatcctgacattctttaacatggcaaggcttgtaattgagtagctaatagttttcaaatcatattgagtgtatttttccctgcagcctataaatagaattttttacagcttttttcccaagtatttgccaaagatatctccctggcacaaggcattgtgtattactgaattctagtaacaagctgaggagatctggatgagagaaaggacagcatatcagcagggcagggtcaggtccctgctactctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttaccttgaaagttgtataaagtaagtcagacttaaaagatacaaaagaaagaattaaatatagtcaaaacacatttcttaattttgagggaaagtttttaactgcacatgcaggatcgaagagaaataatatctggttcctaaagaaacaagctgaaataaatattcctggtgtgtttattttatgttactctgaattttttttaaatctatttacaatttctatgtactagtccaaatataatacttattttttctagaggaagcatttcttaaacactactatgtactcagcctcacgctaggggctattacctaatgtcagagaacccgagtctggtcgtgggaaagaaaaagaaccacttaaacagcatgttctataatgtacctcagacattcagttccctcttggctgttgatgcccttggtgtggcagacaccccagtgttggctctgtcctgagttgcagacgtgtggtttctgcatcgtcagtatactcagcacctggtctcagaaacgttctcgtcccctgcccccaggggttaccacatagctttttacttctgagtcctcttgtcctcctgggcagggctgtatccagatggctccagccaggctaccttctgcagtgtctccttgactcatgggaaacacacacatgcttaactcaacatacactacaagcatggcctgccccaggcggcctccagtcatgaaagaggcaggcaccagtctctttttgcttaggaccccaaatgctacatgtcaagctgccccaaggactctctctcacacagagatcctttctagtgtaccaaggtgggcctataagttgctacaattcagcaagcatccctccagagaatgagatagtgagctcttctggctggcacctccagtgtctaatgcgtggttcttttggggcatctaccatccttcactttgtatgagggagggtgcaatcccctctcctttcctcccgaacaagaaggagaagggaataatcaaatacttgctcttcttagtcctgtgactcctacaaatcccagacttctgcctctataggcagaatgaggggtcctggggtgaatatggaagggccattttgactgcctttcagcaagcccaggagaagtggtctagcagctttatagcaggttcagtgccatttacttcctcttggccttagctttgggctttagctgaaagtccaagactactggtaaggtcccaagtaacattttatatattctttatatatgatagaatggggggtgggtaaagggtaagaaagacaagctgcagtcttcctttgttctcaaaacccagctacctttcatttgccccagaccttgacaaaactctacctagatttgaaatttgagtcctgcatatctttgcaggcagcatataatatgcagatgacccatgagaatgagaaatccaaaagcactatgtttctaactactgtttttaaacacttcaatgttacatcgcattcgaacttttttccattgatgactttttatttacctgctttgccatatttctcaaatgctttgtatatgctatggatatcactaaagtattttgagtctctaagacaaaaatgtagaaattggtgggggaaatgaaggttgacatattatgcatatacatcaagatactttccaacttcgggttgcccactgagatcattgccagttgttattgctggggaccaaactacttactctctggtctccaaagggttgaatccttcatacatttctgggcctttggttatacagatttttggaatttgtgagctctttgaagacagaaactcatctttttcatctctgtatccctagtacatagaaccccacattttagtacctagtaagacttcaataaatattgagtggatgggtatgtggatgaaccaacaaagggtcacttctctctgacagtgacaaaatgagcccattcctcactccctcctgcttcagttcttacttgcccttttggttgatgagccagcagccgagattcacagtgtattctttgccacatggacaccatcctctctatcctgtggctgccttgagaggtgcagtttctaggacttgagagctgcagtttttagaagaagcagagcccaatgcccccacctcaggtagaagccccaccttttaattccttcccattgtatctgcctttcatattaagcatcccacctccccctcatcctgccactacttccactgaactttaggtgagttgaatttaatttaagtgattgaactggatcagaccagaccaaaggcgtggaaaaaaatttggtctgagtattttccttggagcagtgcctcaaaagagattccaggcacttgtgtgccacctatgaagttgtatggatagaacagcggttctcacttgaccactctgtgcctcatttttctcatcttaaagtgagaatagtaggggtaaccaactgcgtaggattgtttgaggttaagtgaatgagtatatgttaagagcttagactagtaactatcatctagtaagtgctcaataaaagtaatattgttgctattagtagtagtactattagtactctcaaaagttagcactggacataagattttcaaatacctaaggagtttattaaagcacagatttctggacctccttcttaaattctgatgttgtaggtctggaggggggtccaggaatctatgttccataagtactacatctgattcggccacacgttcttaagaaattacagatataagacctaaggaactgtatatgacatagtaagaccaggtcaaaaattatctccaatttggggagttgtgggattattttttctttgtgagaaaaattgatgtgcatttattaaatgtttaaatagaaacgaaccataatcatagttgaaaatgttggaaataatagtccttgatcaagaaaaaggcaaaacttacagtttatcatggaattagacattataaagtgatggtgctatcaacttgtaaagcctcaaattaaatttgctttttttctcaaacaggtttgagattttttttttttttttttcgagacaaagtcttgctctgtcacccaggctagagtgcagtgatgcgatcatagctcactgcagccttgaccttctgagtagctgggaatacaggcatatgccaccatgcctggctaatttttgtatttcttttgcagagacagggttttgccatgctgcccaggctgttctccaactcctgggctcaagcaatctgcctgcctcagcgtcccaaagtgctggaattacaggtgtgagccactgcacccagccgggtttgagattttataaaaatatttttatgtattcacttagattatttaaactttgcttgataatattatgacacgtcagggggtgactaaatgtgtttttaaagtgttatgtatttttttaattgtgataggaacacttaacatgagctctaccctctcaacaaatcttaaagtgcacaatacagtattgttggctgggcacggtggctcacgcctgtaattccagcgctttgggaggccgaggcgggcggatcacaaggttaggaattagagaccagcctggccaacatggtgaaaccccgtctctacttaaaatacaaaaaaattagctgggcgtggtggcacgcgcctgtgatcccagctactcaggaggctgaggcaggagaatcgctcgaaccgaggaggcagaggctgcagtgagccgagattgagccactggactccagcctgggagacaaagcgagactccgcctcaaaaaaaaaacaaagtgcacaatacagtattgttaatgatagacacaatgttgtacagcagatcactagaacttattcatcttgcaaatgtaatgtagtgtgtgtgtatatgtgtgttttatggtttcttagtttttttggttttgcattttgtttgggtttgggtggtggttttttgttgttttactattttttattgcatgcatgcagtgcaattcatttctataggctagtctggaaacctaatcactatttataacattatttttctgggaaaatatgatcccagttacaacattgacatttctttagagatagaaagcattcagaagatggagactgcccacatatattttacagggatttgggcaaacttttgtggacgagccacaaatcaccatttccctaaaatgttaatataatgttttaaatagagcagcattttactagtctacttatactatttatttaatctctgatttagtagtgctttcttaattaatacatcatttaaaaaattgtccctgctctatcttcacattgcttttgttaggcatttttatgtatgatgtggcccaaatatttataagtcataaaaatttatcttgcattagtataagcaaatctgactataatctgaagaatgtttatagtcagtatttgacttctcaactagcattggtgtacagagtaggtgaagaaaaaaaaaagaataaaaccgaccacgaaaatccccacctgttttagagaagttaggaaataaaagtgttcacaacagccgaggtcatctttaacttttcacttttcaaagcagactgttgactatgaaacactttatttgaggtagaaattaatattttaattgtatttctaaaataattaaatgtatgttcttcagaaagctgaactttggatcatttaggtttgtggaattttagaaatatatttagtttctttcttttttttttttttttttttttttggagacggaatctcgctctgtcgcccaggctggagtgcaatggtgtgatctcggcccactgcaaccttcacctctcaggttcaagcaattctcctgcctcagcctcccgagtagttggggttacaggcgcccaccactatgcccggcaaattttttttgtatttttagtagagacggggttttgccatgttggtcaggctgttcttgaactcctgacctcaggtgatccgcccaccttggcctcccaaagttctggcattataggcatgagccatcgctcccagcgtatatttgctttcttttcagtgtcttctccactctgaattggcagagtcaaaagaaaaaaagtttatgtccttgacttcctgctgaaggataccagcactgattctgttaatgaacagccctagtaaaacaaccataagcctttgtgagaacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtttggaaaataaaaatagatccataatctcatcaccctaacacagtagtttccatttttatatatcgttttctagtcactctccatttgcatataaatttttttatagttgtaatcaaaatgtgtcttttttaacctaccgttatataataagcatatttccatgtttctacttgatctttacaaatataacttctaatgactgcaatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaattagtgaagaaaatttgagtggaaagagaaaataaggctttaaaaaattgttctcttaggctccctggcatttaaccctaagagccattagcagaggcatgactttctctgtgtgggcagatgactatggggaaaaacattgatccggcaggcatttttgcattttctacattacttaaagaaaaattacttgtgtattcttaattaagtagtctaattaattagttctgttcttgaaatcgtttctatttgtgcctgtgtcattttgacatttctaaagggaattggcagtgctgttaatataaaagaaaacttcttattaactttttgtccatattgatttttatggtgagtttggaaaaggatattcagagatactcttccgttaagtttcataaatctgtaataaatatatgttgcagccttgtcattttgctttatatttttcaataaccttttaggttatagttgacagacttttagaacaatttgcttcatttttattaccatcaatactgttcttctatgtattaataacatttgaataaaatgaaaagtttttcaaaataattgttttgcctgccataaaaatccactcataatttttaacttaaaagaatttaacattttgtaaatcttgtgtcatgtttgtattattgtatatcttgtttattttttaggtattggaagaaatttcatgttaccctgagaataacgacgcaaaggaactaaagcgtattttaacacaacctcatttcatggtaagtaataattaaacttccatagaactgaaacctcactttcaaaagaagtttttaaactaccctcataaaatgtagccagcttcatctcatgcatttttatccatatcatatgagactattaagattacaataccaggtaataccaaatattttaagactgttttgtttactttgtgtcacaactgtaaagatactcttggtgaagtggcttttcagggactgtactcatcagacaagggattttctttcttatggggtagtcctttagtcactggaactgtttatgttacttaaaccacaaagaactaaaattagagacagttttcaataataaggaatcgtctgaatctaggtgatatattggaagaattacatctcttttgacaatgcaaaactgctgcactttcttggttcatttctactatatggaaaatggggataacacctgtatttagccaaatataaagctaaatagctaaacaaagctcaaagctcaaaatagataagatactttgctgtggaaaaaggtccatgcttatctacctaactgcaatacaaaaacacaattacagatggaaattcatgttgaatataccattttaaaagcattagccacatcagtttatgtgaaaaatatgtgaaaagtggaaaatttacctcactgccctttgggagaaaatctgacttaaaagccttgttcttataactactattacagatgatactttgaatttttatttatttatttacttttgagatggagtctcaccctgtcacccagggtggagtgcagtggcgcgatctcagctcactgcaatctccgccttccaggttcaagcaattctcctgcctaagcctcccgagtagctgggattgcaggcgtgcaccacgacacctggataatttttgtatttttagtagagacgaggtttcactatgttggccaggctggtctagaactcctgaccttacctcctgcctcagcctctcaaagtgctgggattacaggcatgagccaccatgcctggccacaggtgacacttttaaaataatagtaacagtataatatgtgtatcaaagcaattacctgtgagttattatatatatgctgttttatgatagtgtttctttttttctttttcttttttttttttttttgagacggagtttcgcactgtcgcccaggctggagtgcagtggcgcaatctcggctcactgcaagctcagcctcccgggctcacgccattctcctgcctcagcctcctgagcagctaggactacaggtgcccgccaccacgcctggctaatttttttgtatttttagtagagacggggtttcactgtgttaaccaggatagtcttgatctcctgacctcgtgatctgcccgcctcagcctcccaaagtgctgggattacaggcgtaagccaccgtgcctggccctttatgatagtgtttctaaacttttaaccaagttattgaaataaagtttttttcctaaaagtaactacctggaaagaagcaattaccatattcatccttcctaactctcccacccaagcattaaaggctgaattcaagtataatccttgagagtatttgactttattctatggtaacagcactgtccagtgaaatacaattaggatacaggttctaatgcctgtagatgagtgcatttttacaacctaggtgtataaacacagaacttcgttcaaatctcacctcttttatcaaggtatcttgtaacctctctacccttctcttgaactttctcttctctaactcttttccacttgtttgtattcacctgcataacattctaatgcttgctggcctgccagagcaggtctcttcccagtgaatgagccagggcaatttttctttgtccttccatatcccagcccagttttgttgttctcattgagcttatctcatttagtcattgtgattatctctatttcacagagcaggagaataaagaaactatatgctttattaataatcctcaaatgtgatgaatcacaaatatctgcagttaaattaccgttaatattaccttgttcactgtttcatgcatatgtgctgtgtttccccagattataattcattcccttttagacagcatgtcttctatagcaggggtctccaacccctgggccactgaccagtacccatccgtggcctgttaggaaccaggccacacaacaggaggtgagcagcaggccagccagcattaccacctgtgtccccctcctgtcagatcagcctaggcattaggtcctcataggagtgggaaccctattgtgaactgcgcatgcgagggatctaggttgcatactccttatgagaatctaatgcctgataatctgaggtggaacggtttcatcccaaaactattccccgacctctatcccccacccccacccaccctgccatccgtggaaaaattgtcttccacaaaatgggtccctggtgccaaaaaggttggggaccactgttctatattataaaagtggttaaagatgtgaattcagatgacctggggttgaactccatccttgccaccgtaactttatgaactctgactctgagtcaacctcgtggagtcagaataagaattaagtagctgatatatctactgtgcgtagcacaatgcttgacatatgcttagtgcctaatagatgttatctgatacctattattagttgctccatagtatctatcatgtatagggcacatagtaagttatcagtaaaacattgaatagattaggaacctgcccgtttgcagataggttaggctctccttggctgactgctctgtgcagtgttccatagctagaaacagatatataataaattttggaccaggcacagtggctcacgcctgtaatcccagcattttggaaggccaaggcaggaggattgcttgaacccaggagtcaaagaccagcaacattgggagaccccatctctacaaaaaattaaaaataaactagccagacatggtggcacatgcctgtagtcccagctacttaggaggctgaggtgggaggatcacatgagcctgggaggtcaaggctgaagtgagccatgatggcaccactgcacttcagcctgggcaacagagcgagaccctgtctcaaaaagtaaaaaatgccaggaactgtggctcacgcttataatcccagcactttgggaggctgaggaatgagagtcatttgaggtcaggagttcaagaccagcctggccaacatggtgaaaccccatctctactaaaaatacaaaaaaaaaaaaaaaatagcctggcgtggtagcacacacctgtagtcccagctacttgagaggctgaggcacaagaatcacctgaacccaggagacagaggtttcagtgaggcgagatcacgcctctgcactccagcctgggtgagagtgagactctgtctcaaaaaaaaaataaaaaatgaatttggacagacatgtctttctataaattgctaagtaaactcagctcaattcagagaatgatatagggccgtatgagaccaatagatctttcagatttgaagtaagctaaataaattaacatatacccaaataggagccttttttttcatcaaaatcattacggctcatatagcccattgtatgacagcttatctgtcttctaagtctcgatatgttttgcttttctgaagtcagagagaagttaatatgtgcattgctattagtaaacattttcagaaataataagtaatttttataatttattgaatacctagctaggtgcttaaaagacattttcattcatttatcaaataagtaaatgcctactgtatgccaggcacactatgccaggcactaaggacctagtaatgaataagacaaacaagatccctgccctcatggaacttccactctagtggaggtggggtgggaggacaggtaggagaggtagaggtagacaatgagcaagtaagctaacaagataatttcatatggcaataataactatgaagaaatgaaaggataatggtgcagagattatagtaaagtgggagctgctttagataggggaaagcccctctgaggagtagacatttgggctgagactcctttgaggaagagcaaatgcaaaggcccagagacaggaaagagctttgtagattcaaggagcagaagtcctttgtggctgagatacagttaacaagggagagagtggtacttcctgtaccaagagaggtcagcagaggccagaccaatttatttatttttttaatatataaaataaggccaggcatggtggctcacgcctgtaatcccagcattctgggaggccaaggtggacggatcacgaggtcaggagttcgagaccagcctggccaacatggtgaaacctgtctctactaaaaacacaaaaattagccaggcatggtggtgggcgcctgtagtcccagctactcaggaggctgaggcaggagaatctcttgaacgcaggaggcagaggttgcagtgagttgggatcgcaccactgcactccagcctgggagacagagcgagactccatctaaaaataaaataaaaaatataaataaataaaagccttccaggccattgtaaggagtctgcagttttctcctgattgcagtaggatgacactaagtgatggcacgcaggaaaatatctaatctgtgccttgctggagctgatgtgtagagaacggactgtaggggggataagagtttagggagaccaattggaaggctgttgtgagaggttgtagaggcttggagaaaggtgaggatggtagaacatgggcagatggggtttctgtgttggagatggttacatacaagaggacttgctgatggttgggatgtaagctggtgtaattaaacccatttcacaattccgagaggaaattgtgccctaacaaggtaaagagacttgcttaaggtcactcaccaatcagtggcctcaatgaggttcaagccagatcctgctagcgccaaagcctatgctcctaaaagtcagttgatttataatgctaatcagatttctaataaatttaagttgagctcattggtcattcctaaataagcttttgtgtagataatatcttatgtgggaaatataattctgagatatatatatatatatatactatattaaataagcttttaaatgctggggctttctatcttataagcgtttttaaaatcatggcttcaaaatcttggtatttttaaagaaatattaatagctaaggggaaatatgttaatacttacaatttttttattatgccaaggtttgggagttattcttggcatatttataatttcacacttatttgctcagtcatccgaatttttctttgctttctgattattataacatgaggatttaacattgaattacccaacactgaaaatccagatacttgtagatatttacagtaactaaaggaagaggaaataagggtaaatttaaacgactttaaaattctgtgttttttttttttaagagacggggtcttgctctattgcctagataggagtgcagtgacaccttcttagctcactgtagccttcaactcctgggcaaagcaatccttctgcctcagcctcccaagtagctgggactacaggcatgcaccaccatgcctgtctacttttttttattttttgtagagacgggggtctcactttgttgcccagactggtcttgaactcctgagctcaaacagtcctctttccttggcatcccaaagtgctgggattacaagcatgagctaccacacctggcctaaaatctgtatctttagaggtcatcataaaagaatattatctcactgattacttttttagttattccatttgaaaggctgactttttaaaaagaatatttcctttgcttattgcagctgtaaaatatgaaacattaaatagtcagattttttccactctagtctgatgttgttagttgtcttatacatatccttactatagtacaaaaagtgaaagtgtttttttcctattacacgattgttacgtagttaaaactgacagctatttcagcttagtgacaactgctcactcatacgtcttaacatatttgaagaaaaatgttcaaattttggtttccctattttttattttatatactcttttaagcttttaaaaagatagtctgtaagtggccccctttttctgtttggatatgaattagagctttaggttaagtttcgttttgtggtagcaatcatttacagtgccaaattgtggttaatatcgagtatgaccttatttggtgacatcatttaagcatttttcttttagagtccagtttgagtattattttatgattgtgggcttaatccttccttgtaaataatgcattaaatacaaatgtttgcttatataatttaaaagaatgagtagaggcctgtaatcccagcactttgggaggccggggtgagtgaattgcatgagctcaggagttcaagatcagcctgggcaacatgatgaaaccccgtgtctacaaaaaatacaagaatgatctgggtgtggtggcacatgcctgtggtcccagctacttgggaggctgaggtagaaggttcacttgagcccaagaggtcaaggctgcagtgatatgacgaacataattttagcaaatgaaatgttccagtttttatgttactgatttttgctttttgccctaaatcttggtttcttatgtgaccacaattaaatcagaaaaagagggatttgcccacataggacagcctctatacttgggctcaggagtaccagtacaaggtgcagttagggcactggtgaggaagccaaggtccccagggccatcatggagcactactttcaagctatatattgcttagtgccccttggtgctcctcacccaaatcccagtttagaccagccttctgagattgtgaaaatatctgccatttccattagaaactcaactgtgtataatgctcaaagcatattctttactggtaacaaatcagcattatcttctttatgattttaccagattgttaccttttttttttgcctcgtatgcatgcctttaaaattaaatagccaagtcatgacttttttaagccttttaataaaataacttaatttcagatgctatgagttattatttttaaagcaattttaactgcatttcattatctgcagatattaccgcacagatcccaaattaaaatagaaccaaatttatagttagcacataagaaaatataatctttgtataaagctccagacattttgatagctgtagattctctttgaaatagaaatgttcaaatatttatgcttaatagaaagggtttattatgatggcacaaaaagtgtggtgagtagaaggacattcttttttagggaaacaagggacattttattgttgaagttcaccaagctgacaaatagagatgtcagttcaaagaaatcactttctctttgttaataggctttgcaaaaagaagtcataataataattctcaacttattttttatttaaacaagtgctccaaaaaatataatgaacaaaaaaatttaacatatttagagtttgagttccatatcatacgtgatattttggaagattacgtttttaaggtacatctgtgtgtatttttttctttttctaaatcatatgctataaattattttcatcctttgggttatataaaagcgtcattgtaaatgccattgatgaaagatacttgctcaatactccaattattgcactatttctttttaaatttgtttcaattctaagccccagcacaaatttgccaactctatttatagatgattcttttagctaaattacttgaaattgtaccgtctaccttcatttgaacaagttagttgataacacctctgacccagataatcatcaaacacatctcttcattgattcactcatttattcacttacgttttaaaaaatctatttatcatgattgtcacaaaaaaattgagatagttggatgtcgatattacacactttatgttctctttagatgaatgatacctttgagaggaaaagaatgagatatgtttatagaataaatttgtcagccccatgtctacaaagaaaacatttaaaaattagccaggtgtggtggcatgcacctgtggtcccagctacacagaaggctgcaaaggaaggatcgcttgagcccaggagatgaagcctgcagtgagctgagatctcaccactgcactgcaccctgggtgacagagtgagaccctgtctcaaaataaataaataaataaaataaatttctgctgaaatagtaatgttattaataatttttttcttcataaaacactaggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttggagagccctcagcttagacatttctggtcctaatcctcatttagtaatctttgccagttatacaatattatcttgcagcacatggggggcatgcagatcacctcaccccttctggtactatccaggcaactctttggcttaagagcataggctacagcaggttttgggtgtcttgggcaaatcacttcatgtcagtggacctcagttggctcatctctaaaagcatagttgactaaatgaatgatccccaagatcccacctagctctgaaagtctaatattccattcattcattttatatattcattcatttattcaccaaatatttttgaagtccctactaagtgcaaatcactcttattagatgccagtgatctattgtcagataagacactgccccttactagagctcacgttccacagggctggctacattaaacaagtaaatttgtagcttagcacggtttacttaacaagcccagttatgacagagctggagaggagagaaagctgtgttggagaggcaggaaggtgtgatgttcagccaggcaaagcaggcaagaaggtagaagggaccacaagaaggaggcctcagagtgtcttgggatcattaagttctcaagcagtccagtgacagctgcttgattgtttgtgtgaagactcactacatagaaacatagactgaattggcccggtgcagtggctcacacctgtaatcccagcactttgggaggacgaggcgggtggatcacgaggtcaggagttcgagaccagcgtggccaatatggtgaaaccccatctctactaaaaatacaaaaattagccaggtgtggtggtgggtgcctgtaatcctagctactcaggaggctgaggcagaagaatcgcttgaacccgggaggcggaggttgcagtgagccgagatcgcgccactgcactccagcctgggcagcagagtgagactccgtttcaaaaaaaaaagaaaagaaaagaaaagaaaaaagaaacatagactgaataaaagcataaaactacatccctgagttactttttcagaaagcgtaaaatggtcttgagtctcccctaaaagtctccttccaaaagcttttctgtcttcgatgatcctagtgaagatgtatatttcttctccttttgatgggtttccatgaaaacaggaattattttatgtgaaatataaaatatatattttcaataatagagtgtcaatctctaatgcatttaatacaactttatttgctttcttagttgtcttattcaaagcattatgttactgtgcaggatattcctatatgatctgttttgtttttcagaccctctgcaatgtgtccattcctcaagggtgacatactcctgttacacacctctgttttcccatttgtagcatcatactcataatttttttttttattgattggaattcccatagttgcaagtgacaaaaatcaagcttgaactagcttacaaaatagaggaaaggcttatataaacagggaaaggccaggagtataactttcctaatatctcccctcaagctggtaggttcaggagtaggcacctaacccaagctatgccaatgccttccctagaatttgtgaacttgggaacagagagaaagtgaatcagttcctctctacagagaaatgtttgggacctacagaataataaatgttaactacagttggtttgaggtgaacttctcctggccatgggagaccctttttgtctcatttgctactgtacctagcagagtgcctgcctcatagtaaattcacgttaatgttagttgaatgaatacatacatctattagtttcaagggtggaagctgtattgtactatcatttcccttatgaaattagatttgacttacacactaatttacagcatttttccaggaacacttttcttagtaaccatacaagctgattgaatgtacaagttggaaatgaaacttgaatattacaattgaatcttaggactggaaatattttgataaaccagtttttcacattgctcacctaccacttctgaaaactgcaaaataggaacaatgcaaagttatagtttgtggagtggtacaaattaagtttagagtataaagtctcagatatttttatcaagctttctgacagtgttattctctagtgaaaaataaaagacacagtccctacccttaactgtctcaaattcaaggccactttccagcaagggagcctgttaaaaagtacagatttccgggctccattcgaggcctcctgagcttaaatctaaagagtgggtttaagagtcagcattatttaaaatttccctgtgtgattcttaggattaaccagatctagtgcaaaaaatatgtttatgaatgcttgttttttttaatagtggataatcagaaaacaaaaagtaatccactctgtagaatagtattctggcattaaatgtgactatagaactttcatttctgtccaagatagagtaactgggaccagatttatcctctcatttgaaacaacccaacatataaaaaacaaaatatcatgaaagaacagttttcaagacattagacatcaggcaactaaggacagtgatctcttgtgagacaggaaacaaggtgacccatatgaatgccccaccatgctgccttgagagagtttccaggccacagcacagggaggggaactaaggcagagtaggcagactccctaaattgaggggacagagctgagagtctggggtgaccaaagcaactagagttcataggacagagtactgaagaggagagagctgcacacagacagaacctcagatctgcagaggatctccctcaagtattcagcagagtatcgatcagtgcatgtctaataggaaattccccaacactgagaaactccccaacactctccactttggatggaaaaaaaaaccatccaaaaggattggaaggaacagcgcctgcactacctgttcccaccagtcagactagaaaaatttctaattcatggctcattgtgtagagcgctcagggaagtcttatctctgtaatgagaagtaattagccccaaactgacaactgctccagacctgcctaatggatcatgaacgcaagacccaaaggatcaaactatgtccgagtaactgatctaagtctcagaacaaaacataagaatatttttaggaatacaaaaacatcaactatgcaacaaattcacaatgtctgacatctaatcaaagattactaggcatgtaaaaagaccagaaagtgtgacctataatatggagaataatcaatcaaaaatgacatagaactgacagataatagaattagcaggaaaatacactatgggattaatggcagattagacatttcagaagagattagtgaacttgaagacagagcaataaaaactatcaaaaatgaaacacagcaagaaaaagaatttttaaagatgaaaagagcatcactgagccgtgggacaacttcagtcagcctaatacatggttaattggagttcatgaagaagagaggaaaagaaagaagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaaaaaaagaaaaaagaaattttacacacagaggaacaaacataaggatgacatcaatgtcttatcggaagcagtacaaacaagaacagtgtcataaagtactaaaaacaaacatttctcaacttagaattctaaaccaagcagaagtatctttcaagaacaagaaggcaaaataaaaatgtcttcagacataccaaaactgaaagaattcagcagacccacactataagacccacagtatatttaggacattcttcaggcagaaggaaaacgataacagattgaaatctgaatctacaaaaagggaataaagagcactggaaatgatagctatatgggtaaatctataagttctttttcttattacttcaatctcttataattggcaatttaaacaaaaataacaatgtgttttagagtttatagtatatggaaaaataaaatgtatgacaacagtagcacaaaggtcaggaagaaagacatagaagtactatatactattgtaaggctcttatatgatgtaggggggataagggttatatgtgaagtggtataatatcacttgaaggtacactgacaagttaaagatagatgctataaaccctaatgcaaccactaaaacaacaaaatgaagagttgtgagagaaaacacaggagagaaaacagaataaaaaataatacaaagaaaggcagaaaaagataacagaacaggtggaacaaatagaagtcaaatagcaagaatatatatttataccagactgtatcaatcatcatgttctgcttgtaaaacatgcacttcatacacaaagaatagtttcaaagtaaaaaggtagaagccaggtttggtggtgcatgcctgtagttccagctacttgggaggctgaggcaggaggatcacttgagcccaggagttcgaggatgcagtgggctatgattgcaccactgtgctccgcctgggtgacagtgtgagacttcatctcttaaaaaaaaaaaaaaaagtaagaagatagaaaaagatatactgtgataacattaatcaaaaggtagctggagtagctttattgatatcaaaatatattctcagaccacactgggattaaattagacatgaataacagagagagataaatcgccaagtacttgaaaattaaataacacaattctaagtaacccatgaattaaagaggaaatcaaaagggaaattaagaagtattttgtaatgaattaaaatgaaccacagtatgtcagaatttgcaggatgccactaaagcagtacttagggagaaatatgtaccattaaacacctatattagaaaagaagaaacatctcaaatcaatgacttcagcttataccttaaaagtaactaggacaaaatggagtaaattaaacccaaaatgagtagaagagaagaaataataaagatcaaagtagaaattaatgaaatagaaagcagaaagcaatagagtatcaataaaacagaaaatactttttctttggaaagatcagactgatcaggaaaaatggctatacaatcacggggaaaaaaaacatgaattaccaacatcaggcatgagagaaggggcatcactacagagtctacagatataaaaaggatgataaagaaataaacagatttatgccaataaattcaacaacttagataaaatggaaaaattccctgggagacagaaactactaaagcttatttaagaaggaataaactgaattgccctatactatctgaaaattgaatttgtagttaaaaactattcctcaaagaaaactccaggtcaagatggcttcactggtaaattctgtcaaacatacaatggagaaataataccaattctatacaaactcttttcaaaacattgaaaaaaaaggaatttttcccagctcatcctagaaagccagcattgccctgataccaaaaccagttaagacattacaaagaaagaaaactatagactagtattcctcatgaatgtagatgtaaaaattctaaacaaagtcttagcaaagcaaatccaacaatatatgaaaaggttaatatgttctcacttcagcagcacatatactaaaatataaacagtacagaaaatattatcatggcctctgtataaggatgacatacaaatgcatgaagtgttccagatctttaaaatatatatatgttatgatcaaatggtgattaacccaggaatacagctttacttataatagcccaaaccaggaaacaattcagtgggtgagtggataaactgatatgtccatacaatggaataccactcagcaagaacaaagaacaaactactgatacatgcaacatcatggtggaatctcaaaataattatgctgagtgaaaaaaacaacaaaaaagagttcatactgtatgatttcatttatgtacagtgcaaacaaatctgtagtcagcaaaagttgactgtatcagcctttggtcgacaactatattatcagctttttgattgtcacattagtagttgcttagggatgtggtggggagggtatggagggatgggagaatattaccaacgagcatgaggaaacttttgggaatgatagatatatcactatcctgattgtggccatagtttcatacatatgtcaaacttatcaaattgtacactttaaatatgtgtatgtcaattatatatcaatgaaaactgtttttaaaaataataggcaacattaaaaatggagcaacagggaaaataatcataattagaagatttaaaagcactatcggccaggcatggtgactcacacctgtaatgccagcactttgggaggccaaagcaggtggatcacttgaggtcggcagtttgaaaacagcctggccaacatagtgaaccatctctttccttaccctcgtctctactaaaaatacaaaaattagcttggcatggtggcaggcacctttaatcccagctactcaggaggctgaagcaggagaatcacttgaaccctggaggtggaggtagcagtaagctgtgattgtgccactgcactccagcctgggtgacagagtctcaaaaaaaaaaaaaaaaaaaagaaaaaagaaaagaaaagaaaatagtgtgttaaaagcattatataaaatatatgtatatagcaatcaaaaaatcaaaaatagtatttttgtcatggagcaattttgtgtgcgtggcatactggatggtcttctccattttccatattttctttaattttttttaactggtaattaaaattatctaccgcaaaatcacaaatattaagagaagcactgtcatagtaattctacttttgctgaactttttattttttttttaacagggaatcactttaaaaatgaatgaactaaatcattgtattgttgcaagaattatgcatgggggcatgattcacaggcaaggtaagtttcatatatatttctttctttgccttccttaattttttttccctgtagcctagtgaagaaaatgtttttgtttgttttgtttttgagatggggtctctcactatgttgcccagactggtcttgagctcctaagtgcaagcaatcctcccgtctcagctttccacaggtgcatgccatcacacccagctaagaaagtataaaggatacatataaagaatcttttaaaatcatctttgattttaatcattattggcctccattgtttcttattcatctgcacaggctccagcatgtagataatgaagggagaatatattagagttctgttagccagagcatctctgtattagattactacttacggggaccacgggagataaagcaaataattacactgggcctcacgatgtaggagagacatctgttctagagtaaaagatatatgtaaataaataaccatttaagaagtgttctctcattcatttaggaattagatatgctatttataaattaggacatcatagagttaaataatacaaaaattaaatggtaagagatgtcaaatcgatgattaaattattaatacctgccatggtgagtgcagtcattctgtggagagaattcactaagaactggaatagacaaagaatgatgtgggggttttttttgagacaaggtctggctcagtcacccaggctgtgcaatggcacaatcttggctcactgcaacctctcctcccgggctcaagcaatcctcccacctcagcctcctgagtagctgggaccacaggtgcacaccaccatgcctggctaacttttgatatttttgtagagatgggcttttaccatgttgcccaggctggtctccaattcttgaacccaagcaatctgcctgcctcctcccaaagtgctgggattataggcatgagctaccttgcccagctcgaagaatgattttttaagaaggtgcatcttcagttaactctcaaggatgggcagggtttggatatgtggatttaggctttttctttgaaaggattgagttatatgcactagtatttagaggatgttccaaaaatgattcttctggcagactctctgtctttgagatagggttatttttgtacttaacacctctttccttacccccagagagcgagaagtaacactctaagcattttagtgccttattctcctcttgagaataagaggagatcactgtgtacacaacatgatgtctggcatcattgctgctttcagaggaatccttgtaggcgtagagggtgtacagcactcccacaggaggatatttggttttagattccagtatgtgttttttgtttgctatttttaataatttttatatgttcagtaaagccacaacatcattctttcttttttttttcttttcttttttgttttttattatactttaacttctagggtacatgtgcacaatgtgcaggtttgatacataggtatacatgtgccatgttggtttgctgcacccatcaactcatcatttacattaggtatttctcctaatgctatccctcccccagccccccaccccctgacaggccccagtgtgtgatgttccccgccctgtgtccaagtgatctcattgttcagttcccacctatgagtgagaacatacggtgtttggttttctgtccttgtgatagtttgctgagaatgatggtttccagcttcatccatgtccctgcaaaggacatgaactcatccttttttatggctgcatagtattccctggtgtatatgtgccacattttcttaatccagtctatcaatgatggacatttgggttggtcccaagtctttgctattgtaaatagtgctgcaataaacatacgtgtgcatgtgtctttatagtagcatgatttataatcctttaggtatatactcagtaatgacatggctgggtcaaatggtaattctagttctagatccttgaggaatcgccacactgtcttccacagtggttgaactagtttacagtcccaccaacagtgtaaaagtgttcctatttctccacatcctctccagcacctgttgtttcctgacattttaatgattgccattctaactggtgtgagatggtatctcattgtggttttgatttgcatttctctgatgaccagtgatgatgagcattttttcaggtgtctgttggctgcatggatatcttcttttgagaaatatctgttcaaatcctttgctcactttttgatggggttctttgtttttttcttgtaaatttgtttgagttctttgtagattctggatattagccctttgtcagatgggtagattgcaaaaattctctcccattctgtaggttgcctgttcactctgatggtagtttcttttgccatgcagaagctctttagtttaattagatcccattagtctattttggcttttgttgccattgcttttggtgttttagtcatgaagtccttgcccatgcctatgtcctgaatggtattgcctaggttttcttccagggtttttatggttttaggtctaacatttaagtctttaatccatcttgaattagtttttgtataaggtgtaaggaagggatccagtttcagctttctacatatggctacccagttttcccagcaccatttattaaatagagaatcctttccccatttcatgtttttgtcaggtttgtcaaagatcagatggttgtagatgtgtggcattatttctgaggcctctgttctgttccatttgtctatatctctgttttggtacgagtaccatgctgttttggttactgtagcctcatagtatagtttgaagtcaggtagtgtgatgcctccagctttgttctttttgcttaggattgtcttggcaatgcgggctcttttttgggtccatgtgaactttaaagtagttttttttccaattctgtgaagaaagtcattggtagttttatggggatggcattgaatctataaattactttgggcagtatagccattttcatgatattgattcttcctatccatgagcatggaatattcttccatttgtttgtgtcctcatttatttcgttgagcaatggtttgtagttctccttgaagaggtccttcacatcccttgtaagttggattcttaggtattttattctctttgtagcaattgtgaatgggagttcactcatgatttggctctctatttgtctgttattggtgtataggaatgcttgtgatttttgcacattgattttgtatcctgagactttgctgaagttgcttatcagcttaaggagattttgggctgagacaatggggttttctaaatatatagtcatgtcatctgcaaacagggacagtttgacttcctcatttcctaatcaaataccttttatttctttctcttgcctgattgccctggccagaacttccaacactatgttgaataggagtggtgagagacggcatccttgtcttgtgccagttttcaaagggaatgcttccagtttttgcccattcagtatgatattggctgtgggtttgtcataaatagctcttattattttgagatacgttccatcaatacctagcttattctgagtttttagcatgaagggccattgaattttgttgaaggccttttctgcatctgttgagataatcatgtggtttttgtcgttggttctgtttatatgatggattacgtttattgatttgcgtatgttaaccagccttgcatcccagggatgaagctgacttgatcgtgttggataagttttttgatgagctgctggattcgacgttccagtattttatggaggattttcgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaagaatatatattctgttgattttgggtggagggttctgtagatgtctattaggtccacttgttgcagagctgagttcaggtcctggatgtccttgttaaccttctgtctcattgatctgtctaatattgacagcaggaaacatcattatttctttaacttctctttgttatattactgcactggctaggaccggcagtctttcaaggagtggtatagtagacatcccgtcctattcttgtttttaaacggaatctaaagttagccgggcatggtggcgctcacctatagtcccagctactcaggaagctgaggtgggaggattgcttgagcccaggagttcgaggctgtagtgagctatgatcacgccactgtactcacctgggtgtcggagagagaccttgtctctagaaaaaaatgtttttttaaaaaggaacctttccaatatttcttcattaagaataatgtagatttttagtacatgccttttattagggctaaagaagttcctttatattcttagttgctgagcattttaattgtgaatgggttttgaatttaatcaaatgctctttcagaatctgctgagatgatcatttgtttttttccttttatctgttaatgtggtgaatgtcttttaaagatttcctaatgataaactacccttgcatttctcagataaactcagcttagtcattacatattatcttttttatgtactgcccgactgtctgctaatgttttgtttataagatctcagtatgtgcatttatgagtgagactggcccgtagttaattttcctctcttgtatttctctgattttagtttcaaagttatatctacttcacacaatgacttggagagtattccctcttcagttctccgagagattttatataatattggaatgatttgtgtcttgaaagtttggcaggacttgcctgtaaagtatcacagcctagtgttttggtttttagttttaagaaagttttgtttttgttttttaacaactgcttcaatttctttaacattaaaaggccatccaggctttctatttcttgagtgagttttggtaaattacattttcctaaaaaaaaataagttttaaaatattgcagagagcttcttcatagtattctctcatctttttattctctgccatctttgtcattatgcccctgttcatttctaatattgtttatttgtgcctactctttttttcttgatcaaccttgccagaggtttgttcagaaacccactctgggtttggttcattctcttcattatatgtttattttctgtttcattgttttatgacctaatttttattatctcctttttttttaactttctattggttttggctaactttacaaatttgacacatagttcatttatttccagtcttttttttttttttttttttttttgagacagggtcttgctccatcggccaggctggaatgcagtagcataatcatagctcactgcaacctcgaactcctgggctcaagtaatcctcctgtctcagactcctgagttaggactacaggcaaccacactcagctaatttttttaatactttgtagagatagagtcttgctttattgcccaggttggtctcaaactcctggcctctagtgatcttctcgcctcactcagcctccgaaaacactgaggttatagacatgagccaccatgcccagccttcttttcttttctttttttttttttttttttttttttgagatggagtctcgctctgtcgcccaggctggagtgcaatggtgcaacctctgcttccgggttcaagcgattctcctgcctcagcctcccaagtagcggggattacaggtgcccaccaccacgcacagctaatttttatattttagtagagacggggtttcaccatattggccaggctggtctcaaactcctgacctcatgagctgcccacctcagcctcccaaagtgctgggattacaagtggaagccaccatgcctggcccagccttcttttctaatatgtgcctttaagactaaactctccctctaagtactgtcttaatgtatcccaccagttttgacatgacgcatttttataactcagttctaagtatttttatatttctattatgatatttttcattgacctatattatttataattgtctgttacttttcacacttaacaggattttctgtatatctttttgtaatttacttctaacttaattacattgtggtcagagaatgtagtctgtatgacaccatttctttgaggtttgttgagacttgctttatggcatagcactttaatcgtttttataaatggcccacgtgtacttaagatgaatgtttattctttaattgttgcatgcagaggtatctttttgtaatgaagccaggtcagtgtgtacatttctgcacaatttataaataaggaagcaacattgtaaataacactctaagcattggttcttggtcatttctttctagctgaagtattacaagatgctgaaatgccaaccaaaagattaaattatctttaacagaatttgctgttgtgtagatattatcatgtcacaactcttggaaaattgacaaccttcgtatcatatctggtagataacgatagcagccaacactgtcatggtgcttggtatgtgccaagaacagttctaagccttctgcatttattaaatttgtttagttcttaaaacaatcctatgagatgggtactattttcatctccattttacaaatgtgaaaactgaggtatggagagtttcagtaatttacccaagatcttaaagctagtaagcaaggaagctggaatttgaacccaggcagtctggatccagaagccatacttttaaaccactatacataccacctctctcagaaaaatagatttctgcagccatccatcaaaactgtgccttccacaagtagatatatctgttttgatgaggttactacatgagttaaataattctgctgcaaccaaacttgtacctgcctctgaaatattggccctcaatattcaacttagtttttaaaaattacattgatgcctctggattttgttactatgaaagcatatatcatttcatgtttataatgttatataatttcttaggtacacttcatgttggtgatgaaattcgagaaatcaatggcatcagtgtggctaaccaaacagtggaacaactgcaaaaaatgcttgtaagtaaatgaaagtttttcctttcctaaaattgacttttactttgttagcttgtttttaaatatacaaataaggagtattcttctgtaatcagagaatttctggtaccatatttatgtggacttgaacttatataacattcataaaactgacaactagaaaaatgttgaaatacaatagagtttacaaacattttgcctgtctttagcagtgtgggctttaacactctccttttatcctttatctcctgtttcttaccaagcagatgattaaagaaaaccttttcagtgtttgtacatgtgaactagtttctcactgacctcaactctcctgacatcagcagtgtcagaaacctctttcctgttgagctgagtcatagccagctgtcgtggatttctctacagcatagaagggaggaaagccacggtagaccaggccatttttgaccatacatatccaaaatctgtattcaaattaggctttggattttttaaaaaggcaaaatgacagcctttgcctatgttcattgtcatagcaagcagacagaggtgtttggggcctctgatcccttttcccactgcagtgtagtagcacccaggttatgaatacctattaagtatgaaataagcttcacagactcaccaaacatttttttttcttttttttgagacggagttttgctcttgttgcccaggctggagtgcaatggcgtgatctcagctcactgcaacctctgccccccgagttcaagggattctcctgcctcagcctcccaagtagctgggattacaggcatgcgctaccacaccctgctaatgtttgcatttttagtagagacggggtttctccatgttggccaggctggtctcgaactcccgacctcaggtgatccaccagccttggcctcccaaagtaccgggatgacaggtgtgagccaccactcccagcccaaaatttttttttaaaaaaaagccaaaattaataagcaaaaagtggctgggtgcggtggctcatgcctgtaatcccagcactttgggaggccaaggtgggtgaatcacctgaagtcgggagtttgagaccagcctggccaacatggtgaaaccccgtctctactaaaaatacaaacattagcaaggcatggtggcgcgtgcctataatcccagctacccgggaggctgaggcaggagaatcactggaacctggaaggcagagtttgcagtgagccgagatggtgccactgcactgcagcctggatgacagagcgagactctgtctcaaaaaaataaataaataaaaaatttttaaaagtaaaaagcatattctatggggtacaccattataatgtggcatactcaatgtaatttttatgtaattacctagtctattgtctaattcaatgtatattcacttttgaaaggcatgtcacttagaaagttttgtattcacatctataaaaaggtgaccattgaagatctgtgagaccattgctgtatgagcaaaaggcaattggctgctgggcttttcccaggaacttactctactgttaactcgagcagtccctgcttcatgactacatttcattttccggctatgtgctctcagatggcttgtgctaattgcccccatgtgttttgagtggcttcttacatggttttgtgaacaattgtttgtaagaaaacttttctttctttcccaccaccccccctccagagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaaacggagtgtctgagggaaaaaaactaaaggccataattgcagtaatatttccaggaagttcattcacttcccttgttaagaaatcacatagatagttcttctttctaaggatctgagaagtgatctatttctgttgagatacagttgttcatacaattgtgacaggtctctagatggaagttaagtctgcaatgaattgataattgacttcactagagggaaataggcttttgcaaccttttgtaaaactgtttaaatttagaatggtatgtgatctgtaaacaagtaagttttctagagtaatacagccccaaagtttctttcttaaaataggcttatcctgtagaaattatagttcttccaacctatattattcagttttgtgttggttgttaaatgagattcaaaaatctattctttttgtattggaaatataaatgggcataaatgatatcatcctttggtcattgcacgttcagctcgagtgttatttattgaagcttgttctttcatgtgcatcttccgagagtatgtgcatcaatatgaagtacacacttcctaaagtttatttttaagactgacaggtaacttattggatttgtacttaggagaacctgagagagaattgtaatacttctagtctctagtgatggtgtaaatttcataagaaaaatcagaggcttcatattttttaaaagcctattgaagatacatattaaaatgtatagttttgtcaagtatatttttggtgagccatggcaattgaggtgtccgttgtaacgggtcttgagctcctcttggtggctttttatggaacttcaattaatagtatatttcaaaagaaaatgcagaattgcttctgttccaggattcagagtattgaaatttgttacctagaacacaaactttgctgggaaacaaagaatgtcacacttaacattctatgtaaataattttaatattccagagttacagatgtccttatatcatttctcatctgttgaagaaatttagtaaatacaattgacttttgtctttttggctaactaaccagaaggtactgttagttattaatacaacataagtttctctttttttttttaaatggtcgaactagtttggggtggaaccagtatcatagatgtaaattctatgttcttgagtaagaagaacccctcttaccttctttgcctttgaatagtagaaaaaataatgatacttctctcctagctccacctccagcctttttggccctcctgttccctggcagaattcaagcttgtggttggactcttcccagctagggcaatacttcaaaaaaaaaaaaagaaggctctctggccacctgcatctgcatcccccaggtccttggttaaagagtagacccctgcccctcaccctggctctactgacttgagtctctgcgggtggcacctggagatcagtcttgctcactaacatatgagaatgctcttctaagggatctcattacctttaaggctgacaggttctagaaatgctcttaagtcatctggggaaaaaaaatgtcttttaaaaagacatgcacatttctaaggcttaaaagaactctacagaagcaaaaattaaaaagtacttatttccttcctctccttgttcttatcgttaaagttgatttggacactaagggaatggagcctggaaaatattttgagtgtatagaatagtagagagaaagcaagcgatagaggagcctggatataggaagagtggctgtggctcctaggatctttgctggaagtgtaatattgttataggcttgagattattgttttaatcaatctgctaaaatagtcttaaaaaaagagttcttctctgatgtatatctcttttacccttactagtaataatatttattctataatagaaagattctgaggtgattgtaacatgtgaaatcttaggtttgtttctcttcagattgggtcagttagtaactcttgacacaggtactaaaaattattaaatacttttcaaacctaatctttaataaaaattaggcagttgggatcttcagcacgataatttatggtaatgtttgtcatcttatacttgatagggttttaatatcaagtcactcttctgggtctcattaaaagaaagaaaaggtatagaatgttagagataggaaagaattgattaatgaatgacacagtcatcacttaaaatatgtgagccttcgaactgcaaaatttttttcatacttctgtgaaatcatgcaagcaagtcagtatggcacctatacagctcaaacctcaaaggaaatggttgtcagactgtggttgttactgttgatgtaaatatctctgtgtttctgtgctggtgttctgtgttaatgaaccttgtgtcttatttcagagagattccccttccacttccagacagtccccagctaatggtcatagcagcactaacaattctgtttcggtaagaactttagctccacacagcaaagtgtgacaattttgttggtgctcacctgccatgagtgttctagttacatgtgttcagtggaaatagtgtcttctgctgatatacaaggctactacagctacaatgcactttactcctggaaaatctttttcaacatttccttctcattaaaaatccccttcaatagttaaatttgaagaaatatagttcaagactgctttggtcattctaaaaatatttctatgccaccccatttgtatgtatgactttgctcaaacctatgcaaaggatgtaaacggaaatttgtttaaacttctaaatattttttaatttgaaaaagataaatgtaagaattttgcagagtaggcatttgggtattcttgggctttgtagttttctattctgagtgatatcagcaacatgttttagtttccgctatctaagtttacgaattggtgtgccctctgttattgtggtacgtgcacatatttttgtgaattataagccttgcctggatatgaaaagcaaaaagaactggcttcaaactgcacttaagccacgctgttatcacatctttaacacaaagtactttatatttgacttgaacttggagttttaaattttttcagaactatccattttggaatatagaaagaattgtttttaacttatttaaacaaatggaagcacttaacaggtgcagactggcaatattttggttgctaatactgctgtttatgacccagttaaaattattgagagttctaataatgcagcagtattcttctttcctgacttttaatttgccctttgagaatatatcaacttttttatcaggtaaaattgtaaataatttagaaattatctcaaatggaatgatattctaagtatatcgtaagagaaattatgaaagaaaattgtctatgactttattttcaactttaaaataggctaccaaaggaattcattcataacagttaacatttaatacttttaagatgatgaaaagccatatagccattgaatttttcaaaatctaaatggttgcagtgactaagttgaaaagggcaacagctccttttatttattttttttttttaataggctgtttcacttgcagtggcttttgtgttgaagatgctgagttgtttcttaagaacacattttctctctgcttaaacttacctgctttcttcagcttgctgctaaatggcctgggtttgactttttgataactcaacatttctgataaatggaataatgtatattatctctttacaacttaaatctagctcatttttttaaccatattgtaacagaacacacaaattactttgtactcttgaaaaataaatgaaaatttttctcctgggttggctttattctacaggacttgccatcaactacccaaccaaaaggacgacaggtgaatagatatcctctatagaaacttctctaaactgagcagctaatagccaatcctttattaaccctttccatcccataatgtttgcattttggaccataacatttgagcattgagagcttgtaccatttcattttaacacattacacatgactaattctctataaagaatttttcctcacatctttgtagctgtaatggttattgtaatttcaacctgataattttatattaatggttaagaattcagcctttgggggtggctgtgggcctgcctctggcatgcaaaagaattttaaaggttataaaattcttagaattctaagactaactaaaaagttattcttaaaatgctgatgaacatttttaagcaaaaattttctgaagttgaaagctttttcttaaatttgtatttgcatgtgtatttctaaaagccatttgcaatgaaaaataagaaaagaatataaattatcttagcttcacatcctgatatacctgtgttagttcaaacatgaaaagttaagtgctgcctaacactggcaagtaactttcaaattgccagcactttagaggtatagattttaaatgcaaatgcagagacttgtaattttataggctggattgctgaaaataaacagaaaaatcacacagtggttccaaagtcttcaggttggttttacagtgacttaaacattaatattcaattttaatttcaagagatagaatttttatgggatttttatcttgaaatatggtattaaaaataatcagatttagtgttaagatatgtataaattagtacctgatagaattcacccataattttgtcttaagactgtataattgatggaacattgggtatgaattaccttatcttaaagcatttaaaaaataaaataattcataaaatgctgccatataataaacccttgaatgctaatctatttcctaagtaaactcacatatcataaaactcagagccttgaactatgcatgtcttgaagctctgtgctgatttcaagtgttacattgggggaagctagggttcaaattcatttttattctctcagaagagtaaaatacaaacctaaaacctaaattagaaaaaaatgaagctttttttaacttttaaaaaattgtttgagttacacttaactttatcagcaatgtgtagacacactgccagttgtcatataagcattctacagcaagataccaacccagagttcttgctaattttatatcgtgtgctgctttagggttaaaacctatcctgactgctagtatttatggcttaaaggctgccacgcagtcatgacaacgtatccataatgccagcatcaccaatgcaggtttaaaaaagagcgagcatacttttctataattagaggcctattctgttacagtaaaagcataaattaagtctttatttttattaaacaagtatttcaagtgttccttccaaataaaaacagcaaagttttgaagctatactcatcaaagattactagtacattgtttctagcggtagaagttttttgtgtcgtatttccatgcatcgtttttgctttcaccatctgatgtcctgtttgtattgtaactgttggtgtgtggttatgacattagagctaacttctctttcacatcactatggcatcctttcttacgaactcctgttttatagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggtatgtttttatgcgtgttttgctttgcttggttataaaaacaaagccctgaccatccattttccaattttatattattttagagtgtaaaacctgtttgatatattccttcctttacgagccaaacaaaatttaaattagtcatccaagaattctatatcttcagtatctagtgagatcctagttgcagagtcagggcttcattttacacaaaaagaaaggaaggtctggaaagagattggatgagcagccctgagccaagtcatggtctcacagcagagccctccactcctatatgctgttataattgttttagaatggcattaaaaaaatgtacgttctccttgcccttctacatgctttcatgcccatcccattcccaccaccagcaaaaaatgtaggtgcagtgcttcagtgtcactcagagtatttgaagataaaatgtatttcactgttagaaggaggtagtcagaagctttgttctttaccttgccagtcctttaaaaataccttttctgctagaaagtttaagccctaaaagcaggctaaagttaggggttttaggcactgtttttaactgagagaaaaggagtcacagatcactgtatattttgataaaatctatttctgctattattgttaccgtttccttagttgaactgtcttttggaaaatattgatggttttacctttgttggtacttgggcaatataccagattatttctagcacaaaagagataatgtctgagttttgtttcatgtggcaaaaaataacagccattaagcatcctgccagttcctcctaaaatacttgaacccagctaaaagagaccaaagacattgagtccatagaaatttctacctgcttttatctatttttctcactagttaagagatttctcagttaatctcttttgcttgatcgcctctttcagctatcccatgtttccccaaaaaatagtattaaatttagaatgttggagctgatgaggacttcagatgccatcattttatacataaggaaacgtgggcccaaatggagaagcagcagccttccatctggcattgtctttcagtctgatcttcgagaaacagttcaagcataagcaggaggaaagcaatctttaagtcgttgccgtgatgatgccattatattcttactgatatttacattttacagaatgtcttctttaatgttaccatatattatgggcatttattgaaaataattgtgtagattccagacctcttctgcctagtcagatcatctatataaatgtttcaccaatttctagaactctgagtcctctggaggaatcctgagtgatggcagtgcaaaaagcagatttgcttcctatttcctgtaatggtggatgagattatttggataaatcctcctgatgaaaaaaaatgaaaagtgccgcagaaaatatgtttttcaaatgaccttgaaagcactgaatagctgaaaaggtatcaggggccaggcatggtggctcacacctgtaatcctagcactctgggacgccgaggtgggcagatcacttgaggtcaggagttcgaagctagcctgaccaacatggtaaaaccctgtctctacttgaaataaaaaaaaaaaaaaaaattagccaggtgtgatggcaggcacctataatcccagctacttgggaggctgaggcaggagaattgcttgagcccgagaagtggaagttgcagtgagccgtgatcgcgccactgcactctagcctggacgacagagtgagactctgtgtccgggaaataaaaaaaggtactggggagctcagtgaccaattttttttttttttttttttttttttgagacggagtctcgccctgtggcccaggctgcagtgcaatggcatgatctcaggtcactgcaacctctacctcctgggttcaaacaattctcctgcctcagcctcctgagtagctgggattacaggcacccgccaccacatatttttagtagagacagggtttcaccatgttggccaggctggtcgtgaactcctgacctcgtgatccacccactttggcctcccaaagtgctgggattacaggtgtgagccaccacaccaggcctcagtgaccaatttttatgtgaaagcctttaataagaatgataagtggaatatcagagttaccaagtggcccattttgcaaacagggcatttgtcattactgaacacttctgtgccagagaaccaaggttaagatctaaggccagtacaagttggggaatctgttagaagaccctcctcattgttaggagtgcaagaggcagtccccccaggctaaaaggaaacagataagcatacccttatttcccttcaacaccggaggactatagagaaagctgccttgtcactgagcaaagcaaaagatgaggaaattgggaacaaacttccaaattgtggccaccagtccaccttgaatggatttgcacccaggtacacacagcctggggcagccaggggagctgaagccatgtacttgatttgaagtttcccctttctttactaatagtttcagatgtatggtataaacagaaagtctctgaaggcaaacacttttatcctaacccccactaacttcatcctatccgcccgacataaactttttccagggcagtagccagcaagtcaaaattatcaggcacacaaggaaacaagtaagacccaacagaaatgacagatagtagaaacaaacccaaacctactgcatatattggaattaagagacaaagattttaaaaataagcttacgaagttggttcgtttgtttttgagacaaggtattgtgctctcgcccaggctggagtgcaatggcatgatcatggctcactgcagcctcgacctcctggacccaagcaatccacccacctcagccttcccagtagctgggacaacaggcgtgcaccaccacacccagctaatttttttctttttcttttttttttttttgtagagatgaggtctcactatgttgcccaggctgatctccaactcctaggctcaagtgatccttccaccttagcctcccaaagtgctgggattacaagtgtgagctaccacgcctagcccaggtttttaaaaatcaataataagcttgtaaaatatcttcagagagcagaaaaaaaatgttaatgacatagcagattttaaaaagaaccagaggaacatccagggggaaacatgcagtaacaaaattagaatctcagtggtcacacctattagaatggctaacatttttttgaagtttcatcagtgggtaaatagatcaataaattgtgatatagccatacaatggaatgccactcagcaataaaaaggatcaaactattgatatatgcagcagtatggatgaaacacaagatcattatgctgagtgaaagaagccaggcaaaaaagagaacacgctatatgattccatttacataaacttctggaaaatgcaagatgggggtggagggagggaggaattacagaggggcatgaggaaattctggaggtaatgaatatgtttttctttttttggagacggagtctcgccctgtcacccaggctggagtgcagtggcgcaatctcagctcactgcaacctctgcctccccggttcaagtgatcctcctgcctcagcctcccgagtagctgggattacaggcgcctgccaccacgcctggctaattttttgtgtttttagtagagacagggtttcaccaggttggccaggctggtctcaagctcctgacctcaagtgatctgcctgcctcagcctcccaaagtgctaggattacaggtgtgagccaccgcagcacccagccatttttattttttattttttatttttattcttctaaagtcaaggtccctctctgtctcccaggctggagtgccgtggtgcaatcttggctccttgcagcctggaactcctggattcaagcaatccccctatctcagcctcccaagtagctgggattacaggcgcccgccaccacgcccaactaatttttaaattttcgatagagatgagatctcactatgttggccaggctggtctcgaactcctgacctcaggtgatctgcccgcctcaacctcctaaagtgttgggattacctgtgtgagctaccacacctggctaagaatatgtttttcttgattgtagtgatagtttcatgggatgtttacagatatcaaaactgataaatttgtatactttaaatatgttcaatatattgccaaaaaactgaactgttaaagttgcaaaatatatagagggagaaaaggattctaactgagatgataagaaagaggcccactgggcagtgtgtaccccaagacctgaataggactttgggggtataggaagctattcctggcagaagagaaagatcaattttcctttgcttggaaactgaattggcctctgggatgtcagtgggcatccaatactaacaagaaagatttgaaacaattgtatcagccagacccccaaaactttgatcaaatatattgctaccaagtcacattcttcacattttctagatgagaaatcagttttttcggacccaaatgccttactctaggcacatcaatttagcccttcaatatattttagctcccggactctgtcatccctccccttgccttgcctacaagatcctgatctaagccatcaataaattggtaggcatgtgtttgaaatttccttccaggttgaccttaaccctaacacggtttctgtgcacttactgagctaaaagagctaatgtttatttctgcagtgtctggtaaaaatcaatttcattcctctgtcatcacaccacatgagactatgccacaattttttcctgggaacctgtatttttgttttaagcttaagaacatttattataagatactctctacattgtaacataagcttcacaaggtcacacgattttgtctcttaacctgtcaaaaaattcctcaattctgtttgtttccaaagattctatgccttttagttctgactaatagcacatattgacttgcaccaaaagaatccccaaagcaagcctttatcagcctcctctgtatgccacgtgggtaatatatggagatggactttgatactattactgagagttcgcagtattttccaataaatgtctttcccccaaccaaaaataaatacataaaaacttcagtgaacaagagcgagtaagagatatggaagacagcctctttaagaaaatagaaaataatacttcccaaatcattttatgatgtcaacattaccctgataccaaaattcagtaaaggcagttcaagaaaagaaaactacataccagtatctgtcatgaacacagaagtaaaaatcctcagcaaaatattagcaaattgaatccagtaatatattaaaaagataatatattatgagccagtggaatttgtactgggaatgcatagctggttcagcatttgaaaaccaatcagccgatccactagattaacagactgaagaagaaaatccacatagtcatatcaatagatgcagaaaaagcatttggtaaaattcaaaacccaatcagattaaaagtctcataaactatgaattgaggggaacttaacctgataaaggacatgtatagtaaacctacaactaacattactagaaagggaaaaaatttgcagatgatatgattctgtgtgtagaattcaaaggaatctgtagacaattagaattagtagcaaggtttagaaaggttgctgatataaaatcaatatacaagggactgggcgtggtggctcacgcctgtaatcccagcactttgggaggccgaggcaggcggatcatgaggtcaggagatcgagaccatcctgactaacacggtgaaaccccgtctctactaaaaatacaaaaaaattagccgggcctggtggtgggcgcctgtagtcccagctacttgggaggctgaggcaggagaatggcttggacccgggaggtggagcttgcagtgagccaagatcgcgccactgccctccagcctgggcgacagagcaagactccatctcaaaaaaaaaaaaaatcaatatacgaaaatcaattctatttacaagccacaagcagaaaataaaacttttaaagggtaccatacataacaccacttgcaacaccataatattataaagtgttcttgcacacacacaaaacaaaactggatctgattaggcctctaggttttattacctatttgcaggaaatacaaaggacagagagacatactaaagataccacagggacacagtcagaaaaatccagactctacagaaactaaaggacaaactagtttctacaacaaacaaattgtaagaaaagaaaaaggagggagagggaacctatagattttaaagggatttcagaagaaaactgtactcttggatttgttccaaaataatctatgataaggtggtataaataaagccaggcgcagtggctcacacttgtaatcccagcactttgggaggacgagacgggcggatcacctgaggtcaggagttcgagaccagcctggccaacgtggcaaaaccccatctctactaaaaatacaaaaaaaattagctgagcgtggtggcgggtgcctgtaatcacagctacttggaaggccaagacaggagaatcgctggaacccgggaggcggaggttgcagtgagccgagatcgtgccactgcactccagcctgggcaacagagtgagactctgtctcaaaaataaataaataaataataaaaaaataaaataagctatgactaataattgtcaaagcagggttgtagatagctgggtttcattacactatatccttgtatgtgtttgaaagttttagtgttacaaagtgtttcttaaaataccatttacaaagcctttattaaaaaatgaccaggcgtggtgactcatgcctgtaatccctgcactttgggaggccgaggtgggcggatcacttgaggccaggagttcaagaccagcctggccaacatggcaaaaccccgtctctactaaaaggaaaaaaaaatacaaaaattagctgggtgtagtggcgcacacctgtagtcccagctactcaagaggctgaggcatgagaatatgtcaatcctgaaaggtggaggttgcagtgagccaagattgtgccactgcactacagcctgggcaacagagagagactctgtcttaaaaaataaaataacctaggaataaatctaacaaagatgtcaagacatttacagaataaattataaaatttattgagaccgggtacagtggctcatgcctgtaatcccagtacttttggaggccaaggcaggcggatcacttgagcccagaagtttgagactgtcctgggtaacatagcaaggtccagtctctacaaaaatacaaaaattaggccaggctccgtggctcacacctgtaatctcagcactttgggaggctaaggcaggcggatcacctgaggtcaggagtttgagaccagcctggccaacatggcaaatccccatctctactaaaaatataaaaaattagctgggcgtggtggcaggcacccgtaatcccagctacttgggaggctgaggcagggagaatcacttgaacctgggaggacggaggtttcagtgagctgagatcgcaccattacactccagcctgggcaacagagcgacactctgtctcaagaaaaaaaaaatgggtgacatgcacctgtagtccgctacttaggaagctgaggcggaaggatcacttgcacccaggaggtcaagatgacagtgagccaagattgcaccaccgcattccagcctgggtgacagagtaagacttcgtctcggcgggggtggggggggaattatatctcgagacatttaaaaagatataagtaaatggagagacatactgtgtttaaggactggaagactcaatattgcagggatgtctattcttcctagatagatttcatagataagatgcaatcccaacagttttgaaattgacaagctaagtttaaagtctacatggaaatgcacaaggtcgggaatagccaaaatgctcttgaagaacaaggaaggaggtcttgctctaccagataccaagacttattataaagctatagtaaacaagataataaggtatgggtttagagatgctcaaatagaccagaaaggaatagagaacctgaaaacactctcatacgtaaatggacacttgatgtgtgacagaaatagcactgcacagcaatgaggaatggacaggcttttaaataatgtaggacaattgggtatccattaggaagaaaaaaggaattggacccctcctttacaccataagcaaaaatcagttctaggccgggcgcagtggctcacgcctgtaatcccagcattttgggagaccaaggcaggtggatcacacgaagcaggagttcaagaccagcctggccgacatggtgaaaccccatttctactaaaaaaatacaaaaattagccaggcatggtggcacacacctgtaatcccagctactcaggaggctgaggcatgagaattgcttgaacctgggaagcagaggttacagtgagccgagattgcaccactgcactccagcctgggcatcacaaggagaatctgtctcaaaaacaaaaaaaaaacagcagtactagtacattaatacccaaaatgtaaaagacaaaactataaactttgagaaggtaatattggagaatatcttctgggacaaggaaggatttctttttatttttatttattttttatttctctaaagtcagggtctctgtctcccaggctggagtgcagtggtgtagtcttggctcactgcagcctggaactgctggactcaagtcatcctcctgcttcagccttcctagtagctgggactacaggcacgtaacatcacacccaatcacacccagctaatttttttttgtttgttttttgttttttgtttttttttgtagagatagggtcttgttatgttgctcaggctggtctcaaactcctggcctcaagtgagcctccctccttggcctcccaaagtgttgggaaatcccctgctaaggatttcatttttgttttttttttttttttttttttagacaaggtctcgctcggttgcccaggctagagtgcactggcataatctcaaatcactgcaacctccacctctcaggctcaagtaattatcctgtctcagcatccggagtagctgggactacaggcacatgccaccacacccagctactttttgtattttcagtagagatgggatttcgccctgttgcccaggctcgtgtgaactcctgagctcaagtcatccacccgcctcagcctcccagagtgctgggattacaggcgtgagccatcgcacctggctgaggatttcttaagatatcaaaaatacttcccattaaagaaaagactgataaatttgactaaattaaaactaataagttgtgttcatcaattgataccataaagagagcaaaaaggcaaaccacagagtagaagaagatatctgcaacacgtatattaataactaacaaaagcataatatctagactatataaagaatttctacaaatctatgagaaaaagacaactgaacagaggaacggtcaaaagacttgaacagacacttaacgaaagaggaaattcagtagccattaaacatatgaaaaaatgatcagtcttactaatgagtgaaacgtaaactaaaatgtaaattaaaaacacagtggtattccattattcatccaccatgatggctaaagttaaagacagataataccaagtgttgccaaggaaatggaacaataggaatgttcatacactgctggtaggagtgtaaatcagtacaatgtcattgtaaagcaacctgccatttacaatagcaccatatggcattctgatcgtgattttggactcttatatgtgactcacttggggacccttggttggcccccatgagcaaaatcattaggagagcaaagtcttctgtggcaatattctgaaaggcaagtatttgtttagactgaacctgaaagagcaactttttaatatcatctttatgttaccaatgctggatattatagatcaaaattataatttcctgattgtggttataactgtgaatttaatcagagcacactttttatatcttatcttagaatctccatgtagcagtagtgccatttgttaagcatatactgtgtgcctggtactgtactagggacattatttacattttttgttctaaacctttacaatagccatccaaaaggctccaaaagtttaaagacactgcggatagaatattctggctaagatcatgagctctggtgccagaccttccccactctttcacttattagctgtgtgatttggggcaaattgcttaacctttcattctttcaatcccctcatctgtaaaatggtgatgcaattccctgtgttgttagaaagattaaaggagttaatacatgtaaagttcctaggaaagtgtctaacattaagtgctcagtaccagctaacaagtgacaaagccagaattcaaaccaggcctgtgttgaaacattctactgtatctcatggccacatgtttaggcatctaatctgagttgtcagtatatgttcaaggaataccatgccattttaatataagcctatattttaaaaacatttctaggaaattgtcatgaaaaccaaagaatagcctttgtccaaattttttaaaagattaggatgagtatggttatgctgttttatataaattcttcaaatggatgactcttctattttatcaaccagaattataaattcattttattttatttttctttttgtatgtgctaggcgagtagcttgcattgccatggagaagaccaaacaggagcagcaggccagctgtacttggtttggcaagaaaaagaagcagtacaaagataaatatttggcaaagcacaatgcaggtagggaaaagcacaactgttactgaggctgggttaagcatctccaagacctaaaaagatgtaatattttaattcagtcttcagtgttctctatccaaaaaattctaccatatgagatcttcatcaactttcaaaacctttaagaaacccctacctccaattaatatgttgattatttgctagatattttacagagctatactttataggacaaaaatgttattttgaaatagtatcctctggaatgaaaagaatccaacacgttaagtcctcccctgagaaatgaaagcttgagagtttgctgagtagccaggattcttatctatccttggctgggattggtcttgaacagatctcctcccgcctggctcctgcctggcccttgggcgtggccctgagataaacatctgagggtagaggtgtgctcttatcagagaactgtgccacaaatggttctgtggttggtttgagagagtacaaatgacatggacactaacttggttttgtccatttctgtgagtcgtcttcttccctcatggtatttccaagctaccacaagagcaagaatcttatcttggccttccctttatagtatgtatgtttgcccatatggaagtttgtattcaacttaagtcaaaatgttcacttgtcttgttgaaaactggaattaataccaaaaaggcatgatctgttgttgcaatagaatccccagaagattcacagggtgcaacttaagctaaagaaaatgcatggtgatacacaggagtgctaatacaagaagttattttcaataacttcttaatacaactccttttataaggaactttttctgaggaattgaaagtcctgactggcattaggttagttcccaaggtttcagaaataactccaaaaattagaaatgtggcccaaaaaatcaagtgaatctagtcatgcatacccagattgatggcataatgtttctgacaagtatgaaatgcatttttctctgtaaatgttataacgtactctgaattgttcatttctcaatcagagattaaaagtaaacatttcaaactgctgtataatgtggaatgaatgtgagtggccacatgggttaagtttaaatggctcagttaaataaggaatcattcccttcgcattagttacattgtaccacatttttatttccaaaaacagtgtaatttctggttatgtactactacagagcagtagtttcataatggcttttttggttttatgaagggaagaaataaagcagactagttacacaaaatgtagcaactgttaagcaaatgctcaagtatactatttgaagaaatgcactgcagagccaggcacggtggtggtgcctgtaatcccagctacttaggaggctgaggcaggaagattgcttgagcccaggagttcgaggccagcctgggcaacagcaataccctgtctatacaaaataaaaataaactaaatagaaatgcacagcagtatcagcagaatgttgcttcacacaaaacgtcagtggttattaccaagtctccttagttgcccttacttctgtcagcttctaacagtctaacacaatctaataggctcacaaggagatgtgttgacatataaattgagaaatgtatgcatctcaccttgtaatttgtacagcagtgttaaatgatacatagatatagatgggattgaaattaacttacacctagaaaagcaaagaaatggctggttcaggctgtcagtttatcattagatttatgctgtactaatagaggtcatgtaaacatgagtattcagtttgccagtattctttaattcagctctgaggaaagtaagaaattcattgaaaaactagaattctctaaatgctgtcaaagagtcaatttaatcattaatttaagaattttgccagagaatcagcatccgatctggcagccagtgttttcactttttccactctttcaccaccagggtatcactgatcttcttccattgctcccattctctgattcccgttagatggtgcacagtggtcctgcaaacacacctgtaagcttaataggcagctggagataggaccaggaattagcacacctgagtaaccgtgcaatttgggcaaatcacttcgctcctacgggccttgaaatgagggaattaggttagtcaatcaaggagatcttttctaattctaaagatcagtgggtctcaggttctttcatcactgggcctgacaaatggcgatcattcaatgaagccaagtattcttgtactgtctatctcaggctcttgctctctggtagacattgcctatccaggttgaaagctatcacccttgacatagaaggcaggagcctaataggggtagaacagaattgctttttcctctgtcttttgacatttacctcctatcccaaaccattgacctctcttaagttcttgtcaacttagaatgaagaaaggaggggttgagaggacaggggagcctactgccaccacctgtttggtatcatcagtattttcctaaccagcggccgtctgggcatcagaaccttccttgccatgcttaaggggttgttctacatgtcagtgtgtgtcactgtgtataaggccctcctttgaaagaaagtctgagcttcttagatggtccttgcagagccccttaagtgtctttgtagaactttgtgtttaggcctatttgtgattctctagtcaggatatcattgttaggcttccctcacctgcaaaataatcactgtgagctctctttttagtttctctttttgggagaagattcccagcttttttccttgactttctgaaatacactgcctgcaaagcctagcattcctttctgtcaccatctcttcaggtttcttctgtgtcatcaaccaactcttccattttgttcattagaaagtccagaagaaccatttgcttagtattacctttgctttacaagagatcatagggtcaagtatttaatcagctgttctgcttttagctacgatgaaaggtcatcccaatatacagaagtgtccttataaagaattgctctaaaagagtgagaaacaaatactcttgacttccattggtgaggcagttgctttgagaacttagaaatatcatagcctttcataccaaaccagatgggctcatgggccacagatcaaacaatatctcaaaaggatttttctggcttttttagaagttgatggtaaaatacagtactctgttcttctgttactactcagtaaattaaaataagggctgtatgttttgtttcctgcttcaaatctttgagaattcatcatatattgatggcaagatccaaaccttatcaagttctgacattatttgtatttgtggtacaaatgaaggttgggaattttgtcattatctagaactggtgggaatgataatactagaattatttccatttttgtcgttaggaaattctacatagcttgttaaagtggaattctgttcaaactgtgttacctacaactcccatcataaagtgacagcctattcgctgaatttgacccataagtaaattttgtccctctaactcccacacacacagtgtttaagttttaataagtcatcacgtgtgaaagtcaggatatttaacataaaaatttgggtttcagagttcccttagaagaacaaggaatgcagcaataccaggtccactttctcttttagtaactctgggtggttaatatggcctttgaatggacgctcattctccagcacacactgtccgcaccactccctgtttttgcacctggcccacttcattcaaccacattagctacctgacccctgcgggcattcaagtatgtactccttaacccaatgctaccagtgtgcaatgctcttttgaattggaggtctttatagtatttgaagatcttgatagtgtttccagctgagacaaggattcaatgttaatggcttttttatggaaaaaattcaacctggaaagtagttacataaatacttaaaagaagtgtctggaatgttgagtagtttagcagaaaatcagggtaatatgagcaaactatgctagacagtatttctgaatccttgggaatagatttgattatggtgtgtgtagcttttacagcaaatacattttctgtaacatacagaaggtttctagccatgtatacttggtacaaaaagcattgtggtgtggctggaacaactgaactctagaggcattgagattcctcagcccccaggacttccaaaagtcattttagatcaagttactagtgtaaactttttaaaaatgtaggaagtcttcattaatttggtttcttaaatgttagagccccgaaatactctatttacatacacatatttgaacataggggatttctacagtaccattcataggtgtgcttaaattatgcttaataccacaaattagtactattgactttaaaagctattcttttttttctggaatacaagcaactctaaaggaaacaaaaagtagcccataaactcactgccctgttggcattaaaaataataataggctgtgcgcagcggctcatgcctgtaatcccagcaccttgggaggccgaggtgggcagatcacttgaggccaggagttcgagaccagcctggccaacatggcaaaaccccatctctactaaaaatacaaaaattagctgggtgtggtggcacacgcctgtaatcccagctacttgggaggctgaggcaggagaatcacttgaacccgggaggtccgcggaggctgcagtgagccaagatcccaccactgcactccagcctgggtgaaggagcgagaccctgtctcaataataataataataataataataataataataataataaaagtaataggcacacatggttagaaattacacatggtacaggaaggtacaaagtgaaaagcaaaaggcttccacgtctacactctctgaagaggttttcttgtaactattctcgataaaatgtctatgcatatgctagtatataaaatccgctggcttttatataaggatattgtcgaatttctattaaaatgagtttgtttcttaatgtgatttatttgccttgtgtttagaatattgcatgataaagtttattttatacatattatacttttattttactaatatatgaaaagccatatttcaatgacccctgtacatttttcatgctgtctcactcccaatggcctctgtgcatgtaagtaacctgttgaatgactatgcctctgtgtttttggtggttttcttttattaagtcctttttttaatcagcaagcaacttaaaacctttaaaagctcattctttaagtgctttcctaatattatttgtatctcttattttaaaataccctttttttattgtttctcaaccctatgaccgtgtggcaatttcatttagaccagagtaacctcttcatgctgctcatttatggttaagatattgatgtttaacatatctgtttcatttcattttcataacatgtctgtttgtggttttgatggttgacatctaactcattcttatgtgttttttaaaaaaatgacaagtcttaatttggtaggatcacagttagggctctatagagggataggtgtgtgtatataccattcggaaagcttgtgtcatcatcatcatcttgctcttttgtgagatgcttgcttatttttattaaaatatattaaaacatatctgcttgtcaatgcacttcttctgtaagcatactttttcttgatggaaatatcactcagagggcaataggtctaaaaaataatgccatcagcactcctgcttttatttttgcaactctcatcactccattactactgcagtataactaactagccctaccacagagagcctcatgttcattttaattttgtgagtctgccattctgaacacagaaaacatttcttggtttttagctattgctagaggatatgctttaaagactttcaatcaacctttataaatcaagttatcaaaagaaaacaaatgtgcaaaaacccattaatatacactaacctctattttaatatatcgtgtttctttttttatatattgtgataatggtgctttttgtttgtttgtttctgttctattctattcccaagtatcttattttgcattttaagtgattgggcaaatcactaatgttaagaactaaggtgatattcacagtcatttggccatagtgtttctaggagtagaaggttctcttaataaatgattggctaaagtaatgcagatttcggccgggcacgatggctcacacctgtaatcccaacacttcgggaggccaaggccagtgaatcacctgaggtcaggagttcaagaccagcctggccaacatggtgaaaccccatctcaacaaaaatacaaaaattgtctgggcgtaatggcaggtgcctgtaactcaggaagctgaggcaggagaatcgcttgaacctgggaggcagaggttgcagtgagccgagatcgcgccactgcactccagcctgggtggcacagcgagagtccatctcataaataaataaataaataaataataaagcagcccagattcctttattacatcatcaaatcaattttactgaatttattttaacccctctaaaatccagggtttattcaatattctttaaaaaaagaaatgtcagtatgtaactgacagcatttgggtatgaccatacaaaaaatattacaggaaacacagacatacaattttagccctttgtgagaatttccaaatgtgtgtgagaattggaccatgttgaatttcaacaggaatgggcatctgctcaggaaagttttgtacattgcttgaaattgcttttatcatagtgttaagaggcaggtttcagaaaaatatttgttaaagtatttctcctcagtctgtagtgattagagaactccacttttgcaaaggtttctgagctcagactctgcttcatgattctttccatcctgatccaccatacacaggctgcccatgtaatgggcgacaagttttcaggcccaggaaagcatgtaactctccttacatattcaagactttccattgagtggatatctgggttacagtaaagcttgtgagatgctcattgataagcttgtgcaatagttacagaacttgccttagaatctagcatgccaccttcatcaactctgttgaaagaaagaaccatgaagttaaagaccagctgtccatgcatttctcatccatctctagaaatgatctagctggcccctctcctggttaactttagttgcattcatgctatattcatgttggtcactgtctgtagactttttctttttagtattgctgacttcttagaattggaaaaatatgaacagcatgtggtttcaaattaattcatatgatttgttggatactacatgaaaagatatgtagtatcttttagatttggacattttaatgcatgtgttcagcatctttggatgcccctggttctaaagagcattttcatgggcttaaaaatgaaaatttctccctagatgctatatgacttaaattacatgtaagccatatatcataagttggattcatatttttaagacatggttttaatataactgtagttttgccagtaaaattataatttatgtacatgaaatagtcattctacaaatttacctttcttctaaatctttgcgttttagtgtttgatcaattagatcttgtcacatatgaagaagtagtaaaactgccagcattcaagaggaaaacactagtcttattaggtaagtttgattgtgtaagtgagttgcttattctcactttcaaaacattttgtgaacattattaagagttgtcagttttaacattctttttttctaaatgacataggcgcacatggtgttgggagaagacacataaaaaacactctcatcacaaagcacccagaccggtttgcgtaccctattccacgtaagcaatgtctcaatctcttttcattatatttttcctatcacttttttaactctataatttatgtatttttttctgattacataaggtataactgttcattgtaggaaatttgtaaaatcaaaaaaagaacaaggaggaaaatgagttaacagtaatcccaacccctctttccctataataagtgctataaatattttgttgtatacccttctaggcttctctgttgtatacccttctaggcttgtcttagtacagatatgtgtataaagtgtgtgtgtgtgtgtgtgtgtgtgtgtgtgtgtgtgtgtgttttaaataaaattagttttatccattctgtttgtaacaatttttctaacaatatgtcatacacattacctagatgaattattcttcagaaaaataagttttcatagttgtacagtttctgatatgacaatttttttcccttagttaatatttaaattgttgatttcttaccactttttaaacccaatcaatatgctaacagttgtttctgtaaagattttcaaatctgtaagatttttaattctccttattttccgtatcttattcttaacctcttgccctcttcattttctcaattgtaaaatgaagtaattcaggattgcagagaggatttgagatcatgtgtatgaagcacttagcagatggtggataagtagaagctatctaccactatcatttcattattatcatcattattctaaagtttaaaattttaggccaggcgcggtggctcatgcctgtaattccagcactttgggaggctgaggtgggcgaatcacctgaggtcgggagtttgagaccagcctgaccaacatggagaaaccccgtctctactaaaaatacaaaattagctaggcatagtggtgcatgcctgtaatcccagctactcagcaggctgaagcaggagaatcagttgaatccggaggtggaggttgtggtgagccgagatcgtgccattgcactccagcctgggcaacaagagtgaaactccgtctcaaaaaaaaataaataaaattttaaccccagaagctttctagcagctcagggttggaagagctaaaggaaaattattttttaagagcaacaggagaaaatgtgaagattggctccattctatagggccttcacatgccttcctgaagcaatgtcaataccacttacagttatctgtacacctcagagagccaggaggcttcatgagaaaaccttcatcccaaaaccttgtctgatttacacaagaaaagaaatgtatccaatagtgtctcatttggcactactggggttttctagtaaaacactttgaagtgttcttttaattctccttatgtctagatcatgagtacagcaagcttagctaacatttagcttcttcttaaccacgtaacaactgaacttccatgttattaaatggccagttaactagtttggttttaaaacttacctttgatgatgtcaatcatgactagtctttgaaatatttgaccctgtatgtgtatataacatatatctaactactgagatgactgaagatagtacaacatcaatatgttatgtaagttcttggctgggcgcggtggctcacacctataatcccagcactttgggaggccgagatgggtggatcacatgagaccaggagtttgagaccagcctggccaatgtggtgaaaccccatctctactaaaaatacaaaagttagccgggcatggtggcacacacctgtagtcccagctattagggtggctgaggcatgaaaatcgcttggaacccgggagctggaagttgcagtgagctgagatcttgctactgcactccagcctgggcaacagagtgagaccctgtctcaataaataaataaatagtaacgccggttcttcagcttttgatgtgcctagagaaagggcttctcttaaaatgtccacattttgatgaccacgagcactttatgttctaacaaacaggctagcaggaaagggggattccccattagtttaggctcatgtatacagaagagagtagcataaatttgttctttctcaaagaaagaaggaagcaaagaaattgagagagagagggaaaaaaagggaaggaagggagaaaagaaaggggggtagggagagagaatattaaaaccagtgttcctggctcatctagaaaaacatttcctaaagtgtgttttgcaggatactggtcctattagtatccacagaactagagcttattggcatatacttcagttacactcacttaggtgaggggtgggcaagccttttctgtaaaggaccagatagtacacatttgaggctttaaggccatacagtctatcacaagcacttagctctgctgttgtctcatgaaaacaaccataggcaatatgtaaacaaaagcacatggctgtgttccagtaaaactttgtttacaaaaacagacagtaggtggccaggtgcagtggctcacacctgtaatcccagcactttgggagactgaggcgggcagatcacctgaggtcaggagtttgagaccagtctggccaacatggtgaaaccccgtctctgttggaaatacaaaaaatagctgggcatggtggtacacgcctataatcccagctgctcaggaggctgagggcacaagaatctcttgaacccaggaggtggaagttgcagtgagctgagatcgcaccactgcactccagcctgggctacagagtgggactctgtctccaaaataaaaaaataaaaataaaaaaagacagtagaccatgtttggcccataagccagtttgtcacctcctgatttaggtcttccataataattatgggtatgtctggccacagtcattgtgttttcagtgtaacgtgtcttttgctgtatcctaacattctccttttgcaagatgttatagaacatcacttttcaatagaactttctgtgacaatgacagtacttgatgtctgtgcagtccagtacagtggccactaaccatacgtggttattgaatccttgaaatgccactagtgagactgagaaactaaaatttgaattttatttaattttggcttatttaaatttaaccatatgcagttttccatttttttattctccttttttccttctacacaagacccaactgcattaaggcatacagtgagttatattaatcttgggtcatttcacgtcttcctcctgtggtggttcatgaagggataaaatacatctcacctgaacactgaaagtttcaccaaaccagacaattcactggctactatggtgtgatgcacacagataaatatggtttctagaatttagttctgcaaagccactgggggtgagaacaggggatatgagatatacgctaaagaatccacagcttttaggaagagactgggtttgagtaaatctgttgggagtgtagtaagctcatcagctcagccttttaaacctcttgtgccatgcgactttgcagatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggtaatgcccagcctccccgaatgtctgacatcctgcctgcatgccaataagcacagattctgaaatcaaaaatgccatcagaaagtcacaggtcacataataatttcataaaccacagaaaagtatcagtaatggaggcgttgggggttcacagtctagaatgccagctgactaatcgttggactcagtgcacacaccatgtatttaagaagcagagattattctcttaagaggtttattatatgcagaagctcagtaaggttcctgattgtgtctacgcctgccagaaatcctacgatcatctgacctcaggatgaggctctggcactttgttatcacaacagccaccttccctctctgggtacagctcacgctggaccatcagagcctctaccagcacattatgttaatctccagtgagaaactgatcctggggcctgggtctgaaacacagcactagctttatgaaagcaagcatgagtgagcccagatgtcagagacagcagggatggaaacccatggtggctctcagcctctgccatttccttacctgagcacaatgcctgaccctgagcaaaaactaggagagagataaagacttggaagaggactcaaaagagagccagacacagagatgatgaaatggtttctagatatgtcttgcagtaggaattattaaacttgaaaaagagaaagctgaaggctttacatcaaaaatgctgacaagctgttttttcatctctgagtacaaaccaagtagatatgggaggcaaagtatagtaggaaggatttgggagttgtagacatcaaggtgggttataggagaggcttgtgggtgccatgtgactcctgggtctgccatttctaggactgatctgtaccaaatctcctttaacccttagaaatagaaccagtatgctacctgctgaaatagtagaccagcttccctcaagcaggctgtgtttcatcaggaggcttacctggctatcttaggcagggcgaatccctgttcaagggccactgtatgagacttggtcccctaaccatccctaaagcaaggacagaacctatatagccagagtctgtgtgacctgggacctgacagctcagtttctgggctccaggatcctaattcgtggccagtgggttcacccatttccgtttacaacacctgatggggttcttgaacttggaactttggaaaccacaaaaggatctgttcaaggggctagggaggaaagcagcagtagggtgaacactgccgtttacttaacaattaacttggacctatatagaactaaatatatgatgtgtaccacagattgatttttgtttaactactaatccctccttactagggattggaaaaatcttctggccaggggtggctagaggcaaagtctcaatcctggtcctggtcttcgacatcctctccttgggttccacactggtcttcacctgaacgtcgttttctgctggtagtaatgtctctagcagtatgctggctgcagggctcctcagactccctctgcattacctaagtccactttcgagggctttctgccttacctgcctccgctgctgccgccgccaccgccactgctgctgctgccgctgctgctgctgctccacccatagcgtccagctctccctttctccttgcccttgcacagccatgcattgctctgcactgctgagtgggagacacttctctcagcctcctcaggacacccacagcagttacttttacccattgcacttggccccaaagcacctcctcaccccggctgggcactctcctctgctcccctgagtgctggatgagctcacctgcactcttctctcctgcttcctgggtccctgcctctcagaactgtgatctctcagatccacctagccctgagggccggccataggcatcctggctgcctgagtctctttgggccagcggccctggggatagggattgcccaggtcctgctcctcctgttggtctggttgactacactggtcccaggccctcctgcgcaggccagcctcatgccagtcctggtctcacaatgaccattgcataccacagtacagctgagaatgcccgcagtctgcaccgactgggcttcactctcgggcttctctgccctcagcccagtctctcctcagctggacaaggccttcatcctgccttcaggatacccgtgaccatgaacaacttgctttcaggcagagcctcactgctccagggaggctctctccttaggacatttttctccatccccctttcccactccagcttcttagatgacccctctactgtatcttacagacaatttaatccaacaaacttgtattaagcccttattatatgtcaagcacagggtcaggagctaagaatacaattcagaagacaagatggtgaggatgaaattccttcctcattgtacatccaaaactgtccataacagaagggccttgtggcattttttagaatcctctcacttctgccaaactacatgtggaccataggaaaaccacctaacacatgtccagctcttttagtacaggtctaatactttatgccatcttatttcagacaactgaggcccaattgagcacgtctaataatactatatgataagatgttgtggtccaactttaaagctagaggatgatggtaaagacattaaactagaaagaaattaataacctagcttctcataaaatagtaatagattatgttcttatagtgctgtatattttgccaggcgttatgactccttacctaatccttgtaaccctatgagctggagatcagtatctagttttgtagatggagaaaccaaggcttaacataattgtgactcgattaaggctttacagccaattgaaagtgaggtgtgaagttgaactgtgttgatttttaaatttttattcttttacagtaaatccccacttcctttcactgtaccaccctagaagaggtaaccctgggaatccttaagatggttcaccttatccatagtagtacaatgtaaagcctcattttttcttaacattcagaaaaatctgtaattcagtcaaacctaagaaaagctgtagaatttatttctcatgaaaataaagctatggctcagaaaataatctgtgcccctaaagctgaaactgtaatagccccagtgtgtaatcagagcttaatgtgatggttttagattttaactttattctgatgtatccatttgtagcatgaaaaagttaatagtagcagaatatttgtagttttgcttttgcccacagcggaagaggtcatcatcaagaggcagcatacagtcttgttaggaatccatactttaaaacaagagccaggttctgaaccagagactattttgtgaaatcagttatctctcttgagatgggttctggggtcactgcactcttcctaaacccttagatttttgtacaaaatgactcagatgcttgcctctgtgtgccttttaagtttgcaaaccagaatagatatctgcctcttatacacttgggtcaaatgagtttctattccttgaggataataacctgagattaattattggccatagccaagccatagaatcaatttatctccacaaatgttagattaatgttactttgactatctgaatctagcatgctttcagtgatctttctagagcgtgctctttctctccctgtccatatctgtccctgtttctctctctctctctacacacacacacactctctctctctctctgtctctctctctgcctctccccctctctctcactctctgtctctctctctgtccccgtctctctctccgaatcccagagagattcggagagaaatatttgcccatgaacattaaaaaatgtgtgcctcatcctgagtcagaaaggaagagggtttagagttcatctttaagtcacctattaactgcctgagagaggggaatccttgtgagcaattccatttcctgtccctgaagtaactctgaacctcagccaggctaccacagcaccaaaagtggcacccacttgagacccgtaagtagtgcagagtatggcccaaagaccttcaagaacaagcgaggaaatgtgtggtgagtctgctgaaaatatgaggctgactagacaggaaaatctcaatcaggatttgaggcatcttagaatttttgaaagtacaataataaagtatagaaatagaaaaagctacaaaaaggaggagaaagcaaatatgctaaccacagggctactttagttactgtgataaacattaaatttggctctgaacttcctgacaaccagggcaaaaaaaaggaaatcaaggaatataacctgattcgtagacataagaggcatttggcaatgtgaggaacatggccaccattgatggttttatgcagtgagtgcagtctatggatatagaccaagggtgtgaatgcagtgcagagatgggcaatctgcaggaagctaaactaatgttccaagcagtttgttttctgctgttgtaatgtgatagctggaatggaaaacatgataaggactgggtagctggcaggctgggccactgagtgcagaaaaaaaccatttcatgcccagggtgtcattctctacttcatctgtgggttccgttcagcatccaggctgggtggacttccatctagcacttagagtagctttggggatagaagcaaataggattctttcccatctcagttgcccagaagcaggctatgggatgggtatatgtgtgtgaccgggagtaggggtgatgagaaaaccttgtctcagctgaccctgtattcacctgatctatgagcataggaaggaaggaaaaaaggcctaagataatactgacataaaggatatttctaagtgaagatccctgttagcttgcttgagctatatatggactttgtcataatgtttgttcctggcttaagtcttcagccacaaaaggattggcaaagaaattgccagttacctctttcaaaaattaacatatgcaagcttaaagagctttcttaccagaagaatcagagcctaggactttaagagttaaaaaactttgatggataaatacaatgtaccagtctccctcaacccacaagaagatgctgtgtgactaaaattcagaaatataatcctagtgaaagccaaccttgcactaaaaaaagaaagaacctttcatgtcaaatttgtctcttacatgcctgtatacacaaagaggctaagagagtcccttcagccaagagagtagagtgctctgtagatgaacctgccttaaaagacaagataaattctgtgcaaattatatctactatttttacattttaattttttcataagggcagtttatgctgggtgccatattgggcatgagtgagatagctgaacaagacacagtccctcccttcaaggagggtacccgctagtccctggggtcttgggtttcccacgtgatgggtacttcaggagcacatgggagggtctcagagctcacaaaggacttcccaaagaaaagagcatcagtactgagttctgaaggattactcagccaagcaaaagagtgagtggggaaggggaagagaggatgggaggttcaggcagagggagtagtaaatcaaaaggccaggaagccagagagagtctggccctttctggaactgaaagtagttcaggaaggctggtccatggagccaaaggagcagagagaaaggctgaagaggttaagcataggcatgcttgtgagggagagaggtgacattcatgctgaggagtatacattttatcctgaggccaagagggaactgttgaattctgagcaggggagccatgggttttgaatttcagaaagatcattccagtagcagggtagagtatggattggaaagcagcaaaaccagaggcagggcaaccagtctaattactattacaataagctgggcaaaagatggagcaataggaatagcgtgaagcaagcaaatttaaagaccatttagagagcaaaatatgtggggagcaggatagttaaattcttgtgtaagtgacagcaagatatttaccccagcgcatatgaattaatcacatgtcagtcacttgtgaattgggtacctgtatgtgttgggttttgttccttggaagggagtttgtaacctccaagataatcatatcctcctggggaggagctgaaacagtaatcccttagcagaatcaactcccacagcgtctgactgcagcgttgcagtatatctatccaaactagtagctggcatttagaggttttcaatgccttagaagggaactgaaagggatctcagaggcccttctgtcttgagtgcagcattttctcatgggcctatacattgcccacagccacacagtgtctttagcgacaggactaagacacaaagtctagggctcctaactccagccctgggcaaggttcccccttccccaggagtcccagggggcttttctgcagagcaacacacagttacagtggacagatttgctagcaatccttggctagcaatttgaaatttgaaatgtgagggagtggcctccagattagtggtaaaaccagccggcaggtccaagtctccccttaaatgcatttcctgttgattaaaattcaggctaaaactaatagccaggtttaaatgaacattaaccaacataatcagtgttaacttttatgaagaaaaatagattgattcatgagtcataagaaaaatgtccagtttgccaacttttattttctgatggctattgtccatcctttagaaaaaaagtaatataagttatgtataaagttggtaaatttaataataccttgccaaaaatttgagccaagagcttggaattttcagttgtataaaaatttttatagactcatttgaaagttacattagttatttcttcttttaagtcgggattttttttttttttcttaacacaggcactgaaggtcctgagaactgcagagtttgctccttttgttgttttcattgctgcaccaactattactccaggtttaaatgaggtaagaatcaatctgtttttccccaaataagctgtaaggatcaagccttactccccagcacagtcagaagcgtgtcagtctacatttgcagcaaggctgctctgatgaaatgggatgtggaatagaatgctacatgggacagtcttatcagtaagctgacttctaaaatctgaggacaaacaccctcactcccaccaggaccgaggcatcccaggtgtctcacaacctccagggctgccagcctattccctctccggatagggattgtgtggcccctggagtggaacctttgtggaatttctctccaggcccctgaagactaccaaacctagaaatcagctctgtccactgtcaagccagctcaagtcagaaactgccacagacatggtgctcatgagacttggctgctgacttagaaggttttccattgctgagcagatcaaagggtacttaccatgtgtctgctaagtgtagcagtgcctatcttctgtaggttccttagttaaggggagactcttataccaagttatcctgaagaccattgctttcacagcttctagaaatcatcagaggactcttgattgactctgttcagtcaacactgacctaaactcactcaagcttaaaatctaattaaatcatggcttggaaattttccctttgtgtacctttaaggaagattcaggattttgatttacctatgttactcatattttccgtcattatgtttttgtcatttcatctgcaagaggtatattcctttgtaaaattctaccttcccatcttatttaatacataagcatgtttgaaactccacattgtggttagcttttatccttcagttgccatgtatttttcttgaatcatcatctttgctttgtttttgttttgcctgttttcctgcccttttactaattttccatagctgccaaaatggtgcagaaaattgcctgtaagtaccagctaggaggtggtgaaatacagccgtgtttcttttaatagatttagaatgtagacactttgttcccacaaatccttgcttttgctgttagaataaaggcattttgttttcactgagttaaaccctgctcacgtgtgagtcaagcacacagacaagctgttgtcgaggaagagactgacaaatatagcttcgtcttaaaagattcttaagagggagctttatttttctgtaaagagacctacattaaaaatgtgatactttcagccataaattttcttgaatattttcatcagcccagcttgctgagcaaatcataaaccctgctagtggtttttgaagctcaggactatatattcaaatagaatcccgtgtgccagagagtgatgttgtaggaattgttccttttcatcctggtaggaagcactcctgtctttgggtgaatgcacatttgctaaaatggcgttttttgcattgtgttgattatgaagtaaagccacagtgaaaatactatgctttttaagtgcaagccgaactagaaggtgatgattaactggggtcttatctacactgtagtacttaacactaacattcaaagcatgccctgtcctgctttgaaatgccagtaaaagaggacaaaacaggtaggacattcttggttcagagtgccctgagagaaaagattgagttcctgtctgctgtggtgtctgcgcatgcccactgcagtgccaggacagaatcaagcaagtctctttatctcacttctagtcccctttcttgagagctgtacccagagagctgaggcttgcctggacctcccagcagcctcccaggaaaggtctcttgccaataacagaggggctttagagaagaggagaggaggggaggggccctaagccagtactgggtactacggctcctaggtccttgaaggtaccgcatcttttattttctctggagatctgtctctgtcacccagggccccaatttcctggaagaattgctcagtctcttgattttagatttaatacttgtaaaaccctataatgactggcactagtcagacaagtgcttgttcttttgacagcatttattaagcacttactatgtgtaaggcactatgcctaatgctggggcacagcaattacagggcacacaagacaagtttatgccctagctggagacatagccactaatcaaataaagaggtatttcgttatctctatgtatatttaagactcagcccaagagctcacccacctagtgtttggcaggtagggggtggttaatttgactcacaaagttccctagtgtcaaggttgaacttgccctttgggagttcagcatgacaaatatgacttgcgaagatatagaggcagacttctttctggtggctcttaagagacccctgtcttgaaagaactgccactctgtagcagaagctatacttgcatgacaaagctgggaccctaaactccctcctcctgttggatccctcttacaagagttcttaaaatctgtggcaagctgcagcttagggaacatcctttgttgcagcaaacctccctagagttcagtactccctagagttctcttccttctgtttttttcataagagatatgaggacctacgaacagtgacatttgtctagccacttctaatgcagaccaatttggggggattcatcagatgccaggtgctgtttattggggaaacagccttattccagccattatttgtaacactcaaagatcttttgcctctggcatcagctgctattgagtgagggccattatatgtaattgaattcctagaacgtgtggcacctttaagtagaagaggaaaaaatacaacttaatttgtcatccaagggcagggacttgttggtgcaaacacagctgggccctgaggcctggctccagtgagtgtggaggaccaaggggacgggggcaaagagctccagccttgccaccgtagccctctcgccaattgggagagtggcttgaggctagggcggggggcttcctgctggcctgtttgggccaccatagccactgtaacccacacctggcatggccctaccaagcctgactctggggacaggcacagctaggcctgagtgggggtggcatgtttcctgaagagtatctgttttctctggttcgtctgctttgtcatggaccctctgttgcatgttgagcaatcactgtctcctctgtcatggagcggacttggcctcatgctggcatatggcatatcagggtctggccttgactgtttctgacactgggatgaacaaaaatgtgaaaagagaacgaatccaactgatttctctcttctgtttgcttttccctcctctcatgcccacccctacctccatctcatcaccatttaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggt

SEQ ID NO: 5660 - DNA, 363966 bp, human
gccgccgccacctccctccgcggcgatcctcgctccatggtcctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcatttaagacggggtgctttcagtttcagcaaattccctcctggtgtacacgaacgtggaaagagttgggggcattcgaatttttaatgccttgttatgcaatgactgttcaatcagtgctcgagactcccctcgactgttgttgggatggtggttagcgtggtagagccgtctgctttgagtcaccgggctggtctagaatatagaactgacagtccaaatgctcatcctttcatctgtgttgtataattacgctggggaaaagcagggaatcagattaatcacagtgctgattgagaattaaatctgcagttcctcatctaattgtccattccttaaatctattttgaatagtttccttttcattcttgtcaaacagtactccaagtgcacaatcctgctaatttgcttgtgaaggaaatgctggcaatctgaagttgatttcctaacacagcgtgtattctgcggctttagaagttgaggagataagatttaagagcaaatttttgcttaataaggatcgctagagctaacattgaaatatcttacctctttttttttttttttttttttttggaagcggtgctttattgtctattttaaggtccacagttgggaaatgaaaccaagaccttaaagcagttggccctatctcttttaagttgtctgcagtactcaatttcaatttgagtgctaatttgtttccttttctttccatattgaggtattacagtgttgcctcacatggtgaaattgtgggtagagcttgctacacactttactcagacccaattgatgtgaggacatgttactccttgccctattgttacatgaccagccagacttaaaaggaaagtatccaaatgtgtcctgttaaagtgcttgtggaagtgttctagaacagcactgtccaaaagatatattatgagccacatttgtaatttaaaattttctagtagccacatttaataaaaacatacaggtgcaattaattttaataaaatattttatttaaccctgtagatccaaacttaacatttcaacatgtaatcaatatgaaaaaatattaatgaaatattttacatcttttatgctaagtctttgaaatcccaatgtgtattttacactaatagcacatctcaattctgacactaagctacatttctgatgaaaatcagaaatacttaatctgtatttaggtttcataaaatttgcgtttgcaaaagtatattcacatacccaagttgttcccaatatacataaaagttttccaataaccgaatcaagtacctttttctaaatttaaattttaattaattaaaattaaatacaattcaaaattcagtttcccagtcggaccagccacgtttcaggtgcccagtagccacatgtgaatagcacagttctagagagaaaaatgcatcaaaaatctccttggtttcctcattcttaggagcacccagtgaagataaattaggtgtttcccaaaagcctccaaatgactgtatgtgtgggtgaatgatgtttgttgcatcttagttatagctgatgtaaatgaactaacaaagtcataattggaaaatgtgagattaaaatgttaattatattgtgaagatgtaaaatagccatctctgaatcagttttggtaactagttctgattccttaaagtctggaagggtgatgatgtgatctctttggatatcaaaaagaaatggtcagaatcacattaacacagtccatattctgctgatttgtaattgatagaatatttttcaggaaacacccctgggagaaaaaaattcatcttttctgactgtttcagagctgcataaagaggggcagcaagctaattttgaggtgataggtactctatggctaccttaactactatgaactgtgaaatctcattcatatcctacaaaatctgacttggtcagtgccaattataaaatgccattatgtgaaataatgaattcaagctagccttattgttaaagaatgtaataatagtgttcctcaatctgagtaaaggttgaaggtttctctagtaaattgtcttagtatatattgatctggaaattgaaattagcttgagattttcttgcagggaccttgacagcatacatttttaacttataatttgttcacctctgaatttgaacagaaagcccttgaagatattcacatgtactgaaaacctttttattgatttctatccaagttctatggaattttgattttcttttttaccaaattagtatcacaagttgtttttcaccactagatcttaataggttttaatttttactaaggtactttaaaatagatttcacttttcaagactaattgactacccactcactcctctacctacgcaaccacctactcactcacccactgtgtacttggccttacttgatggcataaatgaaagttctcgtttaatttagacccttcagtgtgtttttttcccccttggttgagaaagataacttacagagttaatgaggttttgaaatataagatcattatttggaatatgttttctttccagtggttgcagcctttacccttgttaaagctgtctttgagggaacatgtgcccaatttgttacaaatattggaaggatgccgtttccctttttaaaaattaaaactcttttccctgtgtttctcatttttgaaaatcttgcagaaactcctttgagtgactgttggttctataacattttctatgtaactatcttttaaatgactgaaacaaatctccaataataagaccttatcatagtcccaaaacttcttgtcttagcaaatgtagcgattactggaaaggaagggcgttatgcaaatgaggttaatgactaatttttatgtcatgatcatttactgtatcttttacaattataagtaagtgtacaaccggtaatactacatgaaggaaatttaagacaattcatcgaaattaaaacatagaaaaatgcctactttcttggtacagcagtgtgtatgaaagggaataacaaaatacataccatttttaccttgtgttaggtgaatacttgccctgtttagtagcctgtagcttcagactttcctgctctggtaggacatacactaaaattggaatgatgcagcatgacccttgcttaaggatgacgtgcaactttgtgaggcatgctgtatttgcttactcctcgagagcacttttatttaattacagttacttatttatggatctctctagttcactaataaggagcttcctgagggcagggaatgtttcttacacatctttctccattaacacagtgcgtgcaatgtaactgcctttcattagctgtggaatgaattgagtagttttaataaaatctcattaaaaggcaaaaaagcatgtttgtcaacctcagagcaattattgtccgaagagcctgcattagtttaaagtagtggttctccacctggctgcatattagaatcatccggggagcttttaaaaaagatcaacgccagagccctgtgtcaaagcagtgaagtccgagtttctgggactgggtcctggtcactgacatttttttaaagctctctgtgtgattctaatatgcagctataatgaggaatcattggcttaaaacttagattatgtatgtaatattttgggactggcttttcagaggcttacaattcttacaaagtagaataaattctttttggaaggtattgaagctaaatggctaaaacatggattttatcttctatgcacttgtgtttctcagccttattgtgtaaaaatttagttttagcttgtgtttggctttgatttcttgggccttttaagatccacattgatttatgacactcatctaatgctaacatggcgattgtctgacgtttggaacaacacagaacaaggattgcttcaataacagttgatgatggttttccactataatggcttgatttaatatgaagaaatttatcagtttagtatggattgtgtttgtacatacactctattaaaagagtatggttaagttgcttgtatgctttaaattacatacttgtgattccagtaatgctgttagctggagaattgagttaatgcagcctttatgtaaatactggattaataatacgtaaagtatataattcagcatacagaaaaattcagctttactaatttgtactaattactatgactttcacatgtattgattcatgcagtgatttgggtttctagtaccatagggagaatttcgcattgtgttgaaaaaatgtttcccggaaattttaactagactttgtaggtaaactagtttttaatgttaggaaaagatcaagtgtttgcctgaaggaaccgagaattttccagaaatgagtagatattccagaaataccagtgatcgtgaaagcagtgcatgatcacagtgacagccaagtaacaaggtaaaagaagtgatcagcagctaaattgttggtggcccagaaagaatgcaagccatgggagttaagctgtacttctacagaggaaaatccttttgaactcagggtgtggatgctacagatagcaggcctcaatgggagtggggaagcaatattgattcctgatgatcctaggatcatttggagggagaacagagctactccgttgcttttctgcatgtatacaaccttctctagtctcttcctgtctgctttttacagattgctttagggtgtgttgtttgaagttgtcttcataaatacttcctgtggactcccttaatttttatgtccgtaacacgcttctatgtacttgacatacgcagttcagctctctccattttttccttgtatctgcaacagtttcacctgatgaactacgtctcaagtgtccctaaattgtgtacctggatatttcctttaaactgaaaattctgtctccagctgtagttctactcaataaattgaaggagcagatataccttgcttcttgagattattcttgaattattacattttcttaaacgttttcacattttaaatgtggtaggagcactgcatttaaaggaactttgacataaggttgtttaaaaaacttctataacttaaagcttactttataaagggattgacatttatccctctaatgttaggcattttggatgtattatttaatcatacccattttacagagaacactgagattcagagggggtgatcagtaattcgcctaagatcacacagattccaacgcggttccatggttttaaagtctgttcatttcatgctgcattctgctgctaattcaagttgtgaaaatactgtgttggattttcttaaagacacgtcttcattttcagagtttctatactgcaaattttagttgtttgactttctggttaaatttcttatttcttcagtagaggttccatatactattcattctttcatctgtttcttttttatttttgtctttctctttaatgaaacatcagcatttgttaccaaactaactggtaaatctagcaatggaaatatagactcttggccatctgtccaaaatataatttgttttggaactttctctacttcttttactctccaaattttttcttccatttcccttgccccaacagacaggatagttgattaattacccctaacttgccaaaccagaagtaataaggtttcagaggtagatgtttgttggaagtggggtggagtggtttccaaaggatagttattcctttatcctgtgataaaaatacggagattgttctctctgattctgaaaaccgtgtagtgagctgcagccgctgagtctgtgagcttctagctgtttgccagcactgtacaccttaaataatcaagagactgagttaactattgcagagcaggtaccggaccccagccaacaagctgatgggatgtgctgttctcacattttttggttttattttttagttgcaactgacagtgaagattctagaagcaccaaatatggctctggatttatgctgtgggatttaagatgctacagaacttgctctccttcctttctgtcctggagccactatggtattggttgtagagcccaagtcagtatagagtctctgacttctaccctgggaaaatttcatttccgaagctagtttgttttgaagttaatgtttatttccaacattgagatttaataattttgtgttacttttctttattaattagtttttatacagtaaattataaaagtaatgatgcacgtagtaaattttattttctttttttgagatggagtctcgctctgtctcccaggctggagtgcagtggcacgatcttggctcactacaacctccgcctcctgggttcaagtgattctcttgcctcagcctcccaacaagctgggattacaagcatgcaccaccgcgcctggctaatttgtgtgtgcgtgtgtgtgtgtgtgtgtgtgtgtgttttgagacggagtctcactctgtcgcccaggctggagtgcaatggcgcgatctcggcttactgcaagctccgcctcccaggttcacgccattctcctgcctcagcctcccgagtagctgggactacagacgcccggctaatttttttttttttttttgtatttctagtagagatggggtttcaccatgtaagccaggatggtcttgatctcctgacctcgtgatccacccgccttggcctcccaaagtgctgggattacaggcgtgagccaccgcgtccagcctagttttttatttttagtagagacggggtttcaccaggctggtctcgaactcctgacgtcaggtgatccacctgccttggtctcccaaagtgctgggattacaggcgtgagccactgtgcccagccatacaatttaaaatataggtgatacaaagataagtagtgagtctgtctcaattctcctaccatccatatccccattctctagaggtaaccattgttcagtttcttctccatctttctggaagctttttgtttaaaagtgagatatttgtatactatgctgaaatattgatttttcatgaataatagtatatacttgatgatcttgtcatatccatcaatgtatctgtctgtctctatctcctctttagctgctgcccagtattctgtcatatggattgttactttggctttggattgagtgcaagccaattgtaattttacattgcttgaaatgctgagctggaatttgggtgagaggtatggaatggcagtgaagatttgggagtcatctgtgtggaagtaaaactgagtgaacaagttcttgggggttgactgctctagggctcgtggtttggagtataactcatagagttagaagaatcaggataatgggctgcacagaagtttaaaagaggggggaggatcaataatgtaaaatgccaatatactctgaggactaagaacacatgtggctataacagagaaacaatttaaagcacttatcaaaatgaatattatgtttaatagtcaattcatgatgtgtctgaaaagctaggtctggcttcttttctgtggatactagtaattttatactatctctctgtaaatctatctcagaaccaacatatttagggtaaaaacaaagtagatttctttttcactctaattgtgttttgcagatttctgatgactggcttttaggtaaaatcatttggttttcctaagattatgtccttttcattcccgagcttgtgcatgactgtcaattaaatggaagcctttcatgaagtgacaaagtaagttttagatactttacatttactttaagttcttggtatgtgtcaaaccactgttattgtcttatatctttctactataggaaactgaattctttctagcctcaaggatttttgtccacgttggatgaatgtagtactgtcctcctctttcacatttcttctcccatcacctcctaactaaatttgttcattggctatttttggttgtccacatccattcacaataagaaacgattgcttcgttgtacataagccagttttttggtatctaagtgcgtgctatttcacttcagcttcttgtattctatttattactgggctgttgtacattgttttttctcccaatctttgtgatttcttttaatatactttctttcctttttgctttgtaatcattgttttgagtatttgaatcatttgcaggtaagaatgtggattgttctgtctctcatgtagtttaataatatccaaaatatactatgttcagtctgtatttcaggcttttaacacttaagttagagtattttggtatatttaaatctaggatagaagtacactgtattaccattcaactacatgcagattttaatgttttcttaaattaaaggatgatgatattcattcagttacagaggtctctctctctagtccttccatggtgtgcagattaccattatactactgctatttcatagattctaatttgtgtttttagaaaacatcatcaattcttggccttctttcttacccttggtatgtgatttcccctaaaggtatggaatgcggttgctctgtggcttgttaggcagcccccttctgatctggtaacctttgggcacagtgtggctattttctccttatttataaaaggaatgatagctgcttcacaaaccatttgtgtggattagtgaattgtaaagtgcagcataagtattttttatttctagaatgtctctgagatactcaaattacttttggcagttatgtacgtaagtttcaacaatttccaaatgtgcacattctcagtgctaaacacaggctctattacataaataatatggtgaaatgaacattcttttctaccatgtgtgtaaaattgttagtggtgctaacttttattcattgttcatttatgtattcatttctagctatgaggtcctgggcaagttagttagcctctctgaccctcagtttctttatctgtaaaatgtggttaatggtatatactttgtaaggttgttgtgaggattgaatagcatgatctatgtgaaatgtctaaaggttgttattttaattgccattgtcattattattattttttaaattttattattattatactttaagttttagggtacatgtgcacaacgtgcaggtttgttacaaatgtatacatgtgccatgttggtgtgctgcacccattaactcgtcatttagcattaggtattgctattcaccaaacacttgagttctctggcctcagggagctcaaatgagttattcacacactcatgcacatatcctctgcgtaacttggtaaccaacagacacacatagtaaaatatttggtcagcagttgttgaatgagtgagtacattaactgagaaatccagagactgtgtgaccacctagtaggagaaggaagttggggaaatcattacagaggaggtgaggcttgaatgatttgtcggtcttctccttgggtaactcatgttatctttgtaggcctgcttcctcatttataaaaaggagtagaggaatacaggtagggaaaattgaagaaattttaataaagtcacatatattactttaaaaaagtataactttcataaattatgtatattataacattatatatatttttatatatattttatatatatatatatataaattacttgcaagagggaaggagagagggtctcactatgttgcctaggctggtctcaaactcctggcctcaagcagtcctcctgccccaacctcccaaagcgctgcgattacaggcatgaaccactgcacccagcctaagaaatatattgaagagtcctttctgtctttttaaaaactgtccaggccgggtgcagtggcttatgcccgtaatcccagcacgttggaaggctgaggtgggtggctcacttgaggtcaggagtttgagaccagcctgactaacgtggtgaagccccgtctctactaaaaatacaaatattagctgggcatggtggtgcgtgcctgtaatcccagctacttgggaggctgaggcaggagaattgcttgaacccaggaggcggaggttgcagcgagccaagattgcaccactgtagtccagctggggcaacaagagcaaaactctgtctcaaaaaaaaaaaaaaaaaaaaaaaacagaaaacaaacaaaaaaactgtccagtgagctgtaatcactgcactccaacccaggcaacagagcaagacactgtcttaaaaaaattcttttaaaaatgtcattgctctcattgttcaactcccacttatgagtaagaacatgcagtgtttggttttctgttcctgtgttagtttgctgagaatgatggtttccagcttcatccatgagaacatataggcacagggaggggaacatcacacaccggggcctgttgggggttggggggcaaggggagggataacattaggagaaatacctaatgtagatgatgggttgatgggtgcagcaaaccaccatggcacatgtatacctatgtaacaaacctgtacgttctgcacatgtatcccagaacttaaagtataataaaaaaagttaaaaaaaaactgtcattgcctcttatgtacatagaaaatacagtattgagttacagattttcataatttgtttccaagtctgttctagattataattccgtagtgttgtgaaaaactcccaagattgttaaaagaaggaattttgtatcacacttcttatgtttgcatttagacaattgacagattaattaattgttcataatgtgaaatttcaagactgaaaaaaggaaaatcccagaatatatatttcagaaacacccatatataggatttatgaatattgtagtgttcctttatgtaacttcccaaaattttattacaacagcaatttctacatcttaacagtgagcaaaatgaggtggaaagattctgaagttgtagtctctgacactactgggcactgaatctaaataacctaaaaccacagaacagtatttcatcttctagttcttattacattgtcaggtgtaagaatgatcatgttgaaattgagtggttggtctgtttagatcacttctatggaaatactgcttagattggtttcagaaatccttggacagtattatttatattgcattatttaggttagaaatttttgctgacttccatctgagttattagttcaaaagcagaatcatcagcctttatatggaatctctgctggtgctcatcttaggcttagtatcttcttaactgggtttttgttagcagtatagtgtggcattaaatttgagactatctttttaataaattttttaaaaattttgtcagttgtagaataattagatacttgtaaaacaagcaagaagctgttttcactgaggactttctttaattacatttcatataaatttaagagaactgttactagaatattaaaatcacaggttaaagtgagaatgtatttcacataatcaacatacataacatttttaacagcatgctaaagatggaaaaaacctttaccaaccatacatattataggcaaagctttaaaaaaaacaaaacattttgctcttatggatgtgaaagtaatctgtgtaaatatgtatttaaatgaaaatatctattcattatcattgcagaaggagtgtgggtatctggagagggagcattctaaacttgctgctctactttttggattatctacattaatatttctcccattgctgagtatttctgttatactgctggatcatcatacttccataatctgtgacccacttgctctaatggtagagtgggctttaaactgccatctgattaaagttcaggtttcttagttagacttgcctgggtggcttcagaattaggcccacaaatatgaatatggacttgaagatcttactagaacaatattttccccgataaagacacatccataaacatggtcctaaaaagatatgtgtaagttggatttgaaaaatgcaatttaagagttactaggaaaaagggattttaaggaaacattttaagtaatttgtgtgatatcaccagttggtttttcttcagtttcttcatcttgtaaaagaaggatagtaatggctatattatctacctcatgagattctcatgcacataaaattacataattcttaagtcttaaactaccttacgtatattattatttcaattttattgaaataaaacactttttttttttgtgatggagtctcactctgtcacccaggctggagtgcaatggtgtgatctctgctcactgcaacctccgcctcctgggttcaagcaattctcctgcctcagcctcccgagtagctgggactacacatgtgcaccaccacgcccggcttagtcttgtatttttagtagagacagggttttgccatgttggccaggctgatctcaaactcctgagctcaggtgatctgcctgcctcggcctcccaaagtgctgggattacaggcatgagccactgtgcctggcccaaactaaaacacttctaatggacttgtactttggctgggcacggtggctcacacctgtaatccctgcactttgggaggccaaggtgggtggatcatttgaggccaggagttcaagaccagcccaggcaacatggtgaaacctcgtctctactaaaaatgtcataaaattagccggccatggtggcgtgtgcctgtaataccagctacttgggaggctgaggcgggagaatagtttgaacccgggaggcatagtttgcagtgagccgagatcatgccattgcactccagcctgggcgatagagcgagactaagaaaaaaaaaaacaaaacaagaacatgggctttgttgacttttctttgattttgtaagaatcatttacctttgtctttaaaagtgattttattttcttgtttgatttatagacattaatacttctcaactccttatagggctcagaacatgttaggtgaaaatattgcataaagagatttgagaatgaatggggcaatgataaatttacactgaagtcaaagtaaagaaagacttctgagtattttgttttccccagcttctttttaaattgcttaattttgttggagctttgatgtgtggaacttactacaagtgacaaatgtttgtggccaatcagatggcacatcctgttccatctgatattgaacatcctgtttagtcagtgaggtttagatcagtggttttcaaagtgtggatcttctgaccagtagcagcatctggaaactcattagaaatgcagattcttaggccctgctctggccctacagaattagaagccctggggttggagcacagctatttctgttgtaacaaaccctccaagggaattctgaggcacgctaaagattgagaaccactgtcttggaactctagatcaggggtcagtaaactatggtccatgggccaaatcatcctactgcctgtttttgtaaatagttatttggaacacagccaccgtcatttatttaagcatcatctatggttgcttttatgctatggggcagagttgattagttatgacagagaccaaatggtccatacagccttaaccatttctccagctttttacacaaaaagcttgccaatccctactcaagataaagcattcgtgctgttttctttcctttaattctgaactgtgaacagctaaaatcattaggtaaacgcttgtgtttgcctttacacctgaccctcctatttctacagatccattcttctctctcatatcaaattattaattcaatgagtagagacttgtaaatgaaaataacatactactctaccctttccttttctgttaggtagtggtggtagcctgtttaacaattccatgaccttttctcactgattgtgtgctggtgtgtccttggtttttctgtactctagtgtaatctaacttaatcatgtattgtaatcttcatttttcccaattcttactgcctttttacttcctcaagagaaaacccaccttgtgactgccaagtttagggattcatgtgagctgtttggaatgtttgtttgtttgtttgtttgacagagtcttgttctgtcgcccaggctggagtgcagtggcacaatctcagctcactgcaacctctgcctctcaggttcaagcaattctccctgcttcagcatcctgagtagctgggattacaggccaccacgcctggctaatttttctaatttttgtattttttagcagagacggggtttcaccatgttggccaggctgatcttgaactcctgacctcaggtgatctgcctccttcagcctcccaaagtgctgggactgtttagtgtgttctaagccaggggtccccaacccttgggccgctgaccagtaccggttcatgacctgttagaaaccaggccgcacaacaggaggtgagcagcaggccagccagcattactgcctgagctctgcctcctgtaagatcagtggcagcattagattctcatagaagcacaaaccctattgtgaactgcacatgcgcgggaactaggttgcatgttccttatgagaatctaatgcctgatgatctgagatggaacagtctcatcccgaaccccctacccccaccccggtccccatcgtccatggaaaaattgtcttccacaaaaccggtccctgatgccaaaaaggttaggtaccactgttctaagccattgaaatagtgccatcccttctggaaaattgttacccttgtcctggagtgctgtagtcactggtatttcaccaggatgttagggtatttcaccaggatgttagtgagcacatagatattgaatatttcgggcaatcttagaatgtttactgggagagttttaaaagttagccttcccacatccctccaagaatagctgtttctctttgtagctggaatgtcatgttgtactcttgattctcctttgtacctgttcttagccattaaggtgattggtggtcaacttcgtataaaatacaactcaattttaccattgttcttattgatgcacatgaatgtttctctttatgcatatcactgagggaagtatagtagcctttgaaagaaaggccttcttgtagtctcccctggctctggtagcaaggtcaggcaaaagtgttgtttttgcagttgtgactccatggttgtgtttttctttacataactgatgttttaagtcaggaaatatgactttgccaaatgatactgagctatattactggtgagtttgtttggttcctgatttatttcagtaaatctgggttgaatagtttagtagtagatgctggggaagatacaggaaatagtgagtttgagactagaaatgattgagttagacatttaatttaggctttcccaatcaacttacttcataccttttgccctgcttactcatcccagaggtgaggaacaatgagaagaggggtcaggcaaaggccatccctcagaatgtggttacttaggtctgtcgccaaaggcaacctatctactggaaaatttgagctttactgtcttctgcagtatagtgttggaaatgcagtattttaaaaactaaattgttatttatagcagtgaataaaatgtgaactctttaaaaaaagagcagtgttactgtcccagctagcacaatagccacccacatgaatcatctgaacaacctcctcatttctgttttatctacctgaaataggggtcagcggtaggtgatgatgaaagcttgggaaatcatgccatgcattaggcaggagaaatgctgtggtgactctttctgtgttgtcctgccctcatgtgcataggaggctggggcagccccaagagctagaggtaagctttaataatttccctgggttccttggcagctggctgtgcttaggagccgggtgctacttccagagtagcaactgctgtagaaaagttctgccaaatgtgtagattttgaaccattttaaaggctatagtgttcagactcaaattttttagtaggcagagagtattatttaagggtacttatgctgcagtattggataaggttcgttgtgaaatagatactacaacaaggcctccatgtgacataaacttattggaacttgtgtacttttaaaaccatatgtttaatacatattttgagcttcattaggtcaggattcttggctatcatagtcattgttgtatctctacaacctagagtagtgtctggtacatagtagatgttcagtatatagttgaatcagttcaaacaaggggaagaagtgactgaacacattagaaaaggtaaaatttatggcctataatgcacaaagtcagaagttcatattttcttttagtgctaatatcttgctgcttcaaaaccatttagttctcataatgttcttttgaaataggttagtagacatagaattgtatagtatatgccgaacatagtagtggaatcctgaataatacctggtttccctagttgagatctgtaagaccaatgctctaattagatgaagaaaagaagtttctaaggttgaaatggaatggagaattttatagtgagtggaattactaatgactggcttacttgatctatctaaaacgatttcattgcttgtaaaatggagacagtagactttaactgatagtattgtttgaagattaaataagatagtgagtatgaagtccttggagacttgcaggtgtgcagtgagcatgaattgttttcaacatcaacagtaatttttgagagcttcctaatcagtcacctagctagtcccacccagccttaggcaaagcgaaggggccataggccaaatcctgccgtctgctttatattgtagccactagccagatgtggctatttcaagttaattaaaattaaaatttaaaattcactgaacagacatttctccaaaaaagatttataaatgaccaataaatacacggaaaggtgctcaacatcaagtcattatggaagtgcaaatcaagaccaaatgaaataccacttcatgtgcactaggatggttagaatcaaaaagacaataacaagggttggcagggatgtggagaaattggatctctcgtacgttggtgggaatgtagaatgttgcagccaccttgaaaaacacactggcagttcctcaaaaagttaaatatagagtttccatacagcccaacaattccattcctaggtatgtgcccaagagaattaaaaatgtatatttacacagaaacttatacatgaacattcatagcagcatttcataatagccaaaaggtgaaaacaaccccagtgtccattaatggatgaatggataaacaaaatgtggtagttgcacacaatggaatatcattcaactataaaataaattaagataaagacgcatgtgtatgttcatcacagcactattcataatagcaaaggcatgtaattgacctagatgcctgtcaacagtggactggttaaagaaaatgtggtacatatatactgtgggatactatgcagccataaaaaagaataagattatatcctttgcagtaacatagatggagctggaggccattattctgagtgaagtaacacaggaagagaaaaccaaataccacatgttcttacttataagtaagagataaacattgagcccacacagacacaaagaagggaacagtagacactggggcctacttgagggtggagcattaggatcgaaaaattgtaggatactatgctgattacctgggtgacaaaattatctgtacaccaaacccctgtgatatgcaatttacccatgtaatatgtatcccctgaacctaaaataaaagttggaaagaggaaaaaaaaagatcactttgggaagaattgatagcttaaattattgtgtcatccaatgtatgaacaaggtatatctctattatttgggtattgtttaatttctctcagcagtgttttgtagttttaaaagtacaagtcttgtacatcttttgtcacattcttaaatatttcatatattatgctgtggtaaatctgtttttcatttgaatttctgattgattgttgttagtatatagaaatgtaattgattttttgtatgttactcttatgtcctgcaactttgctagattcacttattctagtagaatgatgtatattgcattggatagtctacatagatgatcatatcatctgtgtataaagacttcctttccccaaaaaaagaaataaagtacagatacatggtgcaacatgcattaacttcaaaaacattatgctgagtaaaagatgccaaacacaaaagaccacatattgtatgatttcatttttaagaaatggcctcagtaggtaaatctgttgatatagacactagattagtatttactagggactgggaggaggagagtgtgggcagtgactactaataggtatggggtttcattctgaggttatgaaaattttaatggaatttaggtagttcttagtgatcaaggcacaactttgtgaatatactaaaaaccaccagattgtatacttaaaaagggtgaattttatggtatgaattatatctcaataaatgttatttttaaaaattcagttccttagttactttagccacatttcagttgctcagtagctacatgtggctagtgactgcatggtagacagtgcagatttagaacgtttccatcatcacagaaagttctgttagacagcactgatctaagagtctcaatctgagaccaaaaaataaaggaagaaaaaccagtctaaaaaacacagggagtggagaacagattatgttctgaagaaatgttactttggggtaattttaccctttgttgccctttgactgttctactaggagtcctcaacatgattttcattttattctcaaaacaaatgcctgtggtaggtactgttatactcatgttttataattgaattatatgagttttaagatatttgtgtagtaagggtagagcaaaatttctaacctaggtacataatctctgttacattgtttacctctgtttatggtatttgattttcttaccaaccatccttcactcccactttgttgctagcccactagagctattttcagtaccctaaatgcacagttctttttgtgccatagcagatgctagccctccttcctccttctgccgtctcccaacactagtatgtgcatgtgcacacatttactggccccacttacctgaaagtgtggtgcacatctctcttcctttgtgaagctatctgataccacagttttaggggctactctctcacctggttaaggttacataatgtcgcaagatataagcaagaatgctgacaggattcttgttgtgacactatgacacattgagcccaattcatagctgctgtgttggtgactctaacagggaagtggtcttctagtccaggcccttggctcccatttatacattatctcctttccattcacagccttctttaatccccacccacactgctacagtacctgactgaactttgcctttctttgcctcttcatatgtttttctgcttaagctttttgaacctgatgagatactgccatgtttttatatttttctgctcataaaacccttaatggtaaaaagatacctgattgaattctgaagtgctttcatggctttgcctgattctgaggtcatattttctaactttatgctaacatcagtttactctctggttttatatggagcatgtactcctgtagcttctgaagaaaggtttaatgggaagcaaattttgagactacatgtagtaggctaaatcatggcccaccaaagatgtacacatcctaattactagaacctgtgagtatgttactttacatggtaaaaggatctttgcagatcttattaaatttaggattttgagatgggggattatcccagaatatttggatggacccagtttaatcacaagggtccttataagaggaaggcaggagggtcaaagtaagtaaaaggagacacgacaatggaatcaaccagagtttggagtgatgcactttgaagatggaggaagagggccacaaaccggggaatgcaggcagcttcaagaacatggaaaagcttctcccctgaagccaacatcttgatttgagatttctgacctctgatcagaactgtaagagaataaatttgtgttgtttaaagccactaagtttgtggtagtttattacaacagtagtaggaaattatgaatacaccatgtataaaaatgtcattatgccctttaacttgattgatagtttatgtagacctaatatatatgtacacatactagtctccatggctccatgctgcagtggacccaggacccaggcccaccatccatggactcaggttccaaacccaccccagcagacttggcctccagactcaccctggcggatccgggctccaggatcatccctggttgtctcagactccaggcctgcccctgcagacccagtcttcaggcctaccttcgtgatcccaggcaccaagcctgcgtccttgaatccaggtgccaggctcattctagcaccaggctagtcccttaagactcaggctcaaggcccagtgcagcaccagattgagctttatggacccaggattcacactggcccctgtgaatacaggctttaggcctgccctgcatgcccagctgacaggcttgacaggcttacctgagtggaccctggcactaggctgttccccatgcacaccaggattgagatccaccctagcaaactcaagccgtaggcctgtcctaatggacccaagtttcaggatagcccacctgaaaactccagcagcaagcccccctgccagacagccctccggaatttctggacaggctgactggtaaaaggcttttcctgccaaagccagtctgtgaagactgcaagtgcctacttcttcttctttttttttttttttctgagacagggtctcactctgttgcccaggctggagtatagtggagtgatcacagctcactgcagccttgacctctcaggctcaagcaataccactgcctcagccaatcctactgcctcagcctcctgagtagctgggaccacaggcaagtgccaacaggcctggctaatatttgtattttttgtagagacaaggtttcttcaagttgcccaagctggtcctcaagcaacccacccgccttggcctctgaagtgctgggattacaggcgtgaaccaccatgcccagccaagtgcctgctttgtaaaatgtgcagacactaatgcaaaactgcaaggatcaccgataatcagggaaacatgacatcaccagaggaacaaaatgaagcaccggtaaccagtcataaagaaatggacatctatgaattgactgataaagaattcaaggccaggtgcagtgtctcgcatctctaatcccaccactttgggaggccaaggtgggtggatcacttgaggtcaggagtttgagaccagcctggccaacatggtgaaacctcatctctactaaaaatacaaaaattagccaggtgtcatggcatgcgcctgtaatcccagctactcgggaggctgaggcaggagaattgcttgaacctgggaggcagaggtcacagtgagccgaggtcatgccactgcactccagcctggctgacagagcaagactccatctcaaaaaaaaaaaaaaaaaaaaaaaagatttcaaaataatcaaataatcatcttaaaagaagttcagtgagttaaaagagaatatagatggacaacaaaatcaggaaaataatacacaaacaatatgagaagttcaacaaggaaacctcaaaaaaaaaaaaaaaaagaaccaaacagaaattctagagctgaagaacacagtgtctgaactgaaaaattccacagaaagcttcaatagtagacttgaagtagaagaaaaaattagtgagctcaaagatggtcatttgaaactacccagttagaggaagaaaaagacaactaaatgaaaaagagtgaagacagcctatgggagttatgaggtaccatcaaacaaagcaataaatgcatatgagatttccagatgaagcagagaaagaaaaaggggaagacagcttaaagaaataatgacagaaaatgtcccaaatctggagacatgaatgaacatccagatccatgaagtccaaagaacctccaactagattaaagagatcttcactgagacactttataatcaaattctcaaaagtcaaagataatttcaaaagcatcaagagaaaagcaaaccatcacctacaaggaaacctctataagactatcagtggatttctcagcagaaactttccaggccaggagagaatgggatgatatattcaaagcgctgaaagaaaaaaaaaaaaaacaaaacaaaaaacctgccaaccatgtattatatacctggaaaggctgtttttcagaaatgaagtagagataaagacttccctgtgggagttcatgtcccactagacctactttacaagaaatgctaaagggagttcttcaagttgaaacaaaaggactctaacaacacgaaaacatatgaaagtgtaaaactcactataaaagtaagaatatagttaaattcaaaatactctaatgctgtaatgatggtgcataaatctctcttaattctattataaaagttaaagacaaatattaaaaatgactatagttgcaataatttgttgatatgcaatatatacaagctgtaaattgtgacatcaataatagtggggcagaggagaaaaagtgtcgtacttttatatgtggttgaagttatcaatgtaagatattttataattataagatggtttatgtacacctcatggcacaaagaaaaaatctgtagtagattcacaaaagataaaggaatcaaagcattctcttacagagaaatcatcaaatcagaaaggaagggacaagagaggaagagtggaacaaaggaactacaaaacagaaaacaaggtatcagtagtgagtttttacccatcaataattactttaaatggcttaaattcttcaatcagaagacacagaatgaatgactggataaaaagaaataagactcaaccatatgctacctacaagaaactcactttagttttaaggacacacataggctggaagtgaagtggaaaaagatattctgtgcaaatggtaaccaaaagaaatagaggtggctatatttatataaaacaagatagactattaagtcaaaaactgtcacaagagacaaaaaggataattttataatgataaggggtcaattcatccagacgatacaacaattataaaatatatatgcacccaacatcagaacatttacatatataaagcaaatattaatagaagtgaagagagaagtagatagcaatacaataatactagcagattttaataccccactttcaacaatgcacagaaaatcaataaggaaatagcagatttgtactacactgtaggccaaatggatctaagagtcatctgcagaatatcttatccaacagtagcagaatacgatgttcttttcaagtgtgcatggaccagtctctaggatagatgatatgttaggctacaaaacaagtcttaacaaatttaagaagattgaaatcataccaagtgtttttttctgaccacagtggtatgaaactagaaatcaaaagaaaacggaaaattcctaaatatgtggaaagtagacaacacactcctgaacaaccagtggatcaaagaagaaattgtaaggaaaataaaatcttgaggcaaatgaaaatggaaacacaacataccaaaacttatgggatgccatgaaagcagttcgaagagagaagcttataatgataaatagcaatacatgaagaaaaaagaaagatctcaaatagacaacctaactttacaccttgaggaactagaaaaagaacaaactaagctcgaggccaaaaaaggaaggaaataataaagatcaatgcagaaataaatgaaatagagactagaaaaacaatagaagttatcaacagaactgagttggttttttgaaaagtaaaatcaacaaatctttagctagactgagaaaaagagaagactcaaaattataaataaaagagacattgcaacttaaagagatacaaaggtttataagagactactataaacaattatataccaacaaatttgatagcctagaagaaattgacaaattactaaaaatacagcctatcaagactggatcatgaagaaatagaaaatctgaacagacctataatgagaaaggagattgacttagtaatcaaaaacctcccccaaaagaaactcccagaacctatggcatcagtggcaaattctgtcaaacctgtaaagaggaattaatgccagtccattttaaactcttccaaaaaattgaagagggaatacttccaaactcattttatgaagccagcattaccctgatgctaaagctagacaaggacagtacaagaaaagaaaattacagaaaatacaagaaaaaaattcctgatggatatagatgccaaagtcctcaacaaaatactagcaagccgaattcaactgcatattaaaatcatgcatgcttggtacaacagatatatctgaagagactcttttctctatggttggtttcttcttgatcatcactacctcttagtgtacaggaagctcaaaatattactgtgtgaccttaacaaaataaatttacttctctggtctttaggtttttttcaatgggaaaatgggaaggttggctccattagtttctaaagtccctttgagctctgaaatgagtaattttataatttctaagtgtttaattcatcaactacatgactttaccttttttcttcattacctgtcaaattcacttaaaaactattatcacacttcatttgctttttaataaatttctgacagcatgaatgggagaaaaaaagggactatacagcatgatcaaagaagatttatccctggaatgcaaggatggttcaacatatacaaattgataaatcacattaacagaataaagtacaaaaaccatatgatcatctcaatagatgcagaaaatatgtttgacaaaattcaaaatcttttcatgataaaactctcaagaaattaggtgtagaaagaacataccttaacacaataaaggctgtatatgacaggcccacagctaacatcaacactcaatactgaaaagctgaaagccttttttctaagattaggaagacaaggatatccactctcaccacttatagtcgggataatatgggaagtctgtcctagccagagtacacaagaaaaatgcatccaaatcagaaaggaagaaataaaattttcggtttgcagatgacttaaaattatatatcaaaaactcttaaaactccaccaaaaaaacctgttaaaactaataagcaaattcactaaagtggcagatacagagtcaacctacaaaaattaatagtgggggaggagggagtagggatggttaatggtcaccaaaatatagttagatagaatgaataaaatctagtgtttgatagcacaacagggtgattacagtcaacaataatttattgtacatttgaaaataactagaagagtataattggaatatttgtaacacacagaaatgataagtgcttgaggtaatggatatcccatttaccctgatgtgattattgtgcctctatcaaaatatctcacataccctataaatctctacacctacgtacccataaaaattaaaaattaaaaacaatagcatttgtatgcactagcaatgaactgagaaagaaatcaagaaagtctgatctacaatagaatcaaaaatatataattcatttctaagaggtttttttgttctctcttcttgtatatagcttcaagattttgtttcttatatgctatgtctaatgtcctccaagagaaagagagggaaatggaattataattaacattgtcttttccctatattatctgttttctcttattttcttttttcctgttttttagctttggtacttgtctgtctttcatgttagaggtgtttctcaagcatcttcagctgtttgttgctattaaggaaaagtttattggaaactgtgttcatgactgtggcttgttcagtgatggacctcatgtggtgtgattgagggaaacctggctatttatggggagcctatcagttcttttttcttaagccagtcagcttttctaaataggatttctaaattgaatcttttgtgggagggagtttgggagtaataagctcatgtctagggctggatccttaatcattggctgcaaagacttatttaacccttgttttcagtaaggcatcccatttttgttctcagttatggctggtgttcctgagttcaggggctctgattcaacctctccagagagtaacttaagccctctgctatgtggagaaaaggcagttgccagatgctctggttggagtgagagtatgtgaaaatcttacttctcttttttaaacaatttttcagcatccccccaccacttgctttaaaaaaaaggattattttcttcaaatgtgcccataagctgcaattcctgagcttttaccttctgttcttccagggcactcaggagtgaactggcttacttgcctcaatttagattcccccactgcaggtacttggcacaaagaagaaagatacaatcaagtcagttacctcttttccaaatgcttttcattttaaattttgtgggcctatctcctttgctgtcatcatctccccacgctcttcatcttgttggtttatatcttttctaattcttcagtcttttgatttgtagagggagttagataaatgcttgtatctgatcagttatgtttaaacaaaagcgcctccctcccttgacaccttctctttttcttggacttctgtttcttagactgtttccaccattagaataagagcttgtcaagggcaggaaccagggtatttaatagctccagcatttgtataatgcctggagtatagtaggattattaaataaatgaacatacctttattttcaattatagatttctctgacttgagaaataatttcaaataaaacagtgaagtctctcttacagataagttcggaagctctcctctttcctcgattcttgcttatttttatccacagtgcgtctcgtgaaggaaaagaatggatcattctttcttgatttcctcgttggtaaagtatttggctttaagagctattcaaatgaatgtgcaaagtaagagtaagttgggtgtatttctagcactaagttgttgaggttctagaaaggtagttttgtgccttctagataccatgtctgcctttcctaatgagcctggtatgtatactattctgcctagcataactaggagcaataggatagagaagtgggatataccatttcaaagattcactgatgctgcttagaaacaaaaatctaaatgaaaaccaatgtacataaattagataattcacatataccattagaaattccacttaaagtcagtactgctagaaaccttgtcattaccttgctttaaatgctaagcgctttctgattaattctttttcagtttatttacctgggaggtattcgatctaagcaccagcatccctgcccccacttttatctattaatatttacaggtttttccctctttgaagctccctattgaattctgaatgactttgaacttggaattgctctgggtctgcttttcacctcctttctctacctcccaccccaaccttcactaatttgcttttttttttttttttttttttaatatttgggtggtttcttcttgcattctcttttttctatatgctccatgacagcctggactacatttctgttactcactgctgcatccagtgcttagcacatgctgggccttaagtcactgtttattgaaaagaataaatggattactcgttgaaatttttttaattatgaataacaaaaattagtaatctaactatatattatcaatcttttgctgtcttatcttacaggttttctttctggttttcatactggatagtctctattgacctagcttcaagtttgctgatttttttctactgtcaacttaaacttgctgttgagtccttctagtgaattttttgtcaattatagtacttttcaactcctcagtttctattttttttaagaattctttttctttattgatgttctctatttggtaagtcattatcctcatactttaaaaaacttctttaagtatagtttcctttaattctttgaatatatttataatagctaatttaaagtctttactaagtctaacagctgagccccctcaggaagtttctattggctgctttttttcttctgtatgggccatcttttcctgtttctttgaatgtctcataatttttctgttgttgataactgaacattttagataatatattgtagcaactctggattctgatccactcaggtagtggttattgtttttacttttgtttttccattgcttaatgacttgcctggactaattctacagaggctgtctttgctgaaatgtgtggccactgaagtttgtgctaggattttttgttttgttttaaattcttgtttttatttttaagcctggcttcctagggttttccccttggtcatccaatggttggccacaagttttccttaaacactttgagccaataagccttccatcttttgctgaaggaatctctgtgtgggttggggcatacgttgaaagttcaggcagtttaaaagtctgccttggctttcactttctgcttgtgtagggcctcacagtcagccaggagcagtagataattgggaatctttctggtctctcttgaacatgcatacatgcacagagccctccaaatggatacaaccttccagaacccccaagtatgtcagagctttaagctttctatggctgtctcattccccacatctaccttttacatgttggctagtgtcttgcttacctcaaccagtattgcagacttaagcagctgtgattgtttctaatgattgctattgtttttgacagtgcccctggccatggggctttctcttggagctccatatcaagtcagcttccttcagtggaactgtccacaaagctacaaggccagcgaattgtggtagaagcggacccaaattaaaatgtcacagaccctgctggtcttacctaggatcattagtagctgaggtcctcactccgccattccagaagtcctgccccccacctctgccttaggttttcaatgtgtttttatagctgtttatagttttgtggcttttcatttagtataaatattttctcatgttcttgataactcattataactaatttctactggctctcatcatttgaatgtctcataattgatttggtaatttcccctgttgttggacttcagataatcactggtgtaatttgcctttcccaacaggctctaacctgaatgaggcctgggactgctttgtttactacttcatcctcagtgcctgacacagtaattcttgttaaataaaggtcaccccacaattttttaaatgttataaataacactttgaggtggatcgtactgccaaaactgtattcagatttcagattttttttaagaatggagtttcagaaatggaattgcttggtcaaaggatataggcatttctaaacctcttgacataggttgccagattgatttcttaaaaagtcctatcaaaatagaaccttttggccgggtatggtggctcacacctgtaatctcagcacttcgggaggctgaggcaggtggatcacttgagatcaagagttcgagaccatcctggccaacatggcaaaaccctgtctctactaaaaatacaaaaaatttagctgggtgtggtgacgcgtgcctgtagtcccagctatgcgggaggctgaggcaggagaaccacttgaaccccagaggcagaggttgcagagagccaagaccacgccactgcactccagcctaggtgacagccagactctgtctcgaaaagaaaaaaaagagaacctgttttttcagcagcatccttatctgttgcattgtatatttggcgacatcagatgtgctagttgctcaagttttattgaccttattggccaaaaaaaaaaaaaaaaaaattctcgttgaactattttgtgtctttttttgagacagggtctcagtctgtcacccaggctggagtgcagtggtgcaatcacagctcactgcagcctcaacctcctgggctcaaatgatcctcccatctcagcttctcaagtaactgggactacaggtatgtgccagcagacccagctaattttttgtttgtttgttttagagatggggtctcaccatgttgcccagcctggtcttgaactcctgggctcaagcagtcctcccaccttggcctcccaaagtgctgggattacaggcatgagccaccatgcccagctattttgtgtctcttcgataaccaatgaaagtattagttttcctcatactttttaaaaaaaattctttctataaattggccatttgtttttcccccattttgctcttagttgcctaatgtttttcttgctaatttatgtaaactttatatatcaaagatatttatctattattgtcttttatatatttttaaaatttttcattttgttcctgatgagtttggatgtgcagaaactaaaaatcatacagaagaagcctctttgttcgatatgattggatattacaactggtctgctaaagagggaggagtataaaaaaagtctacagatatctcttcaatattttaacttgaagacaaaatatacattaagtagctaatcctttgatattgtgtgacccttttctttgaataagtctaattgattcgaaacctgctctatatttcttttatatatctcatccaaaatgcatcatcaacgatgtccagttttgatttatttaaaatggggtaatgacttaatgagctgtaatctgagtgcaaaatccttttggatattttatagatccttgctccccccgcccccccacccagtcttttgcagttttgtcacccacatttaattcagtatctcctttatctggtctttgaagccagttcttctcttttgtagtcacattcaattgctgtaacatatatgtaacatataattaagaattataggccggatgcagtgcctaacacttgtaatcccagtactttgggaggccgaggtgggcagatcgcttgaggtcaggagttcgagaccagcttgaccaacatggcaaaattccatctctactaaaaattaaaaaaaaatagctgggtgtggtggcacgcacctgtaataccagctacttgggaggctgaggcatgagagtcacttgaacctgggaggcagaggttgcagtgagccaaggttgcatcactgcactccagcctgagtgacagactgagactgtctcaaaaaaaaaaaaaaagaaattatagtaacacctacacaaccaacataaagaggtacacatttaggaacaaatacaaatagctcttggtatgtagacaacttaatttgtggggttcatgggctcatatgtactacacagtaccctgtcagcattgagcagtcagcatgcagcaggcattcattaggtttctacagagggaatggagaatggatcagtctgtgaaatttgttaagtggggtcaattaagagtgcttctaccatggtcaaaatctaatcagtctttttctttgttgtgattgtttccatgcttagaaagtccttcccttcttgagagttatgtgaaaattcacctacatttttctgtctttcttttgattcatacatttaactctttagttcatctgaaatttattttgttttttagtaagaagtaaggatgtaagcatctaaatagattttccaccttcaaataatgtgctgttttttttttccccagcatagccagtgcattcttcaaaggcaaagatcaaaaatgtaatttctagttttcaacaattagaataggggttgaatgggtctgggtcttgggagtggaaggtcagtatggtccttggggttggggaagggcaggcagagcatagagtggaatttaaaacacacacacacatacacacacacacacacacacacgcatgcacattcacatgataaggagaaaaagataactgagaaattggataataacagagctagtaggaagaggatatagtacaatgaaccctctttagaatgcaggccctttccaaaatgaaaatttgaagggtacttgggctctatttgatgaattatagtgaggtaaagtagtttattaagcatttgaataaacctaaatagttaataagctattgtttattaataaaaggtatgccaacaaggaagtaattatgcaaagttctacagagctgtcaaacttgaaagcatgtttttccccaccgattttgccagtctctactgggaaattatttatgatcattccctcagtcttttgaataagtcaacttctctcagtgcaatcattgctttttcctgggccatagcattaggtcaattagtgaaatattaggcataatactctttaaggctatgaatggccttgaagtactgtatgaaaaatatgagattaatattaagaagctgctatgaagcaaatgttaccagtggaaaattttattatacagtggtgtttatgctggttttaagttttaaaacattttatctttaaatgaccactgtataaatgttactttcaaaatattgtttggtgttgataggttctatttactcttcccaacatttatttgtattatgagtcacttcatactgactcaccagcattgcattaaaataaccagtcaccatcaaaaagtggactaaggacatgaatagacaattctccaaagaagaaatacaaatggccagcaagcatatgaaaaaatgctcaacatcactaatgatcagggaaatgcaaatcaaaaccacaatgcaataccacctcactcctgcaagaatggccataaatcaaaaaataaaaaaaaaaagatgttggcatggatttggtgaaaagggaacactcttacactgttggtgggaatgtaaattagtacaaccactatggaaaacagtatggtgattccttaacatctaaatagattttccaccctcagataacgtgcctttttttttttttccaggatagcaactgcattcttcaaagggacagatgaaaaatgtcatttctagttctcaacaattggaatagaggttgaatgggtctgggtcttgggagaggaaggtcagaactaaaagtagatctaccgtttgatccagcagtcccactactaggtatctacccaaaggaaaagaagtcattatacgaaaaagatacttgcacacacgtttatagcagcacaatttgcaattgcaaaaatatggaactagcccaaatgcccatcaatcaatgagtggataaagaaaatgtggggtgtgtttgcgtatatatacacacacacatatatatacatacatatatacatatacatgtatatatacatatatatacacatacatgtatatatacatatatacacatacatatacatatatatgtatatatatacatatattcacatacatatacatatatacgtatatatatacatatattcacatacatatacatatatacacacacatatatacacatatatatacatacatatatatataatggaatactactcagccataaaaaggaatgaaataatggcatttgcagcaaccttgatggaattggagactgctattctaagtgaagtaactcaggaatggaaaaccaaacattgtatgttctcataagtgggagctaaggtatgagaatgcaaaggcataagaatgatatattggactttggggactcaagggaaagtgtgggagggggtgaggaataaaacacattgggtacagtgtacactgcttgggtgatgggtgcatcaaaatctcagaaataaaaaaaaaataaatgaatcaccaaccaccaaccaaccaatatgggagatttgtttcagctggagggccttagtttcttaaagtagttttcttctcttgctctggaaagtactaattccaaggcctcttttctcctcccagttgtaggatattggggattcttactagaaagcgtaggcagagcacatgcagccagtgtccccaagttttttagaccatctggagctacctgtggctgctatgtagcctaaaacttcagaaggccttatgatctattggcagatggctaaactgggatccttgtgtcagggttttcttttatgttatttttaaattccagaatagaagagaaaatgaaatggagaaagaagacattgaaggttgtggtgttttctgtgaagttcaagaagtattgacatttctcagaagagtatgactatagatgatattgttactgtttggggttttttgttggtcatggtggtagtgatggatttttttttttaagagtcacgtttcttcacctagaattagctgaggaaaagtggcatctgtattgatggttttaatagatatgattttattggtggtgccttcagagtagtggcttagagtaattagaaagacatcattgctttgtataggtcttaaaaagattgttaaacttttaattcaatgttggctgagcctgctgtgcctgatacattaaaagaaaaaagtcttatgatttactgaaaagagtaaaatggtcctgatttcagttactcccttctactcatgcacactgtgttgcttactgccctttttaaatccaaggtgattcttcaacctcatacattgttttaacatttcactctatgtctaggacatgtctagaatatttaagtgcctttttcttggaaataatagagatgtatcatacccagttttatttgcttaggtagcagataaagacttcagaaatactcaatatttgagtatttgggttggaatttgacactgtgtgtgtgtgtgtgtgtgtgtgtgtgtgtgtgtgtgtgtgtgtggactcaactagcctaaaagaaagataaatgcctcttagaagctagaggggaaaaacctatgaaaacttagtttgggatgtacctatgatgaagaatttgccctctgatttctcttccatgtggctgattttgaaggttgtatagtattttgtttttatgttttgatacagctgttaattcttgaccattttcctcagaaattggcatttccagattggcaaaatctagtatcattgtaggtagctctttacagataaatttgtacgggagagtatgcaatatattttgaaacttctgtttttgtgtgtacaaatctctaaatcagcccagatggtggccattatggattagtaatagcaagaaagaaagctgttaatatcacagcttctaacatatgtctcctgattgtgggtatatatgcctggtgtcaaagataacgctacagcatacctattacggcttttaaaaagttactaaggcatttctatctgtatcagccaactagaaggatggattagacaacatgatatatgtagtgcttttatctctggcaggtagctaagtctttgaaagaagatatatcttctcatctggccagaatgttttgattttaacttgaaatttcctaacaagagttcttatgtgtttattattgcatgttcttatgtgtttatttttaaaactatcctttagcatttaggcacattaatttatagcacctgtagagcaatcagttgcaatatctgcatatatgccttttattttctgtaattgagatctgtattatatttatataatcagtgtgtaagttactctaaaagttatctagtcaagcttgactttaaagatgtctttgtaacttgttctacattgttactgtttccttcagaaagttaagtttccaagcttctttaagttacattctagacgttccgaggggttccaaagtgttgaaaaggaaattgaagtaagctttggaatatgttaataagcttcaactggaaacatgtatggtagcagctgttttaaaggccgctgatagtgagatgttaattgagtactttttaaaatatattacccaaccttctctaagctctgaagcttcaattacatttatcctaggcactaagacttgaatccaaaggggttacttcactgctcttcttgaggttgggggtcctatgttattcactattgtaacagcaacagattataatgattggtaggcaaccaaatgcttgctgatttaattaaacttgcctagttatttttaccttattgtaaattttggtctatagagctgaagagatttctccccttttctttgaattaagaaaaagccacatatgtgtggtaaactccccttcaccataatgaaactactttttcttcattctttgtaaaatattaacccagtagagtaaaaactgaattcttccatgaatggtggtatttcttctatctggcaaattaaagcaatggagaccattagggtataaccctgaactttttgtgctccctccaccctggtccgttatttctttggtataaaatcagaagaatgaaatcttagtagagttctcgtaccactacacaagacaaggtaaccatgctcttgaaatagatttaattttagatgttgagtgttcctaatgggtggcaaattatttatgctaattgtgaggaataaattacttatagatttattaataatttacacatagtaacttaaggttcaaagtttgttaacacttattttatatatgacattcacatcaactgtatgaggtaactagatttttctttttccatctcataaatgaaaaaaacaggttttttgtgaaaatgcaacttgcccaaagttgtagaattagatttttataaacagatctgagttacttaatatgtgtagaaatctttacttgacaaattttcgacattgtaaggtttgtaattttatctcagaatcctagaattctagagctgagagaaacttaagttgatacaaatggaaaataggttctttattgagtgccaggttaatatcaattgtagctgttgagacttggagttgagacatttttattgacttatttccagtttattggcagagagtgccctaattgattaaccatgcctgaagtagacatggggcaacatatagatgacaaatatgtggcagtcagactcagtaacttgatatagcattttgaaagtacctaatatagctttttacagattctgtctaacgtgagtttctattaaatttggcaaattcctcagtaagttacaggattctgtatgtatcaagaattgaatttggcaatgtggaacagaaaacccaaataatagtggcttaagtaaatttggattcatttttctgtaatgaaatgagagaattaaacattccagggttgatagggtgcctccatgatgtcattagggccctaagcaccttctcaccttcttcccagccatccttgttgtgtgctcctagttataagatggctcctgaggctccagtcatcccatttgcgttccaggcaggctggaagacagggaggagcaaaatggtgcctgtcagctgagtaagacctcttaaaagagctttgctgtaaaccacatctattgaagtttgcttttatctcattggccaagctgtatcacatgactgtctcatctactgcaaagctaggaaatgtatttttacttaagcacattggaacccagcaacaatggccttctgacagcaaaaaaagaagcagatggatgattaataatctttgctacagtacacctctttagctatccagtccttactcagttatcttcccacacaaagaacatgcttaccccttccttaatgggaacacctccaaagtcttatctagttactatatccaacttttaagtctttgatttcttggtgatgtacagtcctctcaattaggtctaggtgtggcttcttgtggtctggtgtcccacaaactgccccctccttcattgttacatagatagaaaaagaataggataactttagtaaaagttcccacccaaccaaaaaggagagagtaggaaacgtagcatttaacagatcctattgggcaggaaaagcaaagactctctgtcctgccttcttggatggcccatttggcaggccctggctctgctctaggggaatttcctttgcctgggaaagaaatttgtaagggaagccccagcatccttgaagaactctgtgatcagtgagaaattaacagcgggaactgcggccactgattgggaagcctaaatacaatgagggtaattggatcccaggatggcaaggaccagtagcacttaattgccaaaggaagggcaggtatggttactgaaatggacagcagagtcaaagcaacaattagaatgaactgactagtacagggtgatttcttttgctccaagcaggcccctggctgttctctggagattctttattgtccattcttctccatggccctatctgaaatgctctttggggagcacatttttcttggggactacacagctttcatagctaacatattactgttgagggtttggagccatgaattattttagagatttaatagctattggctgctgcagggcagttttggggtttccatgacaatatcgtttcgtcaaaaaatgtcgatatttttcttcttgtttttagtaagctccacgggggagaagccacatctagacatagtttcttagcctgaaaattcttctacttactggcctctgtgctctgcccttttctttcagcttttgagttaatagccagctgcctcgaggtaggcaacacccttaatctgatttttgctggctagttttctttcctgtcctgaagggaactcttaaaacagcttggggttgtggtttcatctcctgctaagacagccacttctctgagttactgcttataatcacctcagtttgagagtacaggagctgttgatgtttatagtcctccaaagcttcaaattatgtgactttcagtcgatttaaattgaaggctgcaggcacagaatggctggctcaagttctatttggtctctcctaggactgggctcaaaagctgcaagaggaaaccatcatacatccatatcccgaaaatgtcctacatttccataaactgtagcctcatttggcatatggtattaccaaatgttttgccactacctaacaagagtaaccagctttaagagtcactgtgaattggttagagactgatgggattagttaagactaattttccttaaagtcttttcttttccttgatataggtatattccaagtgttgatgggcagcttggggtttatttactttttagacttataaattgggagaaattaggactaagggaaatgattttttctaaggacatgaacatttataaaagacaaggaaaaagtatgacggaagaaatatgtggatgtaattgccaagaaaggagttcatcagtgatgggtaaatggtcaagaaaaaatggacagtgtgatctctgtgtgatcctgttaatatatattgtgccagccattttcctatttcagccaccaagtgatgcagtttacccagggtctgggttccagtcctcattgagaggaaccatggttaagaagaaagtgaacttacaaccaggagtttatatgttctcccacatttacccttcggatggtatctaatcattttctcctctaaatgaaatgtattacattctcttgtggctgatttctctagtacttatcttatatattcttaaacttacctttatgtaaatgtgctcaatcaattttagtaagacttaaacttcctgagctctaccttttaacagcatcctagactgagagttagtctcaaaagtcaagttctacaaaagaatcctttatgctgtttaacttaatatgttgtagtgttgtgacttctctacctttcagtgtttcttgattaggattcttcaaggtatttcttttgtttttaatcttaaaaaaattaacatgtcaaataagagaataaatagtacctggcctttattagaatcttattttccataatgttttaaatattttcatatcctatgagatatgaagggaagagttatcaaacaataaacttttgaacaccaactatcagccttttactacaccatgaggcttaataatagtaaatagtagttggtttttattgagtgcttattaaataccaggcacagtggtaaacattttatcttatatatattcattttatcctgacaacaatcccaagagataggtggtgttatcttcgctttatggatatatgtaaaccaaggctcagagagttgtaagccacttgcccagggttaccaggctattgagtggtaaagctaggagtctaaggaagttcaactccaaagtccgaactgtgtagctaccttgctataattgtagatggtccctgccatttgggaacttggtttaacagaggaagtaaacacggaaataataaattgaatgatttccctttcttagtttggccatagttgttatgatcatttcataataatcatttctataaatgtaagttggcacatatgaagcacctttggtatgatgtcagaatatcatttttgaagtagtgaactaaaatggcatatcaagtgacccaaaatgtcatgaagctttttggaaacattcactctacgaaatttattgaacaattattatggtccagggtcttctgggcccagagggtacagttgtgaataatatagaagctgtcctttctgtcatggaacttgcaagttagagagggagagacaggttaaataattctacaaacaattgtttaaaattcaatggtggtgagtgctgtgaaggaagccatggaagtgctgcaacagtataaaaagggaactgaacctacttcaagagtaagaatcaagggagtgattcaccttgagtagagctgtctttcaaactccataacatactttaatattttatcagtgagtcttgtaattcttgatcgttattctttctactagtatactgcagtcttgtgctttgtgagcaccaaggggaagagagcttaacttggtctgaggggaaatgaaaacaattcttagatacttaagctaaatcttgaagggacagtagagaggaattagaccaggggaagtatattctaggcagaggaaacagtttgtacaaagtttacacaaaggcattgggggcagatgagaacataatcctttaaagataattatggttagtatagctggatgcggtgtgtgtctagatggtattgagagatgaggctggaaagatagatagaaaatgtgaaatatttatgtaaccaaatctggtttctgtagagttggtctattaacttttccccatatttcagaggatctaagagatatgagattttcttttctcccccatattttaattgttagcattgttaaataaagtgtaaggattggcctaaatagatgtatagtgagatatcttatagttttaaaatgtatgtaatgcagtaattttaagggttgcagtcagatacccaaagcaaggcaattaattagtgaaatacatttggatctcctggctagactgaggcttgagtgttgtagaaatacatattactgcatgtgtataagattgggtctgcctgaagagaaggtttaagtgtggtgttccaggtatattccaatggtgaggcagaatattttgttaatgatcaaaggagaaataagagatcaagtgggaggaaattattaacagtgaaagcaacatgggcagtttgatgtagagcactgagaactatgtaggagacacatggcttgcatctgagctggcctctaccactgaccataggcaagtctctgggtattttggaatctgaatccaaacttcctattgaagtataacatggcatacagaagagtatataaattataagtatgtagcttgatgagcttttacaaactgaacacattcctgtaacagcacccaagtcaagaaactagaatgttaccagaagccctctttgtgctacctgtacttccatttgtttaatctttaaaataggggtaataatgtcttcttcacttttagaagtgctgagaaaatgacaacttgagaagtgccttgatctctctcagtgttgttatacaagtgaaatgagatgctaggaagtaggaccagcttccaaaattgtagaagtacatagagcttacttatagtattattagtaaacctattaaattggggatgcataaggagataactctgaaaaccacaaagcaaaggacaaaacagttgtctaaaatgaatcataaggatgcatgggcatagtatatgtgatgtcttttgttcttataaggtgtcattcttgggattcaggagagcaacttgtgtatttttacctgttcaaaaaatgtgaaactattctcattatttgaggatgctggagaaatggtagcttcctgaaataaaagtaagttctgttttaaaaatagccataagtcttgaattcaccaaatatttctgtttgggtttcaggaggtctgatgctgagtctctttttgttaatctgaatgcttacgaatacttttagaatgggaagtcctccttcatgttcttaatgccattagctaaattgatttttttcaaagtaacaaagtcatcataaatgaaattacatacattagtccccacttatccaaggttttgctttccatggtttgttacgtgtggtcaacagtagttcataaatattacagtagttcaaaaataaagtattttgagaggggggagccacatttttgtaacttattatagtatattgttgtaattattctattttattattagttgttagtctcttactgcacctaatttataaaataaactttgtcataggtatgtatgtatgtatcagaaaaatcatagtatatatgggatttggtgctatccacagtttcaggcatccactgggggtcttggcatgtatcccacgtggataagggtaggggactgctgtactcttgtagtactttttgaaaaagtttcaattttgtttagtgtaataacagattgatgcataccatttcttacacgacactagctgtagtcaccacaataatctgcatttttctatcaggcctatttgctttccaattctccatcatctccctgtacaggtatcttattagatccccttaagatctattctgtcctttacctgtatacagtgaactaagacttttaatttctataaggtaagatcattttattagcatatttttgtctttgatatataaaattatctctgctgagctcaaaagtttagtaaattttttgattgataatttaagaaagtctttaacataggcagtacagttataagggatagacaaatagagcagctttatttataataaacatttggctcttttgcaggatttccagattttaagatacactgaacccagtttatagccttttatccctcacgcccccgacctttccctcccaccagtccccaaagtccattgtatcattcttagaaacattctaagaacttcatgttacagttctgaaaactgttacatttacacttgttgtatttctgaagactttgttacatgtgagttacaggtgaatgaatttgagggaaaaactgacaaaactcagcttgaaaaggaacccacagtgatttctctacaagggtattttttgaatttgtgaataatttattggcagcttgctttgcaaaaaatacacaaaaacctatggaaataaaattttaaaaaaaaagtcaggaaagactgcaaaaaccatgaccttgcacaaaggccattgcaaccgtatacaaaaaaaagaacacttctgttgaggacatctgcccagccttggactggcatcacccttattattgatccttgaagccaaggacaatgacctaaaaacaattatgtaatcttcctcattttatctttgaaaacctttgtcttcctttacttccctaaatacacacatagtttactgtggcacacatattttcattgcaatgccctattcccaaataaataccattttctgtttttttttttttaagaatattttgtgctattatgtgattgatgttggttagtgctattagtgaagaagttggtgctttaaaattgaagcaccagagtctacttatttcgcttaaaacacgtgctaatttttaaaacatatcttcacacctcatgaaaataagaggcattgtgtttaaaatgtatttttttttgtttctttcccattaaaaatttaattgtggtaaaattatataacataaaatttgccattttcaccatttataggtgtacaatttagcggcattcattgcatttacaatgttgtgtagccatcaccactatgtctatacctttgtgctatattaccctacgtagatattatgggaagaaggaaaaattcttcccataatatctacaatggtatagaattgttaaatgatttcttaagatagttttattattttagatctggattaagaaaatcctttggtaaatgttatagttggatctgattggccagaattcaaaccagcaagtaccttattcaatagctgcttttgtaggcacaggtattccagtaccacagggtaatgagtatttcaaacaaaagagggttagagatatgtctaatgtttattgccataccctcaccctctgggctttgatctttctggtggtcttaagttactactatagatttcttccttgctcataatatctatttggcaatgggactgaaatctggtaacttctattgggaacaaaccattcctctccactgtggaaatggctgttgtctcataagtattctccctcctgctcccgactgttaatactaaatctttgggtaaataaagttactcatctgtacaaagagattggagaccagtctaattcccctatttgaaggaagccccagagagttggaactaatagttaagtgatgcatttagaattagaacacacctgttccaatctccaatcagggaagttgattgtcttgtggtggttgaagaaacagagagggacggggtcagcagaaaaacctatgaataaacctccagtgccttatggtttttcctgaagtcagaatttagagcttgacaaaatgaaagtatttatctagttctaacccactctattaaaaatgaggaaactggcgcagagtgactgtaacttaaaaatatataaccagttagttgcaaagctagaactggacacccgtatgtcttgacttttgccctagtgccaaatatatgagagtgtgactctggccctgcctctaatagtttatttgcctacaagatatttagtggaattgtcagtgccacattactgtagaattatttcaaaagaaatatttttgatattctggttttgtatccccttctaaccaattaggaacaagatatttttagtgccagttaatagtgcagtctttcagcagaaaggaatctaaatcaatatgcagtgttaaattcactttaataaatgtgaaaattgtttttaaagtaaccattgattataaagagagatgctttctatacattttggtgggtacatatacagtatttttctcatataagtgaatacttactatatactattttttaaaagcctaaagtcctacagaacataaacatataaggcaactgaaatctgtacaccttctcaatatataaaataagtgaatatttgcttctaatgaaagagataaagattagataacttcaacaggggaccttggcatatgtctgataatagatatgagacagggatagcatattgattaaaaaagtcatggactttggatctggaatttttaggacccggattctcactgaaccagttacttgatctggggctatagccaagttatttaacttctctgaaactcgatttccttatctgtaaaatggggataaatatgctaccttagagagttatgagaattaagtgagttaataccagtacctcttagaaaaatgactggcatatagtaagtactcaatagctgtaataataataataatataccaatacatactaatactaataaagtatctgttactaataattttatcattgctactgttgctcttgttggaagattatggtaaaggtgacatgtgaacagataatccttttatgcttctatggtaagtataggactttttacctgtggatgcttttgactacttggatttaaatacaaatattttaatcataattaaacaactattaatgaaattttttgttaagaaaatatttcccagtccagatggttccactaagccagctccttgatcagttttctgtaccatgcagttaaactattttttccattttcatgtttatgttcctgaaagtatattcattgggattacttttttctgtttaaatactaaaaccaggctttttaaagtatcaaattgtattaatcatggtttccactattttaagtcttcttttgtactggtattgaagtacattttttttttcttcatcattatacactaatgtactaaccaatatagcttttttaaagaagcattgttacacctccctgattatgcttcatttaaaatgcagtcccctacagtcctctccaccaatccccacccccaacctttatattgttcttaacatcactttcttcaataactctggagtgagggagcataaacagtaggttatgggtgaaagtgaaatggccccatagtgctgtttctgatgactagaagagtagcatggctgagtcttgcagtacaccaagatgttctgcatgagaggataaaggtgggaaaaggaagaaagctaaaatgatttcgcaaatgctctacagcatctgagttatgaagagaggcatttcaacaggaaaaggaggccacaatgtttagttaagtggtaaagaagactcactgaaacttaaggaaaaaccaaagagtatttccatggttattttcaaatatttgttctctcatcagttctactctgggcaaatatataatgcagaatttcactttttaaagatcacattattgaaactattctgctaagcaatgacttcttgatttacggtaggactcaccaagattttaaataaagcaataaaaacagatttgctctaatggctttagtgttatacactgtggttgatagtgtaatgttttattaagattgataaacattaagcattgtgtatttgaatcaaccactaatccaaaccagtaagcatctgttaccattcgtgattgtctgttatgtgaaaagcaacattattgcagagctaagagtatcttgagcagtaattgaaatagtagcctttgctaactggactgatcactacaactgtctttattttctgatgattataatgcattttatctactagagttgaggttttagctgagtgatcactttcaaaaagaatgattagtcttgatcaatagtgtattacctatagatgagacttttagcataatgcaatttccttagctggtgttgagatccatttcatctgttcaggaaatgaaagcaggagatatatagtactttggattgtttgtattgcagattagctaaatatttgtgggaaatcagaggtctaaaacatgcttaaaattctagtctgatatctggataaagaaaatgcagtacatatacaccatagaatactatgcagccataaaaaggaacaagatcatgtcatttgcagggtcatgggtggaagccattatcctcagcaaactaatacacgaacagaagaccaaacactgcatgttcttacatataagtgggagctaaacaatgagaacatatgcacatggaggggaacaacacacactcgggcctgtagcaggggagggagagcattaggaaaagtagctaatgcatgctggacttaatacctaggtgatgggttgataggtgcaacaaaccaccatggcacacgtttacctatgtagctaacctgcacgtcctacacatgtaccccagaacttaaaatttttaaaaaaaaatctagtctgttatatggtagtaacagactattagattggtgcaaaagcaattgtggtttttgccattaaaagtaatagcaaaaactggctgggcatggtggctcacgcctgtaatcccagcaattttggaggccaaggtgggcagattgtctgagctcaggagttcgaaaccagcctgggcaacatgctgaaaccccgtctctactaaaatacaaaaaattagctgggcgtggtggtgtgcgcctatagacccagccactcaggaggctgaggcaggaagaattgcttgaacccaggaggcggaggttgcagtgagccgagatcgtgccactgcactccagccttggcaacagagcgagactctgtctccaaaaaaaaaaaaaaaaaaaaaggaacaacaaaaactgcaattacttttgcactaacctaatacaatctcattaagcacagtaactctgcattgtgtattgtagaagcaccagaattttcttacaaatgaaatgataatggctttttgatgtgttccctagaaagaattgtggtccatcatcttttcagtagatatactttttgttatttagtgctttaggtgttatttgctaatattacagccaaaataaaataggaatgtgcagtggaactcatttcttctctgttatagctggctctttgaaagttgtttgaggaaactctaattacctacagccctgcaatgaattgcacaacagatgtactgttttaaagtcttgattcttgcatgcatttttcaccttttacttcagttttagtctttgatttggaacacttaatgttaagcagtataaatgtgtctttctaggtgacataattggattctctctctctctctcttttttttttttttttttttttttgtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgaaattttgcattttaggtaatattcaaatgacatcatttcagtccttttgtttgttattacttctgacaaaagcacttttctgtaagcttttcatttattttactcttcagctatgaagtatttgattatatgaggacacaggaagaaataaggagtagcccatggccccagctaatgtgttagacatcttatacaggattagtgctagattagttccatgaggtgatttgaactgtcaaggtcatcaaaaacaaggtaagtctgagaaactgtcacagccaagaggagctgaaggagaatgatgactaaatgtaatctggtatgctggatgggatcctggagcagaaaaagggcatttaggtaaaaactaaggaaatccaaataaagaatggacttgagttaatgctgatgtatcaatattggtccattaattattacaagtgtaccattctaatggaagatgttagtaataggggaactggattcagggtatatggaagtctctgtactatctttgtaatttttttgataatccaaaactattctgaaaaataaagtttattcttttaaaagaacagcatcataagaggtgatctttctgtttagatgacctcttggtagtaaggtataagataactgtttaataaaagcacaaggagcataggtaggggtatgccatgagatctagaatgtgataatcctggtagtgcagtatcaattcttggacaagggcaattctaagtcaaatagacatgctgaattcacttgaagcagaattgaagaggtaggaaacatagtcatttagcataacctgaaacctttactccaaatgcattatgtaattgagattaaaacttgttgggaacatctaagtgaggggtggacaaccttgtttctgtaaagtgccagacggtaaatattttaatctttgcaggccataccgtttttgtcacaaccactcaactctgctgtagcaaaaaagcagtcatacacaacgcgtaagcgaatgatgagtgtggctctactccaataaaactgtatttacagaaacaggtggcagtctggatttgtcctgtggtctgtagtttgctgacccctgatctaagtgatcatactgcccagctccattaggtgtactataatatctatttcaaaaaggaatgcaatctgagcaagatagaataatattgccttccctctgttttcaaggagagtagaaatggcagcaatggagggacagaagtacatggtttacttgtacatatggtcattgtgcctctggaaaccccaaggtctatgtatctgaactcagagcaatttattaaccacactctttttagatttagtctgattatggtctttttgtttatttgtttattcttaactgattttactatgacacagtatacaaaatcctttagggaaaccgtataccacttctctttgcaatgaaatttctaatcagggcttaaagtagtattttcccaagtgcatgacaggtattgtggtaggctgtgtttttaggtggtaccccaataagtcattaaataaacagtaataaacagaattatatacagtcttctttcagtctttcttattaatacatttgagaaaatttagttttaatgtagcataaacaaccaacatagactctgtttttggtttttgtttaagtgagaatagccctcaagttcacagcatttggaaaggaacaatactttcctggacttttgtagtgctattgttttagtttgttctatttctttttaaggttaccttctgtttatggcaagtgatactgtttcctgttaatgaaagtggtataataaaaaaaaattacctaagtaaagagagtcaacttaaaggagatttcctgaagaaagagattcagattatgagaagaaattggtatgagagagattctccattgctggcttgaagatggaaagggttgtggcacaaactgagtggcccctggctgatagccaacaaggaaatggaccttcagtcctacagctgccaacaacttgaatgaggttggaagtggattcttccctacaacctgtagataagagcccagcccaagtaacttcttgatttcagcattgtgagaccctacgcaaacaacctagctgagacacctggactcctgacctacagaaactgttagataataaatgtgtgttttaagccggtaaatttgtagtgatttgttgtgcaacagtaaaaaactaatacagcctataggctttgttcttactgctcttcaaacagagaccatgccctcctccaccaccaccaccagttcccctaacactgtgtctcagttcttttagtggttacccttaaaatagcaacatgtattatatacttaccaagtataatattagtcagtctcattagccttatctcagccaatgcaaggatcttaggacattttaactttattccttcctgatttacatgttaatgtctatcatatattttaattctttctgtacttgaaaactcagcaagacattattattacttacatagtcagtttacttaggttcattcacatatttatgttttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggtacatcatcattctgttgtcttctgatttctattgtccactgtcaaactgtcacttctttggagatactctgtccttttattacctctggttattttcaggtttttgctttgtctttatttttctgtagtgtgtctaggtataaatttcttttgtttatcctgccatgattcagtggaatcttgaatttgtagatagacacatctgatgaaaattctataaaaagatcctatgaaaaattctcagccatttcctcatagattttctctaactcattctctctttcctctcctgctgggaccccagttgacatacattaaatcttctcattattttatctaagtttcttaccctaattctgtgtttttcacctttttgtttttctccatggtgtattctggatcatttattttgacctatatttctcttcattaattttattcagctttcagttcctctgaaacccatccattgagttttaaattttggcttttttttttttttttttttttttgagacagagtcttacttcatcacccaggctggaatgcagtggcgtgatctcggctcactgcaacctctgcctcccgggttcaagcaattcctgtacctcagcctcctgagtaactgggagtacaggcgcgcgccactgcacccagctaatttttatattttcagtagaggcatggattcaccatgttggccaggctggtctcgaactcctgacttcaagttatcaacctaccttggcctcccagatcgctgggattgcaggcgtgagtcactgctcccagcctgtattttttgtttgtttcaatacctcatgtattttgtcttttatttttgctaattctaagatacggtatcttttcttgagagcatctgcctaccaggtttaggggataggacagctcatggccaggactgctttaatccaactttaagatttaaaattccatggaccaccagataaaagagagccaggctccaagtccatgcgaggccaggtttgttttgggttcacctccaccctaggcgtagcctttcagaacaaaacagaataaggtggaggttggtttatcaaatggactgtaggtattcactcactcattcattcctatgaggccctatgagtcctatggggcagttgcttcccaggggtggagaattaccctccaggcaaaagtagttttatgtgattgaactcactactgtgagttccctttttctcctagatcatcaactggcaaaatttaagtaccttataagatatttgatactttcaaaaaatgatggagaggggaaggttttattttgtttttcagtaggaaggctagtgtaggttatctatttcatgatcattggaagcagaactttctctggcttcttccttgtttctttgttttggtagtgaaagggtacccttttggtatggcagacatgatactttttaggggagaagtaatgaagaagtacttgtacaatagcagatgagccccagaagaagtctcctgttgttcgtatgcgccagacacaaccctttatgccttgttatttcctgtactgctgagaaccctctaaagtagctattatctccatttcacagtataaataaagtagccccagagagattgaataactggcctctcattatagttagtaatgagtaatgggcacatccaggatgcagccccaggtcttttgagctatcaagcccttgctctgtttatgttgtggtggctttgattcaaagaggaaaaagttaaagtctatcaggggctaaagtgcattctctcaaggggactttcccataattatggggtgtttgcagctggagtgtctgtacgtccaggttgcctgggcttgccaaaaggaagttgtaagttcattgtaaaatattaatgtgcagggattcttggttaatagaataaattattttttctttaaaaagttcaatggtctctcagtggagctgcctaaaaaaattcatgttaaaacatcttgttcttttacatgatctcaagccatctgtttgcatctatgatagatattcttcatgcttcattccctatttcttccctactggttgatataaagtaaaggattccattaaaggacagggcatagtaattgcatatgtcttgatttttaatgaattgataaacagtcattggccaaaatgtttctaattttatgatctcatcctgtgtctatttactggtttaaatttgtgctcaaaattgtcagtcttcagtccagcattaattaggaaccatgaagttttctttgtcatctgagtcttaattgagtttatatacctctaacttcacaaaaaggtgatcatgtggataatataagtagtttatttccatttaatgatattttctggtggtaagctattatagtgattgagtgtcatatttcatcttgccagatcatacaaactgaaatttttaagcaaactattaaaacatccaaaccaacaaaaagcttgaatgaattctgagctaatcattgtcacagctgattttgtaaacctttaggttgaaaagctttctgaattttaggagctatgtttggttcagttctctgctattacaaaatactattttgtaaaatgcctcaagtttataaggcctattttaaatcattaaagtatttaagaacagatgttattacatggtaaaagttaaaaagtctgctttctgagtcttagttatggtatcactggaaggattttgaattagcaatcaatgtctctagtaaaacaattatttttgaagatgtgtttaaaaaatagttaacatgttatatgattttacagcttttgtttacctttcagtaattggcattgacaaattaacatttttatttgtattagataagtgaaaatctcccccaaggtatcagagagctatagcttcaaattaacttaaatgtaactatgctaatgtaagtgtctggaagatggcacccatgtttgtgcatcctaaaatggatttatctatttgtccatccagtagcatttactgggtcttcattagcacagtgtcaggcacagttctatatgttagagactcaggatggataagagaaaattcctgccttcagagaactagtttagtcaactggtaggtcctttattaagagctgaccttcagttatgcataaccgtgtttgtgtagaatactgtaacccctaactttcctatttgtgtaatatggaaggccaagtgatgaaattgttattaaaaacaccaattcccaaacagtgtgccatgattttaatatgctaaatagactgtggcaatgttagatttcctttttgactcaggaagactgtgagggtgagtgagtgagtgagtgaggatgtatatgtgtgtgcatgaggagacaacagagcagaacccctagtctagtatgctttggttagttggtattcatcaaaccccaaaagattgagaaacatcgttgtttgagaccctaaaattctaaggtagagtgaggaatcatggaagactacattatggacctgatgagtttaatgcctgccatttttaactgagtatgttgatcataaaagaactgtagcttgtactctcattttaaatagactggactccttctgtaatagggattgtcaacaacaacaataaaaagaatggactcctaatgctagccagaataaaataggttgaaaatgcacagatttccatttccagaacaaaaaggcgtagacttacttttcactgccccttccttcctctataaatataactaaatgtcctggaaattattcaactgacagcaataaagggattctgaaagttgggaagaaagcagagtagcttggaacctcaggactagaagtttgaggacaatgagtataagttcactgggttttcttttaatctcccattttctcctagactgggtgctggagagacctacaacccagaatcaccagtgggcaaagaaagcagaacaaaaagcctgctttctctggctagaagaccaggaaagggaaagcccaacaaagacctaagtgggagtgctcatccccactgtttcacagtgggtcccggtgggcactctgatctgtccccattatggccccagttgctgcgggagcagcaaagcccctggccctcccacccactgctctacaactggggccatgacgggtggtttgttctgccaactacggtgaagaccagaccatttcagcccctgtggtctgctctgtagacagcagcagcaacagcaaagcccaggctatactgcctctgctcccaactggccccagcaggtggtctcttctgtagggagcagtaagcagctgcagccgcagcgaagccatgtgtcttcctgccctccacctcatggcttaaggagacccaggccccagtaggtgaccccctccccctcaaggtttcccagcaatagcaagtggccctgggaagtaccttttatccctgcagatggcatcagcagggattgagtgggagtcccaacatcaccagaagaatgaagcacaccaaaatagcattgtgagggctcagaaaactaaactgtcattggaactgaagcccacaaaagtagtctagaacctacacactaaacctaagcagggtgaccaccctgctaaaatagaagatcctgtcatcaagtcttctaacaataagcaaaacatccagggtacaattgaaaaccacttgtcatagcaagcaccacaaaatatctaggatacaatatgaatgaaaaaagacatcaactgatgccaatacccagttgaatcagatatgggaatttgataaggtttttaattcagctgtcatgcaatttatccaacagtcagttgcaaattttcttgaaacaaatgaaaagatagaagatctcaggaaagtagagccaagagcatttcctaatgaactggaatgtcagagaaaaaaaaagggtcaagaatggtgccataatttttggctaagctatcagaaggaaatacggagttgccttcaactgagatagcaagaggagagattagaaagctcagttcactcagatgttttgggggatctgattgccctttctcttgtcttccatgctctcttgtgtgccttattgattagcaggagtcattacggagactgagaggttggtccatccatgggaaactcgttaaaagtgagcattactaacttgcatactcacatgcagggagtttggtttcttacctaacttgaaaaattccccaagtgtttagatgtttgattttactatgtcgcctaaacagttacatccactatactcttattttcaaattttttcccctaaagcaattattttccagatcatctactttatgtctttagacctagaaactgattactacaattatgattcaaaacctattttctgctgccctgcactgagctgagtaattgggtgtaaatggttatttcgtttgcatgctttgcctttgtgttaagtgttttttggttaaaagaccagaggttgcattattgcctgctgaatatgcttatattaacaattgtaaaaaagtaaattacttttgggagtattaatgaataggcacttaaattgcatagttaaatcttttccatcctttactaagcaaacaattggattaccccccataagaatttaattgacaatttccatgccacatttgggtagggaatatttcttacagacaaaagttgtttgaaatcagaaggttcttagccatttcaatttcataatttgtatttgtgttgttattataaatactaaaatttagattatcatgtccaaagtccactgataataaatgctacatgggcaacggggtggagtgtgacagaagagagaggtttcttaaccacaagactggactgctaatgtgtaatatgagtacgggggcaggaggtaggtattttatatggtgtttcccaaacttacttgaatgcgaaactttcattctttaaggactccacaagatgccaatttgggaaaccctgacttagagtgttaggtaattacatttttgtttctgttttacagtataattttgtataatcctgatgcaactgaaatgaatagagagaggcgtattggtgactgagatatctttcactagcttatttaaattagataatttaattttatttaatttagaagtaggtttacctggttatggagatctttaaaacatggttttaaatgagaagagattaacggtattccacagaagtatcactgaaataaaaatctcttaaggaggataacaacttcagagtgcagatattaacctccgccccctagctgcagagttgtgattaatggcttgcaacaatactattataggataatgtagcatttggaaaacaacctatgttagtggcatattaacagaacacaccccttagaaatatgatttacaatgtaatttcagacttccagacttccataattattagtttccatttacaaagagtggattatgcacagagaatttgacaattgtgataatgctaggtactagttaaaagtaattaggtttatgaacactagtagagaaggaggagtgaagaggaggagaaaaaggtcaatagtgaatttcaaaaaagttgtttctctactaaatattttcattgggccaatttctgatgtataggcccacatttagaaaataacaaaatgtgaatatatagctcttaacataaaaatgaaagttatggttttcttgcaccagccttaagaggagtgttcctgtttagggcagaccctgctaggccttcctgtttgttatctccacaagatattgtaccttaagagcttgcctttagcactttttctttttcctttctgggcttcttacagtctttctatggggatgtttccagcagccccttggggaggggtttggggatatattcatgttttctggggctctgtcctctgtatcctgaagtgctgtcattagcagcaatggcttcaattacctctcattcactcatgctacctagggagtatagaggttaagaatttagatttcaaagttccatatgtttaggctccagtcctagctctaacatccactaactgtttgaccacagacaacctcttagcctcagtttcctaatctataaaatgaggctgatattatattagctatgatgacaaataaattatgataaataacaagaatctatgtaaacttcttagcagcatgcttgctgctgacatgttatattataaatgacagttgttgatgtcttcattatcatgacccgttccttgaactttatactcctatctatatgccctctataaatctctgcctggatattccatggaaaccaatattttccaaacatagccatgtgcttcgtttctttctcagccttctatcagttctttctcttgtaattcctttctcatttggtggtatcattcacccagtaactgttgccagaaatttgtaagttttcttacaactcaaccccaaccaccatctagctaatcattcactgtgttatcttgtgaatttattttcttaagtatctctctgtcgcctttactttatcacctcttgcttgggctaatgcaataacttcctgagtggctcccacccactccacaacgtctctcactctctgtcatagtgatctttggtccccttttccttttccagccacttctcaccctccagtttttcatgctagcagtaccaaatagcttgaagtgcccagcacacacttttttttttttttttttttttttctgagacagagccttgctctgttgcccaggctggagtgcagtggcatgatctctgctcactgcaacctccgccttctgggttcaagcagttcccctgccttagcctcccaagtagccgggattacaggcatgcaccaccatgcctggctaatttttgtatttttagtagagacagggtttcaccatgttggccaggctggtctcgaactcctggcctcaagtaatctgcccgccttggcctctcaaagtgctggagttacaggcatgagccactgcaccctgccagggcccaaaacaccatgccctgtgttttgacttggctgtaggccattgcacaggctattacttacctctggaatcctctcctttccctgcttagcccaacaaactcctattcattgtttcaagccctccaggatgtccgtgtgtcatagaggccttctctcagtaccatgctatccacagatttttaaaactcatagtgttatactatttctatactttataactttacactaacattatatataacgtatgtatacatacataatgtatatatgtatgtgtataatgtatatatacatatgtatacatacatatatagtatatatagtatatatacatataatgtatatatactatatattatatattatactatatatactgtatgtatattatactatatattatatgtatatattgtatgtatatatacatatatacaatatatacattatatatacatatatacatgtaatatatatacattatatatgtgtatatatacatgtaatatatatacattatatatgtgtatatatacacgcacacacatatgtcaacagcagcctactagattggaagttccctgaggacaagaattgctttattaatctttttcttgtttattctttatattctttgtcttattttcattggggaaatgaggtaaataagataaaatgtgcaaatgtcaatagaatttttaaaatcttagtgctttaatatttatttttgatttagctaagattgcctaaagtgtgtaaccaagtcagaattctcacttttgtaaggtttatcttcatatgttttcttgcttgtttctttccatgcatgtctaatctccttcttcacatttcttatgttataaaaatcttttttcttctctattaatagttcttgatatatcctccatcaagtgtgagctaacaaagacctagaatcgatgtccctctacattggctctaaccccagcccttctcacacacgcatgcacacgcacacacgcacacaaacacacacacacaccaatcaaattttccagaacctttgctttgagcagaaattgccttatgtgactggcagtcctctcataaaagtagtaaatgatgagtgtattatagttagactcagaccagaagatggtgtgctacatgaaatctaaagtgaagtctactaaacttcactgaagtatcaaggtgtgacagaggtactaattatgtcaatataagtactgagttagtaaatgctagtcttaactctgaattgttcagctttgacaggtgagctagatttgttccattagcttattggagattcattgctagctgtttcaaataaacctcccccttctattttcaaggaatgatctgaatcatactcctttgtcaagtctttaattgttaacatttaggcaacagttcctgagacttttattttaataattttccactccgtgtgtgttttttgcggtagcaatgagtaggaaaacttttttttctttggtttaatcactgtacctaaagcaactcagcttggtgaatgtatgtaagcatatgtgttggagctggggatgggtaccagaagtgttaaaaagtgtcaggacagcatctctgttcccttactgctatcacattgattaccgcgataatcattgtcacagctgattttgtaaacctttaggttgaaaagctttcacaaagctatcacaaagcacaggaagacaaggaaaggatttattgatgaaattatatgcataagctcttctttagtggcaatgactacactaaatagtgttgaaatagggaacagaccatcgttatctttaatcggtagagtttttatataaatttatatatgtctataattttcaagattttattcttactgctaatgttgtcatttatagttattttattttagctttgtttcctttttgcctacccaccatctatgtccctcaattcttaacgtcagaactgtataaaaagtagtaggaagacacagatttagaaaatgggtagagaaatatctagaagcaccatgatttctcaaaattttatgtacttacataaaattgcgttacttaataaatgtatcaatggcttattcatttctagtttgtcatttttcttatatcattcaccagatattttttgagggcctaatgtgtactgggtactcattaagtttatattttaatatgaatacacacacataaatataacattacatattataagtatatatgaaataatataaatacatgtatgtgtgtatatatgtgaatacacacagtttattctcattattcatggtagttgtgttctataaagttaccatgaatgctgaatgaaccaatactgaaccattgctcctaggggaagtacaaggttgggttccttcaaacctctggtcacaacattttcatcaaccgatcaatacataaccttgttttatgtgtgcttctgtttaaagatactgcatgtaatatatactgttgattcattaacattgaactcacagccaacattgttataactcatgcctgaaggaagcttccctaactcacgtattttccccataaggcacatcacagccttcttgtgcttaggaacactagacagtcccttcagcactatgcttggtgaccatattaaacagcaaaatcaccaagaaaaagcgcaaaatgcaaaaaaatgctctaaatagactttgaaaagatgacttgttgatggcatgagagctgaaacaagaaggcagagcatcatcttgtttgccctcagctggcatcatgcacattgggtgattcaaatttttcaccattacatgcgtgcctgtaaacgactgaaagtgccatgactgttgatttgggggttataagtgaattttaccaagtaggcgaatttacagacatgcactctgcaatgtaatgaggatcagctgtatatcaactttgtgtgtgtgtgttgtgtatatatgtgtgtaaaaatttgttcttggccttcactttccccatctttgtcttttcttttttaaatcattcacggttttcctacgtatcttgtggtacattgcacaattcattataaatgtaatggggcttctaggcctgttgttatggacagaaatttcattgcgtttattaaaggtttcctgagacatgatgtgtttttgtttatagacctctcatagggtgaaaatttaacatgtaactccaaagtttatatgtagcaactcaaagtattattttaaatttattacaattagatataaaattacaactgacaattcatattgactttattatgtttgagatgcagtgtttttttgaagtgccttcaaaagccctttgtgctcctccccaatcacaaccccctccccctcaaaccactatcctgccttttatattaatctttttaaattctctttatagctttaccccctatgtttgtatctctaaggagtatattgtttaatcttttagaactgagtagcaaacacaaacttagctgggtaaagaaaggacaatattactactattgtatgaagacttaggagaagagaagctgaacaagctcttgttcatagtctggcttcagatgttctgagagtggttaggagcccattctgggaagtcggttggcaaggtcatgcacaaataaatcccgagacaaggggctcttcacaggcaggacatttccgctgtagtgcaggatagggggaggtactgagcacccagcaggaatttggtggggggcactggctgccctgcatttcctgctcttcagctccctgatgcctgcctcccattctcaggaataggtcaaagcaggcactgctgtagggtgaaattaagagtcctctgctagtctaggcagcagagaaggacagaaatctcctcagccaattgtcaggaaaagaaaaacagaagaatctggatgcagctcacctacctattctgttttcaggttaaaaaggtggcccgtggcagtggaaaactgatggctctcagtctggattggttgtcctctgtgcctgaggcacagctgtcagcctgagatttcccttccttgcattcctggggattcccttcatctctcttctgtgttggatctcctatttgctgtctccaggcatgctttttattggtctattcttgttttagcaaacacgtcctacaataatttcttcagaaagtgtgcatggcaagtaatttattgaccttttttgtctgaaaatgtccttatggttaatgatggtctggctggatgttgaattcaagattagaaatcattttccttcatgattatgatggtgttgctctattgtcttctagcgttggcattgagagatccaaagctattctgggtgaattgtgtcatccttcctcgctgcacatctttacccccacttctggaaacctgacaatctccttgtccacagtgattttaaatttcacagcagtgtgtgtatggacatgggtcatttattttgctgagtacttggtgggtccttttaatttgagctccttatgatttaaattctgggaagttttcttggattattcccttaatttcttccccttcattttctttgttatttatgctctgcttttcccaaattatcggccaacgcttctattgataaatttctctgtgtgtttttcaagggctcttttgttttctgaaagttctggtttttgtttcacaattgtgatatctttctgaggatattaatggtaatttgaagtcttattgtgtagtgtgtttcctctaagttgctctttttgtttgtttttggttctatcttccaaattagagactcttcagatgtcttaggagccttggttgttgtatacttatgattagaaatagagcaatgattctcaactgggggcaatttgaaccttccgtaccccaggaggatatttggcaatatctggaggactttttggtggttaaagctgcagggggtgctatgctactagtatctagtaagtagaggctagggatgttgctgaacatcctacaatgcataggacatccctgcacaacaaaaaattatctagctcaaaatgttaatagtgctgatattggaaaccctataatagagggcctcaaagctgattaagagagctccgaaggtgcaggtggaacgtgttgactttgggttttgctggaggatgatctagttgagtagtttggagaacctcttcattatctttaggtcttttcttctgagctagtcagatattcaatagaaaagtctttcatctcctgccttaagggtaaagatctggcttccaatattccccctgttagtcaaaaagggactcgggctgtctgcgttcagtgtatatgtgaccacataatacccttgcttttcatataatacccacttcctcaacagccttgtgtttccagttgtgagaccctacagtttggttttttttttttttttttgagacggagtcttgctctgtcacccaggctggagtgcagtggtgcgatcttggctcactgcaagttccgcctcccgggttcataccattctcctgcctcagcctcctgagtagctgggactacaggcgcccgccaccaagcccagctactttttttcagagaccctatgttttatttactctttccagataattaacctgttgggatgagggagcggcagttatccatggtatggagtacaggagaccacctagggctctaactgcttctctaacacatttcattcaaaccttgttactttaactctaccctctcttcacttccagttccagagttatctggaacccattcatgagtttcttggggattctacagtatagatgggtttggttctgaactttccttattatctctttgcagttcagcttttccaggtctgccaagtcaattaccactctccatctgctttcttggattccaaatttaattattactattatctcctctcttgtactcccaatcctttttaaaaacccctttggtatcattgtagtggagtttggatagggaaataaattagatacattgtgctcaatctatcccatgatcctggaaaccaacatgctgtattctagcataatttcatttaattctagtcttattttggtatatttacctttgttatcagaattatttcctagacttaggttttcttcacataaatgaaaactagaggatattagtctgtgtctgcatagggacataattgaattcttttcaaaaccttaggggatattgtagtgatatattcacttctaacatattctggtttaatttacctttttgcttaaaaacatagactgctgtaagcagccatctgcctcaagtagaaccttgttttaccatcccaatcaatattcagaatttgtaaagagttgaataaagaatatatatttcattaaatctgaaatgctgtcaattatctttttccatttttaatacggtcataattagtggaaatatgagaaagatagttgtttatgatgacggcttataactatctctaccagtattttcccccacataaatattcaagaattgactgtaccttagatttaaaattttaagggtgatttcaaacatcaataaaatgtacaggccagactgaaacctatacctcctgaatttttgctgttccctaaactgtcatccaagcataagtaataagtgtaatatagtaggtgtgttacactactttatcactcctccctttttaagatgggaaaccaagccaaattttaaattttttatcagtttctgctgagtttccagttaatgggttaaatcgcaaaaacctcaaaacgtattttagtatctttttagggtgttaaatttggtttaccattgttaaccccctggatgtcattgacggacagacccttaaaatgctttacttgtaacctgtcttcaggtcttcagtagttcatagatataattattttctttgcctcgtactataaaattaaagaattggggatttgatttgatttttattcacagatttttaaaagtttgtgttttgttgtctaagtattctcttttctccctagctctattaattttattgttactaaaagaaaaggggggagaagatatgctttcttcctcacctttgttcaagcaggaaaaagtaaagaattgactcgattgaccatgaacaatcaaccccacatacagatgttgggaagtttccaaaaagatacagtgaattgaagcagactattcaaatgtatcataaatagagtcccaagggtttatgtgtggacaaaaaccaattacatgaagcatttcctgaaattgcttgctattgtcaggataagtaatcagaagtaagacatccaggttgagaatgaaaacgtttgtccctcagtttgtaatattgtcttctcacagaggaaaatctttgaacagttttgagggattatcaaaaggatcctctttctgtagagttttgaaagatatattattaccatttcttttcctcccaggttagcttttttaggttgcttgaaaagagagatttgaagctgtggtatagttgatgtcctcatgatgtcatcttggataaatgtttaagtctaagattaaatttagtagttcgtcctgtagttgaaagaagaaaaactttaaggccagcagtatcacaagtgtagtactgtaaatgaagaacttttctctatctgctaattgagcacatgcatctaggtgtactgtttgtacctgtaataagcgaatgaaggtggtttttttgtttgtttgccttctccccaggagggggaaaatacacgcatgtatacatgtacacatgtatttaatgaccaccatattaaccttcaaataaaccaatcacattgctattgcattctgtattttatagtcaattcacacacacacaaatctatatttggattatcttaactgagttcagatatttcttttataactggtaaccacagggaaccgtgtgtgtgtgtgtgtgtgtgtgtgtgtgtgtgtgtgtgtgtgtgtgtgcgcgcgcccgcgcgcgcgcgcatgttccctggaccagggtatgggcatctttaaatcatctcagctgattcaactgtgaggtctgggtcagcaaatagctagaccagtggctgtgctcatagaaattacttcctttcctctagtaatttcaaacaattctaatttgaagtttgaggaaaattaaggatttctctgtgatttcaggtgaaactggagagggttggagaccaaaccacgcaggcctttctctttgtaaagtgtttgttcaagtcttttgcccagattttattggagtgtgttttttttcttattgtatttacaagttacttatatattttggttcttgacttggactgtatattgcaaatactttctctctctctggtgttttaaacagggatatcatatcagattttcattttttaaatatcattacaagaatgaatgggagaaacaagtttttcagtggttctagtagaagatggtaggatgtgggacatggagagaagaggacaggttcaagagatatttgagataaactcagtaggatttgttagtgatgattaggtaaatggtgggtaagatgagagggaagtgtcaagaatggcttgggtttctggttcataagaataccaccattactatggacttcacttattttgtttaagatgttgataatctatatagaattgtacagtcattatttgccttgagcataagactactatttagaatttttaaaaaattactgcaaattgcaaatttattggtcatttttatggttttggtaatcttttaaaattatctcatgaattatagaaaaatatgttggaagttatattacttaaattttattttgaaaactgtgttcaatttggagtctaaagtagaatggcaaacattatctatattatatagataatgaaacagtaagacattaatgggaaataggaacttaagagaatcaatgaattaaaattgactttttgttttataggggtcccttcagtgttgtacgacgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaatccatttaccaacctaaccttcatctgggggtggggaagcagagggtatgatgtagagggaagtgggtggagacagtttaaactctattctagtttgtcagaattctaggacatagtatttgaaagacagggtaatttacagagttataaaatcatctaggatttctatgggcctatgttttttgactaggaagaaagcaaaaatctgggctttttttttagggtctaattttgaattatattgtgtgggtcatgggatgggaaaggaaggaggtgaaataatggcaagaatgataattgaagattcagaagaaacttagttacctcaaaatgcatcacttactacctttaggattatgatttagtggaatcaaaagattcatatctcacatttggcttaagtcacatatgatatatgtgtaaaaatttgaaaggtcagtactgttaggactttcaggacttaaaattttgtttcaatacattattatagataatcatatttatatgtatatttataaacagtacgtaaacattttaaagttttattttgtttgttttttaagccatagtttcatgtaactgtgacatacatgctcatacttcagatggcacaattgatcatgatactaacttttctaattagcccattactaacttttcacttttccacagttcagtaaaatatgaatccttctttagtccttccctttttaatcccaagagcaatacagttgataatttagattggaaaatctagggcagtgtagcctatttatattttatccagttattttactttgggaagtagaagcccacatattgtgagcttcaagtttgtctgttcctggagatctttttttcttttaaatacttttgtgaccctttgaattattattattcatataatgattatggaagattcttagaagttgctactcacaaagaataactgatttgtttttagtgctttaatatttaaaatattatggtaagatttagagattttatattttatggttttatgctctagaattggctattattgcttttgaatataaattattttataaatctagcaacatttaaaattgacttttaagtggggtttagaacaaaattatatttccttacacctttaactgcctttaagcttaatattctatatttgatttttctctacctctgttgtctgaccaaatactgaggtaattttgtataaacctaattcattaaacatatgttctgatcctgtttataaacttagtaagattccaattttaaatcacaagtctaagtcagttactcagttaccaatattaaattggaataatataagccaaattctcttaagcattgttataaataattaaaataaatattaatagcttctttttcaacccaaaattatcaataccagagttttgacttatctcattgttgtaccaaattctaaatctccccaggctaaagacattctttcgggaaacaattacttaccttctcattggctgaggttgtttattgacagatttcttcagccagatctcttgagctacagactcagaatgccaagctgaacctgtctcttgtcacttggtcagggagtcaaattccaaatttacaaaaggggaaagtacttagtatatagttcatatacctggtattaagtcctgtcttcatttaatataatatatgggagtctgttgctgaagttatagctcactccttcattactttgccattgctttggctatataaatgtcttcaagtcctattctgaagacaaagccacccattctattgatccctcatactcttaagcctccttgaacttaatagaatcatgtactcttttcatatccttcctatatggtaggaccacagcgtatagatattaaatgacatccagttggatttgggatattactcatgactttatctgattttggtcggagtttagtggtattcaagtgaaaatatgcaattggccctttatgtttatggcaccagaattaagtttttccatcttctttagcacagcgactcagtataaagttaggaaacaatcaaaattccatctccaccacctctacctttttttcttgcgatgggattcccatgccctctgttgctcatgttcacacaagctttcttgattctgacttggacacattttattataagatgtataatatatgtaataaatagtaaattatttcattatataaagtctctgtgaacagtgcttcccctccctcaacttctttcaacccttttccagtcactatgggcaacacatcttaactcctctgctcttctggtccatttacaaattgttagggtccaaaaatgacctcattcatggcttagcatagaaggagatgctacataagaagacacatattttgaagtaaaatttaacacagtaaaaaggaatccataagttcaaataatatctagaaatatctatatttaccgttacattctttcccaaataaacttatctcttaagcaacagataatttaaaatctattttattctttattctttcctttttgtttcattttattattttatttttggcttagtggtttgtttgctctttgttaattacctcaatattttttcttgttttcctagtgtacttgtattcaaatacattattgagtgaaataggtctttaaagggttatctaagaacctaccatatgctatttatttggataggtcattataatacaaatgataaataaaaagagcccctagccttatgggacctatgttttaatagtctccaaccattgtttataacatggtttttattaggaaaacaatgtgtaataaattcgaagtaaatcatttacaaattaattttttttgagatggggtctctctcttgcccaggccagagtgcagtggtgcaatcatggctcattgcagcctcgacctccttgggctcaggttatcctcccacctcagccgcctgaatagctgggactacaggcatgcgccaccacacacagctaattttttgtattttttgtagagatgaggttttgccatattgttcaggctgatctcaaactcctgagctcaagtgatctacccacctcggcctcccaaagtgttgggattacaggcatgagcctccactcccagcccacaaatttacttttgaaatgaaatgtgttgatttgttgcagaccacctgtacgttttaatattttaaattctcattgctctaatgaagatgagatattataattggtgaggctaaagatgagacatttcataacagatgagatatttttgaatatctgttctctacttttgccatcaaaatcataatttttattttatagggcttcttaacttgcaggttgccgactattcaataatcccttgaaatagtaagcagaattatgtttatttttttagagagtccatagctcttattagattcctaaaaaggcatattattcctaaatgatttagaatttctcctttcacatgtatgaaaaaatgaaattcatgcttatgaacatgagatgaataagaagtttctactaaatcaaaactggatgaatttatattaggatatgacttctgattgggggattttttatacttacatatacagcttccattaatgaatttcctagattattatcttgaacttttaattaatatactttttgtctcttactctactgagccactaatttagagtttttgtcttaaaaatagatatcaaaattaattcagacaaattataataaggaaactaaaggaaagtaagatgtatagaattggaaactaaattatcaaagttctgagttcttgataggactcaattctttatggtttattataaaagtccaaaattaactgtttttatttgggagtattataaattgtgttctagaaagagtatattttgggctccagtttgcttagtcttcaagaatgtctcattctaaagtcccagatagtaggtgatatcagtgaaattgaagaagtaaggaccttgacagttctcacttttcatttaaaaaaaagagaaaactgacagaaatgtcagaatcaactttttcagggctctggaaattgaccaaaggcttacagctatccaggaataatttattcaagaaaactgactgattcttagtaacaacagtgaacttcatagcattgtataataatttgtcccattcacatccccctttcttccagttctgtagtaaccttgaaaacaaacagttcacaatcacgatgaaaaccagcaacttgacagccatcaaaggaggctgaatggggatggagctcctctaaggccgcattcccataatattgtcatttttttacttgtctggtagttccctggaagacttgtcttagtacatttgtgtttctataaaggaatacctgagagtgggtaatttatgaagaaaagaggtttatttggctcatggttctacaggctgtacaagaagcatgacaccagcatctgcttctggtgagggcttcaggaaacttccagtcctggtggaaggggaaggggaaccagtgtgtacagagatcacctggcaagagaggaagcaagagagagatgggaggtactaggttgtttttaacaaccagttctcatgataactaacagagtgagaactcacttgttactgccaggatggcaccaaggcattcatgagggatccacccccctgactcagacagctccattgggcccctaccttcaacattggggatcaatcttcaacatgaggtttcaggggacaaacatcccaactatagcaacccctcttgcaataccatctttaattggcctgactcagagatcacccagtgcaaaaaaagtttcctctgggggcatttgccaaaaacctttagaggtagttgtttaatttcattgctgcctgaggcatagataacagctgggcaaacaaaaagctaacctaaaagcttaaaacaaaaagctagctaatgagatgcccatagaggctttgaaaaagctacaacgtattctctagaaaatactatgttaagaaggccatgcacatatataaggctatgaacaagctcaggaaaaatctaagaaggccttaatttctcacctctagctgactttcaggctacataaacaggaattgaatgataaggtagaaatgtgaactccctgactgagtgttgaaggtatgccctacacatccacaaaacccttgagcaaagactaaactaaataagcagagacttaagtggccacacataaaaaagaatacagactgcagaatgtgttcccccaaaaaatcactaagcaaagagcaggagtaacaataaacagcaacaataaatcctgcagaaaaggagattctgatttttagagttgacacataatattatttaagacactcagttttcaacaaaaaattatgaggcatgcaaagaaacaagaaaatatagctcacactttggggggaaaagcaatccatagaaactgttcctgagcaaacccagatgttggacttactagaaaaagagttaccaaatggaaagtatcaataatgagatagaaactataaaaaacaaaaagagaaaatcaaatcaaaattctggaattgaaaaatacagtaactaaagaggctcagcagcagatatgagcaggcagaataaagaatcggaaccagaagacatgaagataggttcattataattatctggtcttcagaactgaaagataaaagaatgagcaaaatgagcagagcctcagagacctctggggataccatcaagcataccaacatatgcataatgagaatttcaaaaggaatggagagaaaggagtagaaagaatatttgaagaaataatagtccaaaacttcttaaatttgatgaaaacataaatctacacaaccaataagttcagcaaactccaagtaggataaatgcaaaaacaaaccataatcaagttgtcaaaagctacagacaaggggagtatcttgaaaatagcaagggagaactgaatcatcacatacaagggatctataaaaatattaacagcagatttctttcaaaaaccaaggatactgaaaggcaacaggataacattcaaagtgctgaaagaaaaataatatctaccaagaattctttatccagcaaaaccatacttcaaacatgtaggataaatgaagatattgtcagataaagaaaaacggatagaatttgtcactagcttccttgtcctacaaggaatactaaacgtagttatttatgctaaaaggaaaacttatttttttaatttttaatgtttatgggtacatagtaggtatatatatttataggtcacatgaaatattttgatacaggcatgcaatcacatcaggataaatgaggtattcatcacttcaaacatttaacctttgtgttacaaacaatccagttatattctttcagttattttaaaatgtacaattaaattattaaattatttttgactgtagtcatcctgttgtgctagcaaatactaggtcttattcattctttctattttttgtacccattaaccatccctactttccccaacccctactagccccccgcccccccaactaccctttccagcctctggtaaccactcttctacctgtatcctcctgacttcaattattttaatatttagctcctacaaataagttaaaacatgcaatgtttgtcttcttgtgcctggctcatctcatttaacataatgacctccagtcctatccatgttgttgcaaatgacaggatctcattcttccttatgactgaatagtaccccattgtgtatatgtaccacattttctttatctattcatctgttgatggacacttaggttgattccaagtcttggctattgtgaatagtgctgcagtaaacatgggagtgcagatacctcttcaatattctgatttcctttcttttgggtatatacctaggagtgggattgctggattgtatgatggctctatttttagttttttgaggaacctccaaactgttctccatagtagttgtactaatttacattctcaccaacagcgtacgagggttaccttttctctacatccttgccagcatttgtcactgcctaacttttagataaaagccattctaagcatagtaaaaggaagtgtagtaaaaggaatgacaagaaatcaaagtagaacaccataaaatatctatttaacacaaaaggaggcagtattggaggaatacaggaaaaaaaagacagatagaaaaccagtagtaaaattagaaacataaattgtaccttgtcagtaataatattaaatataaatgaattaaacactccaattacaaggcagagattggcaacatggatgaaaaacaggtgagatggtatctcatgtcgttttttgctgtctggaagagacatacttcagatttaaaaaatacatataagttgaaagtaaatgagtagaaaatgatatactatgcaaatagtaaccaaaagagctctgaagtggctattactaatatcagatgaaatagactttaataattaaatcagaaatttaatagtcaaacaaattgttactaaagaaggacattttataacaatagcagcattaatccatcaagaagatttagcaattataaacacatatgcacctaagaacaaagctccaaaatacatgaaacagaaaaaggcagaattggagggagaaatagagaattcagcaataataattggagacttcaatacctgacttaataatggattcaacaactaaacagaagatcattaaagaaagagaaggtagatttgggcaacactagaaaccaactagacctaacagacatctgtagaacactccactcaacaacaggagactatacattcttttcaagtacacatagaacattatctaggatagactgtgcattagcccatcaaatatgtctccatcaattttaaaatatctgaaatcatacaaagtatcttctctggccacaatggaatggaatcagaaatcaataacggaagcaaatttgggaaattcacaaagatgtggaaattaacatagtagccagtgggtcaaagaagaaattacaagaatactttaaaaatactctgagatgaatgaaaacaaaaatataacttaccaatatttatgagatgcagcaaaagcagtgattagggggaagtttattattgtaaatgcctatattgaaaagtaagaaagagctcaaatcaataatttaacctttcactttaagaaactggaaaagaaaactaaacttgacaggcagaaataaggaagtaataaggattataggagacatagagactagaaaaacaatggaagaagtcaataaaaccaaaagttgtttctttgaaaaggtaaaaataaaattgagtaggctttaaactgaccaataaaaagagacaactcaaagtaataaaatccataataaaggaagggacattactactgaccttataaaaatgaaaaggattataagagaatatgctgaaaaattgtatgccacttaattagatagcctagattaaatgagctaattcctagaaagaggcaaactaccaaaactgactcaagaagaaatagaagatctaagtaaacctgtaataagaaatagactgatatgtactcaaaattttcccataaagaaaagcccaggcccagatagcttaatggtgaattctactacatgtttatagaattcatataattccttcacacatatttctgaaaaataagagagggaacacttctcaactttttgtataaggcctgcaataccctgataccaaaaccagacaaagatattgtaagaaaggaccaatatcccttatgaatgtaaacacacacattctcaagaaaatactatcaaactgagtttagcaatttaaaaaatgttctgtagttcttcagaaagttaaatctaaggttatatgacccagccattttactcctagacatatgcctaagagaaatgaaacatatatccagataaaatcttgtatatgaatgttcatagcagcattattcataatagctggaagatagaacccaaatgtctaccaactgatgaatttataaactaaatatggtatatccatacaatggaatgattttttcaaccataaaaaggaatgacatactgatataagctacaacatgaatgaatcttgaatatattgtgctaagtgaaagaagcaagtcacacgagattacatatgttctattcatgtgaaatttccagaataggcaaatctatcagaaggaagtaaattagtggttgcccagggtatggagaaagatgagatggggagtgtctggtaatgggtatgggatttcttttcgaagtgattaaatgttcaaaatttgaacacagtaatggttgcatgactgtgaatatactaaaatccattaaattgtatactttgtggacaaattgtatgataagttaattgtacctgaataaggattttttaagtaccacgagtaagtagaattataacagaaattcaagcttgtttaaacatttaaaaatcaacgtcatacaccttattaatagaaaaatgaacaacagtccacatgatcatctcagcagacaaaaagcatttaacaaaattcaaccccctttcatgataaaaacactcaacaacctacaaatagaagggaatttctttaaccttttaaaagacatctaggaaaaaccaaagtctaactttatatttaatgttgtaagataatgctttcctccgaagatcaggaataagataagagtatctgttctcaacatgtttattcaacattgtactggaaattttagccaaggcagttatgcaagaaatagaaataaaagcatccagattgaaaaggaagacttaaaatgccctctattggcatataacattatcatgtatatatgaaaatccaaagaaattcacaaaaagacttagatgtaataagtgagcttagcaaggttgcaggatacaagataaatatacaaaaaccaattgtatttgtatacacaagcagtgaaaaatctaaaaatgaagttaagaaagcaattccatttaccacagcatcaaaaagaataaaatacttaggaagatatttaaccaaggaagtgcaaggctaataaatggaaaactatattgttgagaaaaattaaggaagtcctaagtaaatggtaagatctctcgtgtttgcctactagaagacttaatattaaagtgaaaatatttcccaaattgatctatagattcagtgctatctctatcaaaatccctactggcgctttttgcaaaaattgacaaactaatctaaaaatttacatggaaaagcaaggtaccccgagtagccttaacaatcctgaaaaacaatggacaaagttggagtactcacatttttcaacttcagaattttttttttttttttcctggagacagagtttcactcttgtcacccaggctggagtgcaatctcggctcactgcaaccttcgcctcctgggttcaagtgattcttgtgcctcagcctcccaagtatctgggattacaggtgtgtgccaccacacctggctattttttttgtattattagtagagatggggtttcaccatgttggccaggctggtcttaaactcctgacctcagatgatctgcccacctcgcctcccagggtgctgagattatagccatgagccactgcgcctggcccagaattttctataaagctacattaatacacatagtgtaaccctggcataaggatagacatatagattgatgaaattgaattaacaatccagtagtaaatccatatatttacagtcaaataattttcaactgtggtgccaagacagttcaatggagaaagaatagtttcttcaaaacagtggtattgggacaactggaggctgacatgcaaaagtttgaaggtggacctctaccctacaccatatacaaaaattaactcaaagtagatcaaagatctaaatgtatgagttaacaccatgcaattttaaaagaaaacataggcataaatctttgtgaccttggattaagtagtggtttcttcattattacacctaaagcacaagcaaccaaagaaaaaaatagataatgggattcatcataatttaaaatttttatgcttcagtagacactatcaagaaagtaaaaagaggctaggcgtggtggctcatgcccataagctcagtactttggaaggccaaggcatgcagatcacttgaggtcgagttcaagaccagcctggccaacatggcaaaaccctgtctctactaaaaatacaaaaattagccaggggtggtggtgcatgcctgtaatccaagcttcccagctactcaggaggctgagacatgagaatttcctgaactcaagaggcagaggttgcagtgagccaagatcatgccactgcagtccagcctgggtgacagagcgagactgtcccccccacccaaaaaaaaaaaaaaaacaaaaaggaaaaagataatacacagcattgggggaactatttgcaaatcatatatttgataatctagtatctcagatatacaaagaactcttgaaaatcaacaataaacaaaaacagataacctgattaaaatgataatggatttgaatagacatttcttcaaataatatttacaaatggtcaataaacacatgaaaagatattcagtgtcattggcttttaggaaaatggaaatccaaaccataatgagataccacttcacacctactaaaatggctgtagtaaaaaaacaaaacaaaaaacaacagcatgtgttggcaaggatttggagaatttggaaccatcataaattgctattgggaatacaaaatgatgtaaccgctgttgaaaagcttggcagttcctcaaaagttgaacttagagcaccctatgacctagcaattctcatcctaggtatatacccaaaagcattgaaaacatatgtacacacgaaaactggtacatgaatagtcattgcagcattatttgtagcaggcaaatgtggaaacaaaccaaatggtcatcaactgatgaatgggtaaacaaaacgaatattacatacaatagaagatttattgttcaaccttaaaaaggaattaaaggtatgcaaaactggttcaacatttgaaaatcaattaatgtaatccatcacgtcaacaagctaaagaagaaaaattatttgatcatattagtagatggagaaaaggcagttgacaaaatctaacaccctcaacttgataaagaagtctacaaaaaaaaccctacagctaacatcttacttaatggtgagaaactgatgtttttcccctaaaattgggaatgaggccaggatgttcctgttccctactcctgttcaacatcctaccagaaacccttgctaatgcaataagacatgataaggaaatgaaagctatacagattggggggaaagaagtaaacctgtctttgttctgagatgacatgattgtctatgtagaaagtcccaaagaatcaacaacaacaacaaactcctggaacaaataagggattatagcaggttgcaggttacaaggttaacatataaaagtctatcgctttcttacatgccagcaatgtgcaagtggaatttgaaatttaaaatataacacattatattaacaccaaaaaattgaactgcttatgtataagcataacaaaatatatacaagatacatacaaaggaaatttctaaactttgatgaaagaaatcaaaaaagatctaaataaatagatactccacgtttgtggataagaagactcaatgttgttaagaatcagttcttaccaacttgatctgtagattcagtgcaatcccaagcataatttcaggaagttactttgtggatattgacaaattgatctaaagtttatatggaaaggcaaaagattcagaatagacaccatattattgaagaataagaataaagttggagaactgacactacctgacttcagtacttgacttcaatactttaaggctacagtaatcatgacagtgtagtattggtgaaggaataagtaaatagatccatagaatagaatagagaccctagaagtagatccacacaaatattgtcaatagatctttgacaaagtagcaaaggcaaaccaatggaaaaagtcttctcaacaagtggtgccagaacaactggacatccacttgaataaaaatgaatttagacatagaccttacatttttccaataagttttttcataatacttttcccctaagaccaggaataaggcaaagttgatcactttcaccattcttcttcagtatatttctggaagctaccacagtaagggaagaaaggtaaatataagcatatagattggaaagaaagaaatgaaactgtccctgtttgctgatgacatgacagtctacgcagaaaaattaaaaggaatctacaaaaaaaaaaaaaagactcctagaactagtgagtgcgtttgtcaaggatatgagataaacatacgaaaaatcagttatttctctatactcgcaaagaacacctggaaaccacagttaaaaacatagtaccatttgcagttgcttaaaataaaatgaaatgcttaggtataaatcccacaaaacatatacaaaccttgtatggtgaaaactacagaactctgatgaaagaagttaaagatctaaataaatgaagagatgtactctgttcagggattggaagactcaacatagtaaatatataatttctccccaaatctatctctagatttgacccaatttcaattaaaatcctaggaagattttttatggatatagaaggcttatcctaaaatatttctggaaaggaaaaagaataagaatagctaaaacaattttgaaaaactatgataaagtgggaggaatcattctacccactatatagatttatatagctataggaattaatatagagtagtactggcagagagatagacacgtagcttgatggaacagattagattacccataagtacccccacacaagtacagccaaatagtttttgagaaagattcaaactcaattcaatgaagaaagagtaatttttttctacaaatggtggtggagcaattggacatccataggccaaaaatgaacctcaatttaaacctcatgccctataaaaaattaactcaaaatagatcatagatttaaatataaaacataaagctacatagcttttttttttgagacagagtctcgctctgtcgcccaggctggagttcagtggcgcgatcttggctcactggaacctcccatcccgggttcaagtgattcttgtgcctcagcctcctgagtagctagctgggactacaggcacacaccaccatgcccggctaattatttgcatttttagtagagacggggtttcaccatgttggccaggctggtctcaaactcctgacctcaggtgatccacctgccttggcctcccaaagtgctgggattactggcatgagccaccatgcccagccaagatacatacttttgaaagaaaatgtaccctaatatcattaggacatggagggagatgaagaattcttagacatgacactaaatgcacaattcgtagatgaaaaaagaaaaacaaaaaacctcaacagtaaaaaataaaacaaatagtccaattggatagtggttaaaagacatgaacatttttcccaaaaagggttatacaggttctaaacaattacatgaaaatatgttcaacatcattatccattagggaaatgcaaattaaagccacaataagatatcgctccacacttaatagaacagctacaataaaaaggtgaggccaggggcagtggttcaaacctgtaattccaccactttcacaggctgaagcgggaggattgcttgagcccaggagttcaagaccagtctgtgcaacatagggagaccctgtctcttaaaaaaaataagtaacaatatgacaataccatattctggcaaggatgcagagaactggatctttcatatatctggtgtgaatataaagtggtacagtcactccagaaaagagttaggcagcttctttaaaatactaaaacatacatttgccatacaacccagcaagtgtactcctgggaaatgtacatcctaaggaaatgaaaacttatgttcacagtaagacctgtaatcaagtttttatagcagctatactcgtcatagctaaaatttggaaagtaccaaaatatcctacaatgggttaatggttaaacgaattgtgatacatctataccatggaatcctactgagcaataaaaatgaaaaatctactgatgcatgcaactacttggatagatctcaagaaattctacttcgttaaaaaaatctcttaattgtcgtgtactgtatgatttcctttatataagtttcaaagtgataaaattatagaactggagaacagattagtgattgtcaggtgtgggacactgcaaagtttaggtgaggattgtgagatgggtgagtgggtgtgactagaaagggttagcacttggggtttttgtgggggattattatgtagcagttctgtatctctgttttggtggtgactacttgaatttacacatggcgataaaattgaatagctgtgcacatagacacatgagtgcatgtaaaactattgaaatcgaaataaagtctgttggttgtatcaatagtcagtttcctggttttgatattgtactactgttatatgctactatgggggaaaatgggttaaaggtacacaaaatctctgtactacttttgcaactttctgttaatgtacaattattttaaaattttaaaaaattgtaaggtttcccttatgaactgtatgctcttccatgaaagagataattagcccacaaatatttaggagtataggtaaaagcattttaactacaggttttggtttccaaacattccaaattgttctgtacaggcaaaccctgactgatataactgatagcatcatcaaaaactgtcactcgttttcctcaagaaacatgaatatttaatagatttaatttacataggaaatttgtattcattttgtggaataattactggtttagttaatgaatctctataccttccttttgcatgcagaaatcatttgccaaaaccttttatttgcagttgcattttcttagtgtcatcatttgcttgactatggcttgcaattgatattgttagaagtaatccagcaaatttcaagatattaaggcttatacttttgtttaattttgtcatgcaaaatactatagaatatgcttccagaacagtttgatcatgtatttttaaattcccatcccatatttatcaaattatagtttataaatttaatatttaaaatgaaaactcattctttgaaacattaatgaattatgttcattatgtgacataatacgtcacataatataaatgtgcaatattttttgagttgtcagataatcattttgagcattggtattattaattatagattcttaaggatgatgaaatccttaaacttggctagtatttaaaaaacgtatttgttaattgtggttctatggggaaaaggttttgtgtttcttggaatagtttgagcaaaactgctagagaccagcttctagctgctgtaataattttcaatgaaacacctccttttcacagttcctgatcataatagtcatttaattattgttttgctcattggctagtattttcctaaatgggatttcccttagatttttttttgtttttcttcacttttaaagcaaatattctttgtatagaatttcatatatttctgtagaccttatatctttttttccccacagggcaagttctatctgtagaccttagacaataaattatgagtactgttttagcaaactgtacatctttggctgtttttcctaatggttttgtgtatgtgtgtctgttttgaattttttcaggctaatgagagtcaattttaaatacgtctgtttcttaatgattaattttgctgtattatgacaagcatttctggataactatttacaatgagatacaaatattacaaatgtaaagtttatacttgtcttgctaatcagatcctgctattctgtgaaaaactgctgatgaatctctaaacctaagacaatttatagtgattatgcttgagatcaactgcatgggaaaagaaaacttacttctttcatcttgttttttgccttttaaaaaatagtgtagattacctacttctgaaagtatgtggctatttgttaactaaaatgactcatacttgttcaatataattctaggtgtaaacatggcttgatattacatgtaacatgttggccataatccccaatatcaacgttttatttgtaaatgtctcttaacctgaatttctcatcttatatgacttcagtatgtagatgaggaggctcatgtttatataatagagctctcaaagttcattggctcatatattcaatttttcttagtatcatcttaatgttacattcgggaaatatagcaatatgaaaaaaatgtgagatgagtttctctactcattttttattctgaaataaagcagcttttaaaaaatgtttttccaggccaggtacagtggccaggcatggtggctcatgcctgtaatcccagcactttgggaggccaaggtgagtggatcacctgaggtcaggtgttcaagaccagcctggccaacatggtgaaaccctgtctttactaaaaatatttatttttaatgtttttcctctactataagtggaatttgtgtttcacaagttaaaaatgatttttatcattgttttctctttttctatacaaatagctacctattttctttcaaatctgcattttgctagcttttacattatgtgacgtagagaattccttaggaagctgtgggaatagaaaatagataaagacaggaatttggtgggttgacataacccttgatatatgggctacagtagctggaaaattcagtctgtacactaggtacaagatgaattttggagtatacttgctaattaaaatttgagtctgaagaattagatgggggtgttcttagatgtattgaataagttactgttatcccatctatatgaataacctttggaaataacctaagaagtgtcttttgttaagtttgctctgtaagaaatttgtattacacaattaaataatacatgtcagatagaaaatataataaattctaacttagcagacagtttattcaaaagaattatcgcaagggggagaaactattgcaatagggagtggggtctattttaatagaacactctcaccataagatctatgagtatctcaagggttaggcaaaaaatatttttcttttatgggaggaataaacaagactagaaagaacttggtgggaggaagtgggaaggcctgggggaaggagagaagcgtaaccagtttgattaacaggcaacttcaaattgggtacaagagctcctaattgttcacaaaaacttctatacaatatcaatcacgaatagttttaagggaaccacttttcaaattcttacttctatatatactcttcgtaaagttgatatgcttaagaaaatgtctgtaatggacatagaagttctcctttcttatatcccctttcacaaatttttcttctctcattttactattgtccttcctcctacccatccagaatcttaattgtggtgcgttacaagatctgttgtaatatgtatcaaaatctccagggcgccaaacaaaaggacagtttgaaaattggcatcagtgttgagaaagtgaatgactctgaaagaccaataacatactttttcaagttagatctattcttgctttgctttcaacaaaattgatggatgaccttatcaatttgtaagttgatggattattaagagtaatttttgtggctcactcctgtaatcccaacacttggggaggcagaggtgggcagatcacctgagcctaagagttcaagaccaccctgggcacaacatggcaaaaccccatctctacaaaaaatacaaaaaattagctgggcatggtggcatgtgcctgtagtcccaactacctgggaggctgaggtgggaggatcgcctgagcccaggaagtcgaggctgcagtgagctgtgattgtgccactgcactccagcctgggcgacagagtaagatcctgcctcaaaaaaaagcataatttttattaagtcattataattcatggtgtataactcaaaaagagattgctttaacagaactccatctattcccgtatacttggtttttttcaaataggtttattgagatataattcacacaccataaaacactcctttaagttgtataattcagtggattttagtatattcagagttgtgcaactgtcattgctacctattttcagaacattttcatctcccccaaaagaaaccctataccttttcatagacacccactattttcccccctcccagcctctggcaattaccagtctactttctatttctatggatttgccttttttggacattttgtataaatggaaccatagaatatgtgttgcatctggcttctttcgccttacatattttcaaggttcatccatgtagtagcaggtatcagtactttattccttcttatgactgaatagtattccattgtgtagatatatatcgattcattagttgatgtacatttgggttgtatcagttttttagctgttatatataatcttgatatgaatattcatgtgtagttaagcctcgttattcaaggattctttatttaaaaattcacctacttgataatatttataacccccaaactcatactcttggcgtcacgcacagacaggtgcaaagtgacaacaagtttgaatcattcaacatgcacattcccagctaaggtcggacaacgcaacactcttctatcttgttgtttgggctctcataccataaatgagttcccttttctatgtctacttaattccatattttttcacatttttgtgttttttgctggtgattttgcttcttaaagtggccccaaagcatagtgttgagtgctgtctagtattcctaagtgtgagaaggctgtgatgtgccttacagagaaaataaatgtattagacaagtgtcattcaggcatgagttatagggctgttggccatgggttcagtgttaataaatcaacaatatatatgaaataacatgtctttaaactgaaatacacatgtgataaggttatatattgatctgtggacaaatatggtgcaaccagagattcacagtaacctgtattttccctaaggaacagtgtttctgtgtttcctcagtcagtgtttgtgttgactttatagaatataagtactgcaaataatgaagatcgactgtatatggtttcatgtaaacatacgttttcagttctcttgggtgtatacccaggaatagaattgctaggtcatatgataacattgcttgttttgtgaacaaggtttctcagcgttcacatctataaaagtgaaaataggaatagaatttgtgttgagccctgtcttattctaccacatgcaagaaaatgagatccttgttggactggtgtggaactggccccatgacacacaggaatgtcaccttttgtgacacttccatagacataacttccaaggacccctgaagagacatgcccaagtggaagaaatcaccacattcaggaaagtccaaagctgttcaattgtaattttcctagagtagattgttttctttgttattataccagctttccaccatctgtctcactttcctctttcccagttcctagatggccgctttatgggattgaatctagagagtttaagccttacatagaaagttgatgagcctacaagtgggttaaagcttagtgtttttttttttaggtttcgtgttttttaaaaaagcattttcatatgaactgttgcttttttatttatttatttatttatttattttgagacggagtcttactctgtcacccaagctggagtgcagtggcacgatctcagctcgctgcaacctatgtctcctgggttcaagcgattctcctgcctcagcctcccaagtagctgggattacaggcgtgcaccacaatgcccagctaatttttttgtatttttagtagagacagggtttcaccatcttggccaagctggtcttgaactcctgacctcaggtgatcagcccgcctcggcctcccaaagtgctgggattacaggcatgagccaccacgcccagctgaactgttgctttataatatctcaattgtttacttcttcaatagcatgaataatttactatataattaaaagattttagtgatagtacatcaaaaagagtagtatctgcaaacagaagcagttttgtgcttgtttgtagtaaagactctatctataactgagtcagtaagcatattctcctttttaattactgccatgtactaatcaaacactatttaaaatgccaggcatgttgctaggtgctgttcatatctgttgtcttatcttcagagaaaccctgcaaaaaaatactttatctacattttgcaactgaagattaaagaagttaaataacttttggattgatgcacaggaagtggtagagccaggtgaatccaagttggtctgtcttttggactgcaaaagctgtatttttcccacatctgaagctgttagccctcaccctttatatcctagtgcccagctactttatgtgtcctgcacccctaaacccaaaagcggtatgtgtgtgaagtgaaggtagagagttttgtttttctggatttgttttttcacagctttactctgaccacctagaaccatgcctggcacaatataggtaatacttattgagtgaatgaaggaatgccacgtaagttttgtgaatttactgaggagtctcgggatggtgcaataagagaacagtgtgacagttgataaacaaaggaaggtttctgctttttggcaaagattacatctgtaaaaggtaaataggctgagtaacactttcatggtcaggactacaaagctgggctataaaaacacattattctaatccatgtttatctatcacttcttttgtttttttttttttttttttggcagagtctcgctctgtcgcccaggctggagtgcagtggcgcgatctcggctcactgcaagctccgcctcctgggttcacgccatactcctgcctcagcctcctgagtagctgggactacaggcacccgccaccacgcccggctaattttttgtatttttagtagagacggggtttcaccgagttagccaggatggtctcgatctactgacttcatgatccgcccaccttggcctcccaaagtgctgggattacaggcgtgagccaccgcacccggccatctatcacttcttacctggctggcacgctagtttatccaaactactttattgtacacgcttgttgtacagcttgctattaatataatgaggtcatataattagttatggtagtagatggtgacccttctcaaactatgaggaagatgtttaggtatcctcaaagtaaattctgcagtgatcccagagacagattaggaagtctcagagatggacaaaagacttgaaaggtatttcagaggctgggcacagtggctcatatctttaattccaacactttgggaggccgaggcaggaggatcatttgcgtccaggagttcaagaccagcctgggcaacatagtgagacccgatctctacaaaaaataaaaaaattagccaggcatggtgatgtgtgcctgtagtcctagctgcttgggagggtaaggtgggaggattgcttgagcctgggaggctgaggctgcagtgagccgtgattgcaccactgcactcagcctgggcaacagagtgagaccctgtctcaaaacaaaacaaaaaaaaagatatttcagaaaaaaaatgtatccacatgagcagtaaacaaggcacaactccattagtcatcagagaaatgcaaattaaaaccagataccactgcattcctaacaggatggctaaaaaatgaaaatgacagttgtaaagtggcagtgagaatgaagagccaccagaactcttactgctaatagggatgcaaattagtttaaccactttgataaactgtttgggaatatctaccaaagctgacatatatatatatatatatatatatatatatatatatatatatatatatatatatatatatcttgtgacctagcatttgcatccctgggtatatacccaacagcaatgtcttaacatatgttcacccccacccccccaaaaaaaaaaaaaacaaaaacatgtacaagaattcttttagcagaattcttcataatagccctaaattagaaacaacccaaatgtccaacagtggcggaatgacataaataaataccactgtattcatacagtggagcacaacaaagcaatgagaatggatggaactttgttacacaaaaaacacagatgaatctcacaagcataatgataagtgaaagaagccgggcttaaaaaactaccaactctatgattccatttatataaagtacaaaaacagtgtaactaatatatgaagtttgaggtcaaagtagtggttaccggtgggggaaggtagtgaatgggaggggacatgatgggagctacggaggtgctggtcatgttctgtttcttgatctggatgctggttgagttcactgaaaattcatcaagctgtacatttatgatatttgtaggaaggataggtatacattgtccgaagggaaagagtggagcagttttattttgtcagctcatgtggtctggcataaagatctgtctgggctatttaaatatttatattttgcataatggggatctgacttgttcacaaaagtattcattcagtcttggggagaaaagggtgatgacatacctgttctgtgccaaatgctaagtactgggatatgtaaaaatagaaagaaaacatagatatctttaaatctaataatccagacataagattctcttcctcagtagtaaatgctaaagagacagagtgactccatgtacaggtgaatctgctttgttatccttattggttactttaaaaataatgacagaaggcattggtgcaaaatgtatctaaagttacaacgtaagtgccatttctaaagcgtttgggagaaaattccactagtctatttgaactggccttgtgttgtctgtggtgtttggctttctcttgggtagcttaaatttcctccccatcagtatagtagattttatctattttgtttactcttcagaaataactgccaggggatttttaagactactgattgaggaatgattgccaaattacccatttttaagtgtaaagtcagtaagcaatgccaggtttctgaggagcttcaccaatttgtctctataatgtgtagtatttttttaacagttttaatatatgaatgaaaatactaccaagtttctcctggatccccacttttgttcattcagtgattttttttactgagctttggaaatgaaccttttgtctttttagtatgatcctctcccctcatgtcgtttgaaaatacccatctcttgcacgagactaagaacaatgctgtcctgttgagttcttataaaatccaaagaaaatttaagtactaagtggatgatagttaaagggtttacagcttttcttacagatccatcaaagtgggaaaatcatgagaagagttggagtcagacatgccagacattccaaatctgtcctgtacaatgtgaccttaagtagttccataaacctcagctttcctagttgtcaaatgaggagaatgatactgtcctcatggggctggtgcagggattaagggtgatgatatctgtgaagcatctcagcttagtgcttagcacactgtaggtggtcagtaattttcctgttctctgttgtgatatatcctctactaattctggagttatctttatcttgcctacctcaatccattctctacaatttccatttgtttatcttaattattttgtcttcctcttacttttttcctaaataaagctacaggagagtagattttctgtactctgacaagacatacatttttcttcttttaatagtgttaaaacaaatgtccaaaaaaacctttaaataaaaaaccaaacatgttcaaggaagttaccatcttttctaaactctgtcagcagggtggctgataaaataaattttctactcattagtctgagatgcttattgaagactgctaatttaggaagtatgggcctgctatggtctgaatgtttatgtcccccaccccaaatttatatgttgaatcctaattgtcgaggtgatggtattagaagatggcgcctttggaagggctctgccctcgtgaatgggattagtgctcttataaaagatgccttagagagatcacttgcccccactaccatgtaaggacacagtgagaagatgccgcttatgaaccagagagcagcctgcattagataccagatctgctggtaccttgatcttggacttcccagtttctagacccatgagaaataaattcctgttgtttatagaccacctagtctatggtattttgttatagccagcccaaacagactaagacagggcccttttatgttctggcttaccgtatttaactatggctattttactagtcagaacccctcttttctctagtgtatgtttctgtgacttagatttagtttgagggcattttcatgtttacttttttcttaaaaattttcccaagattattaacagatactaaatgaacttccctcttccatttcaattttatatggtatctcttttagatctttctcttaaagtaaatgcattacattgtatttttaaaacattttttgccttaataaactgctagcatttcagttaagaggagttaataacagtttcaccaatgcacattgaaaacgatgggttccattaaatagtcaataattattaaaattaagccaagaataatgaaagggatacaattacactaaagtgatatttatgtcttataaagatttctcttaaatgaaaattgacaattattagactagccatacacaaaatctggtattttaaaactaatcttggctgggcgtggtggctcacacctgtaatcccagcactttgggaagtcgaggtgggcagatcacttgaggtcaggagttcgagaccagcccggccaaccaacatggtgaagccctgtctttaccaacaaatacaaaacttagccaggcatggtggcatggacctgtagtcccagctactcaggaggctaaggtgtgagaattgcttgaacccaggaggcagaattgcagtgagccaagatggcaccactgcactccagcctgggcagcagagtgagaccctgtctcaaaaacaaaacaaaacaaaacaaaaaactaaaccaagggccaaagcagtatggtgacagggaaatattttatattttcccttagagacttcagagtgctgactcaccccttccacctaccatgtgaggacgcagtgataacacaccattgattaatgtctaagaatatattgaggaaaatactctatcaggctaacagggaaactggcacagttttgtttccactatattttattggttagagaagtcacagagccacctggttggaaggagaaaggatgtagatcccacctctggatgggagagatgacaaaaaaatttctggccatctttaatctgccacatcaattaattttaaacttaaactttgttgccttaatgtttgagtgagattgtagtagttgatgctactccattccgaggcagtactaaaatcctaccagaggatccaatgtcctcattaagtcccaattcaggatacatatgacagcagtgaataatttgtcactgtgaataggagactaaaataaggacataccatgttgcacaattacagactatttgaaatccagtctggcactgtttgttaaaacagaattttaatatttttgtaatcaaaagatagggaaattatttcaggcaggctgtttttataatttcgttttggcattcttctcttaagaatgaataataatataaggaaacaggtagtgattgccttttgaactataaagtgcttttcatttttagtaagaggttttatgtctataaaattatctgaaaagacaggtcatctgctaaccagtggtagagtatccactgcaaggctcaggactcctgaaacacatcataaaattgtcatgtaaggaaattcttggagctgagtgcagagctagtttgatttcatcataataggcagatattgatggattaactttgagtatttcatgaaataaaacatactttgctgtttttggtttataatacattttaaaacgtttgagtctgaaacaaaaattgtgaagctgatatttgtctttcctttcattctatatgtgaccagtttaatttttgtgattcggggcaatcaaagtatttgctgggtatctagagtgaatattttatcactttagataatctaatctaaaagcccagtaataacagttttggttatttttttcacaggtggggtagtatatcaaacagggtccagttaggagacagaaaccaaacagtaatttaatgtgtttcttttgactttttaaaaatttttgttggtacagagtaggagtatatatttatggggtacgtgagatgttttgatataggcatgcaatgtgtattaatcacatcctgtaaaatggggtatctgttccctcaagcatttatcctttatgttacaaaaaacccaaaaatactcttgcagttatttttaagtgtaccattaaattattatctgctgtagtcaccctgttgtaatatcgaatactaggtctttttcaatagtaatttaatttgaacatgcaaagtttagtataaggaattattgccaaggggttggggtaattggctagtaaaagttagagaactgtgaaaaatacaggcataaggaacagctgctattccaacggctgagatagaatgctcaaggaagaggtttggccttcctcctggcagcactaagatctgaaccttgttgaagaaaatatggccatgactcaccggatcacagtgaggttcactgagacaccatgctagtgggactcattggaaatctgccctctggagtccaggggaagccatccttagggacagaactctgaacatgcagcaagctcactgaggggctgctggaggaagccagtaacaaggagagtaccttgccagcagcgctctgctgtaaaggcacctgaagggggttccaagagaagctgcacatggaaagatgcatgctgctggccactgtgcactgcagataaactgcacacactgcaggagcctgatgagaaaaacactggaactgggacaacagaaccctttctcctccagtgcccctccagtgcccttagtggacaaagcttaatgttgtgccagttggaaaaatattcacagtcaatctccagtagtgcagagcaggcaatgaagtgtggatttggagctgacagacaatagattgataagtggcatgaggagtggagagattgtgtatatgacagtgagtatagttttgatgacatgtatcaagcaacctcattcattatacttggcaatgattttatttcattttgcttttttttccccctcctttaaggagattcattcaatacaacttagtggtatagggcttaaggaaggaaatgcccacgtttttgcttcatatgactagttggatagtggtgctacttattttattcaaatggatactatcaaagggtcagggagaataaatgagtttttgacatcttgcatctcagtaacttttgaaatataaatgttgatcagttaaatattttagtctaaaatttaggaccacaatctgaacaaaagagaaaagatttgaaaatcttcatcgttttggtaatagacgaaacttcggaaatacctgtgattgcttaaagaaagtatattaagaggccacaatgaaaaaaaatgatcatgaggaaccatttttggtcatgaaaaatggtcatgaggaatgatcctgacgaacacctaaatttaaagaaaggatggaaagagacagaggaaaccaggagggggaaagagaagtacaagaattattatcagagaatgctgtcatagacgctgagatcaaaaagattttctgtgttgtcaaatgctataaagaagccaaatgagggaacaactgtaatgtctatggaatttggcaacatggaaaccagtgtgaactttggccagagcaatttcggtattgcactggggacaaaaacaagattgtagtaggcagaggaaggaatggggagtgaggaagcagggaaaataaatataggataattttcaaatggctagactgagaagaggagagagaaacagtcatagatgcaggggcatgtggaggcaggggtagcgattaaaatgggaaggattccagtatctttttttttttttccttttttgccagaagagagagctaagaggaaagaaaagggtgcactgatggactgagatcttcgataggcagcaggtggagggtgggcccctcttccatcaagaccaaaagaaagtcaaggtactgatagagctaggcctgcaggcaggagaaggaaccagaggatgtccctcagctgatggcctgattttcagcaggtgggaggcagagccacctgctgagagtaggcatggtggtagagagtagagagataagagagttagtaatagcaggttaagagagataagagacattgctaggctgcctcaaggcccctccccccacccccgctgaggctaaatgcaaggaatttgtagcagcgcttatcaacatgcagatatgatttctctcagcaacactaagtagcctacaattgaggaaaggaaaattgtatgggtagattgtgctagagtgagaagtattacacacagcagacatgatggacaaaggaatcaagagagatgaaagtaatagtaatagcaagagaaaagaccatggagctggatggggaggaagattttagaggtgcatcaaacatattctagttggtcagtctcctcaccagtcacaatagttttcacgacatcaccgtaagagggacaatagtatggtaagtaagaaaaggaagttaatttcaggagacttgggttcaaataatgatcctgccatttatttattttgaccttgtgaaagttacctaacttctaagcaagcctgcatttttctttctttcttttttctttttttttttttttttttttttttgagacggagtctcactctgtcgcccaggctggagtgcagtggcgccatctccactcactgcaacctccgcctcccaggttcaagcgattctcctgcctcagcctcccaagtagctgggactacaggtgcacaccaccacgcccagctaatcttttgtgttttagtagagacggggtttcaccatgttgcccagtctggtcttgaactcttgagctcaggcagtccgcccgcctcggcctcccaaagtgctaggattatagatgtgagccaccacgcctggccacctgaatttttacacatagtaaatgctcaacaaatatttaatatgaagtgatatttcaagaaataagaaggtgcaatacaacacattagagatgccattctggcacaaagaaacaagtcagtgcctgctctaattttaatttaatgttacaatagccagttttgattagaatattttgcttcaccacatggtgctcaaggtactgtggctgcataacaaattaccccaaaacttagtgtcataaagcaactatttaatatactcacagcttctggggctctgcagtttagacagggcaaatctggggtgtgagtcagaagactcgagggctagggcaggaatcttctaaaggctcactaactcacatctggccattgatgctggctgttgactgagagactttacctgggaactttggcttacacttcatgtgacttctctctgtgaaaaggcttcctcatagcatggcagctgagttccaagggcaaatattgagagagacatccttttgctcagaataatggtattgagattcatccccatgtctgttgtattagtactttttaaattggttagtaatgttccatttcatgcatatagcaaagtttttaaatccattttcttgttcttagaaatatatgttgtttccactttggggctgagtaaagccgctttgaatgtttgaatgtaaatcttttgagttggacatattgtcacttctctcacataaatgcaagagtgcagttgctaggtcattaagaaactgccaaactattttccatagtggttgcactattttatgttattaccagtaatgtatgagagttacagcttttccacatccttgccaatacttggtattgccatcctttttaattttagccattctggtgggtatgtcatgatatttcttgtggttttcatttgcatttaccttatgactaaaaatgttgcacttattggccattcatatatctttgttgaagtatatcttcagatcttacaccgatgtctatttttcattgaggtgtgtgtcttttgtattaagttgtaggagttctttgtatattctggatacacttccttggtcaaatatacatattgcaaatatgttttcccagtttgtaactttcccttttatattcttaatggaatctttaaaagagtagaagtttttcattttgatgaagtccagtttacagtttttttccttcatggttcctgatttttgtgacctaagaaaatttcacctacgtcaaatttgtgaaaattttctttatattttcttgtataattgtagttttggctacgtttatgatgcactttagcataagagttgtatatcgtatgaagtgtaagggttgagattcatgggtagccattcgctccagcactatttgttgaaataaccctattgagttattttagcacctttatcaaaaataatgtgttggtctattttctgcactttctattctgatctgtatgtctatccttatatcagattcacactgtctagattattctatattaagtcttaaaatccagtagccaaaatcctacaattaggattttgtgtttaggctattctagctacttaaattttcataaacaatttagagtaaatttgtgaatttctgcaatgaagcatgagattttgattggtgttacttttaatctatatattaatttggggagaatggaaatcttaaccatattgagtcctccaatccatgaacactactccatttatgtagatttttttacattctcccagaaaatatctttgtagttttaagagtagatattttattcatatttcattacatttattgttagggcctcatgtttttgatgctatggtgaatagtattatgttaaaatttttaatttaatgattattgatagtatatagaaatacagttgattcttgtatattgatctcatatttggcaaccttgctaaatttacttattctagtggcttaaaaaaatccttaagattttctatttgaacaattgtgttattttatttctgtccattctgtatcccttttatttctttttcttacctttatgccctagctaggacattcaattcagtgatcttatattgatctcatatttggcaaccttgctaatttcacttattctagtggctttaaaaaaaatccttaagattttctatttgaacaattgtgttattttatttctttccattctgtatgacttttgtttcttcttaccttgatgccctagctaggacatacaattcaataatcttagggagcaaaccagtctcttaccattaggtattgtctgcaggtttttcttaaatgccctttattagattcaagaatttgttttatcgtcctaatttgttgaatttttattatggataagtgttgaatttcttagaatgctttttttctgagttgagtttttgtatagttctcctttattctgttacttacattgattgaattttgaatgctaaagtaaccttgcattcctgggataaaccctacttggtcatggtttattaaattttttatatacccatgtggtaaaaatactaatattttacaagatttttgcatcagtggttatgatggttattgctttctagttttctttttaaagtttctactggcttaggtatcagtagagtcaggtttactggtctcatataattagctcattattttctcaaaatgtttgtattggattgctattactttttcttagtgtattgtggaattcaccagtgtcactatctcctgggcttgggattttctttgtggggttattttaaattatacatgtaatttctgtaataaatttagggctattcagattttctattttttcttgtgatagtacttgtaatttgagtatttcaaggaatttgtcagtttcattttatttgttggatatattggtatatctttattatatttcttataattttcttgtctgacatatctgtactgatgtctcccctttcattgctgatattgataacttttgtcttctctcattttccttgatcattaaaatctttccaatggaatctttcaaagagcagaagttcttaatattgacaaactccagtttatcatttttagctagaggtttattattttcattgatcatacattgaacaagcttttggtatcattaactttattgtttgttcattttctgggtaatttctatcactgttttaataaagtccaatttgtcgacgtattgttttatgaattgtacttttggtgctccttctaagaaatctttgcctaatccaaggttggaaagcttttctccttttttttaatagaaatttaatagttttaggttttacatttaggtctttggtccattttgagttaatttttagatattttctgaagtctggatacaagttgtctttttttttggtcttgtcttttttttccatatatatagttgttccagcatcatttgttgaaaagattatcttttctccattgaatttccccttgcaattttgttaaaatttgattgtacatacctgtgtgggtatgtttcaaaactctatattgtttcatagacttattgatctgtctttagggtaataccacactatcttgattactgtaattttatgtgtctttggattttttaaaaaatagagacagggtatctctctgttgcccaggctggagtgcagtggggtgatctcagctcactgtaaccttgacccctcgggttcaatcaatcctcccacctcagcctcccgagtagctggaactacaggcgtgcaccatcacacctggccaatttttgtatgttttgtagagatgggatttcaccatgttgcccaggctggtcttgaactcctgggctcaaacaatccacccacctcagcctcccaaagtgctgggattacaagtgtgagccactgcacccagccctgtagttttatacgtcttgaaatcaggtgtcagtgtcccaactttgttctactttatcaaaattgtttgcacttttctaggtccttttcgtatgaattttagaattagtttgtccatttcagcaaacacacacacacacacacacacacacacacacacacacacacacacacagaaggcctcctgggatttttattgggattatgttgaatacaggtagtcctcaccttgcatggcactatgttaaatgaaacgtgcatattgaaaccaaggcctcaccatgcacagttccaatattcatgtttcagttaacacagtactagcactgtgcaaagtaagtatggcctatatgtagaataatttgggggagaactgacatattaatgatactgagtcttccaacccatcaacccaatatcattcttttatttgtatctctcatatatctctcagcagcattttatagtttttagtataaatgttttttcaacgttttgtaagaatttttctctgtatttcatatatttgatgctattacaaaatttttctagtttcaatatcctttttttaacttctggaatatataaatacaactgatatacaattgtatatcagtcttgtattctacagtcttacaaaactcagaacacattgagctctctagtccaaaaattcagaatgctccaaaacctgaaactttttgagtgcctatatgacatcacaactggaatattccatagctaatacctaaatccaaaacacttctggtcccaaggactttggataagagatattcaacctgtagttctaatagcttttttgtagactctctctgattttctccatggatgattatatgtcagttatgtcatcttgaatacaatcagcattaattacatcttcctttccaatctggattcctcttgtttggttttctggccttattgcactgactggctagatgtctcctccagtataatgttgaatagaagtcatgacagcaaatgttttcttattccttagagaaaaaacattagattgtttaccattaagtattaatattagctgtaggtttttgtggatgacctttttgaggttgaagaagtttctttctattccaagtttgctgagaattttcagtaggaatggatgttggattttgtcaaatgctttttctgcatttattgagatgacctttttagtttattgacatcatgaattatattgattaattttgtagtgatcaaccaacctgtattctaaaaactgcatattggcctctagttttcttttgttataatagtctttaactggttttgatatcaaggtaatgctgagctcatagagtgaattagaaagtgttccttttcaattttgggggaaaggtttgtgtagatgtggtattatttcttcatgtttggtagagttcatcttggcctgaagttttctttgaaggacgatttttaactaaaaattctattttttatagttataggaatattcagtttatttcgtcttaagtgaggtttggttgtttctttcatgaaatttgtctgttttacctaagtgggtaaatttattggcatggagttgtttgtaacattcattattcttagtatatctgtaaaacctttagtgatgttacctttctttatccttaacattattagttcatgtgttttctctctttttttttttctgagcagcctggctagaggtttatcaattcattgatctatttcaagaacccattttttgtttcatttatgttttctgttgatttactttttcctattctatttatttcaactttggtctttatgttttcctttcatgggcttattttgctttaattttctcatcttctagtttattaagttggagactaagatcaagttagttaatagtattgttcaacttttctatatcctcattcattttctgcctacttgttttatcaattataattttggatttgtctgttcatatacttttatcacttttgtcttttatgtattttgaagttctgttattagatacttatacatttaggattattatgtcctcttgatgagttgactgtgttattatcatgaactgatcttttttctttgttcttcctttatgcagtgtatccttttttctgaattaaaaaattttgtttttttagctgggcacagtggctcatgcctttaatcccagcagtttgggaggacgaggtgggtggatcacttgagctcaagactagcctgggcaacatggcaaaaccctgtctctacaaaaatacaaaaataagccaggcatggtggtgtgtacctgtaatcccagctacctgggaagttgaggtgggaggatcatttgagtgtgggaggcggaggttgcagtgagccgagattacaccactgcactccatactgggcaacagtgccagatcctgtctcaaaaaaaaactttgtttttatcactggttttatgcaatttgttgataatctgccttagtgcctttttttatttgtattttaatttgcttgagattctttgagcttcttatatctatgggcttatagtttacataacatttgaaaattttttgggctttatttctttagggtatttttcttctccatttgtctcttctctcctttgaagggctccagttacatgtatgttagacccctttatattgtcccacatgtcattaagcttctgtattttaattttatacttttcatgcattgtctaatctgtttagttcatccagtgactttttcatttgagataatatatttttttaattctagaagctccattttgttcctatttatttttttgtatttcttttctcattatgtccatgctttcttttaaatctttgagcatattcataagctattttgaaattcctgccttgtaatgcctacatagctatcatttataggtctatttgtattgactagtttttcttttggttatattttacaatttgctgctttcttcattagactatatctagaatagccattattttagtgccaaatttagctccactacttaggtgtgaattatccttagcatttcagtgaggtctctctactgtgtctggttagaactgcagtatctccctgctctttttgaccagcctcatggagtttcaagttatgcaaggacaaattattattaaagtattgttgggactttttttatacctcagtcccttcttttcagtaccctctcctgaacattccatctccctcatcctccccaaaccataatctctgttttctctactcagtgacactgcatgcactgctttgcttcccctccctgtgctgcatactggaaattgcttccaggaagaagccaggctctcatttggtactcattccattcatttccctttccataggaatcacaatcttttactgcctattgtctcagtgcctgataatatttgtttcatacatcttattcaattttctagttcagtgggtaaagaaagtcctattccaattaaatttgcatgattagaagctctttttttcccttcaaaatctttatttgcatttctttttttttattattatactttaagttctagggtacatgtgcacaacgtgcaggtttgtaacatatgtatacatgtgccatgttggtgtgctgcacccattaactcgtcatttacattaggtatatctcctaatgctatccctcccccctccctccacccaacgacaggccccggtgtgtgatgttccccaccctgtgtccaagtgttttcattgttgaattcccacctatgagagaacatgcagtgtttggttttttgtccttgcgatagtttgctgagaatgatggtttccagcttcatccatgtccctacaaaggacatgaactcatcattttttatggctgcatagtattccatggtgtatatgtgtcacattttcttaatccagtctatcatggatggacatttgggttggttccaagtctttgctattgtgaatagtgccgcaataaacatacttgtgcatgtgtctttatagcagcatgatgtttaatcctttaggtatatacccagtaatgggatggttgggtcaaatggtatttctagttctagatccttgaggaatcgccacactgacttccacaatggttgaactagtttacactcccaccaacagtgtaaaagtgttcctatttctccacatcctctccagcacctgttgtttgctgacattttaatgattgccattctaactggtgtgagatggtatctcattgtggttttgatttgcatttctctgatggccagtgatgatgagcattttttcatgtgtcttttggctgcataaatgtcttcttttgaggagtgtctgttcatatccttcacccactttttgatggggttgtttgtttttttcttgtaaatttgtttgagttatttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcatttgttgccatggcttttggtgttttggacatgaagtccttgcccatgcctatgtcctgaatggtattgcctaggttttcttctagggtttttatggttttaggtctaatatttaagtctttaatccaccttgaattaatttttatataaggtgtaaggaagggatccagtttcagctttctacatatggctagccagttttcccagcaccatttattaaatagggaatactttccctatttcttgtttttgtcaggtttgtcaaagatcagatggttgtagatgtgtggtattatttctgagggctctgttctgttccattggtctatatctctgttttggtgccagtaccttgctgttttggttactgtagccttgtattatagcttgaagtcaggtagtgtgatgcctccagctttgttctttttgcttaggtttgacttggcaatacgggctcttttttggttccatatgaactttaaagtagttttttccaatttcgtgaagaaagtcattggtagcttgatggggatgccattgaatctataaattaccttgggcagtatggccattttcacgatattgattcttcctatccatgagcatggaatgttcttccatttgtttgtgtcctcttttatttccttgagcagtggtttgtagttctccttgaagaggtccttcacatcctttgtaagttggattcctaggtattttattctctttgaagtaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctaaacatacaatcatgtcatctgcaaacagggacaatttgacttcctcttttcctaattggttaccctttatttctttctcctgcctgattaccctggccagaacttccaacactatgttgaataggtgtggtgagagagggcatccctgtcttgtgccagttttcacagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtttatatgatggattacatttattgatttggatatgttgaaccagccttgcatcccagggatgaagcccacttgatcatggtggataagctttttgatgtgctgctggattcggtttgccagcattttattgaggatttttgcatcgatgttcatcagggatattggtctagaattcccttttttttgttgtgcctctgccagcctttggtatcaggatgatgctggcctcataaaatgagttaggaaggatttcctctttttctattgattggaatagtttcagaagaaatggtaccagttcctccttgtacctctggtagaattcggctgtgaatctgtcgggtcctggactttttttggttggtaggctattaattattgcctcaatttcagagcctgttattggtctattcagggattcaacttcttcctggtttagtcttgggagggtgtatgtgtccaggaatttatccatttcttctagattctctagtttatttgcatagaggtgtttatagtattctctgatggtagtttgtatttctgtgggattggtggtgatatcccctttatcattttttattgcgtctatttgattcttctctcttttcttctttattagtcttgctagcagtgtatcaattttgttgatcttttcaaaaaaccagctcctggattcattgattttttgaagggttttttatgtctctatttcctttagttctgctctgatcttagttattttttgccttctgctagcttttgaatgtgtttgctcttacttctctagttcttttaattgtgatattagggtgtcaattttagatctctcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtcattcaggagcaggttgttcagtttccgtgtagttgagcggttttgagtgagtttcttaatcctgaattctagtttgattgcactgtggtctgagagacagtttgttataatttctgttcttttacatttgctgagaagtggtttacttccccttccaactatgtggtcagttttggaataaatgcaatgtggtgctgagaagaatgtatattctgttgatttggggtggagagttctgtagatgtctactaggtccgcttggtgcagagctgagttcaattcctggatatccttgttaactttctgtctcgtttatctgtctaatgttgacagtggggtgttaaagtctcccattattattgtgtgggagtctaagtctctttgtaggtctctaaggacttgctttatgaatctgggtgctcctgtattgggtgcatatatatttagggtagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgtgtctcctgaatacagcacactgatgggtcttgactctttatccaatttgccagtctgtgtcttttaattggagcgtttagcccatttacatttaaggttaatattgttatgaatgaatgatcctgtcattatgatgttagctggttattttgcttgttagttgctgcaatttcttcctagcatcgatggtctttacaatttggcatgtttttgcagtggctggtatcagtttttcctttctatatttagtgcttccttcaggagctcttgtagggcaggcctggtggtgacaaaatctctcagcatttgcttgtctgcaaaggattttatttctctttcacttatgaagcttagtttggctggatatgaaattccgggttgaaaattcttttctttaagaatgttgaatattggcccccactctcttctggcttgtagagtttctgctgagagatctgctgctagtctgatgggcttccctttgtgggtaacctgacctttctctctggctgcccttagcattttttccttcaactttggtgaatctgacagttatgtatcttggagttgctcttcgcgaggagtatctttgtggtggtctctgtatttcctgaatttgaatgttggcctgccttgctaggttggggaagttctcctggataatatcctgcagagtgttttccaacttggttccactctccccatcactttcaggtacaccaatcagacgtagatttggtcttttcacatagtcccatatttcttgaaggctttgttcgtttctttttactcttttttctctaaacttctcttctcgcttcatttcattcatttgatcttcagtcactgataccctttcttccagttgatcaaatcggctactgaagcttgtgcatttgtcacgtagttctcgtgccatgattttcagctccatcaggtcatttaaggacttttctacattagttattctagttagccattcgtctcatcttttttcaaggtttttagcttctttgcgatgggttcaaacttcctcctttagctcagagaagtttaatcatccgaagccttcttctctcaactcgtcaaagtcattctctgtccagctttgttccgttgctggcaaggagctgcgttcctttggagggggagaggcactctgatttttagaattttcagcttttctgctctgttttttccctatctttgtggttttatctacctttggtctttgatcatggtgacgtacagatggggttttggtgtggatgtcctttctgtttgttagttttccttctaacagtcaggaccctcagctgcaggtctgttggagtttgctggaggtccactccagatcctgtttgcctgagtatcagctgcggaggctgcagaacagcgaatattgctgaacagcaaatgttgctgcctgatcgttcctctggaagcttcgtctcagaggggtacccagccatgtgagatgtcagtctgcccttgccggggggtgcctcccagttaggctacttgggggtcagggacccacttgaggaggcagtctgtccgttctcagatctaaaactccatgctgggagaaccactactgtcttccaggctgtcagtcagggacatttaagtctgcagaggtttctgctgcctttcgtttgtctataccctgcccccagaggtggagtctacagaggcaggaaggcctccttgagctgcggtgggctccacccagtttgagcttcctggccgctttgtttacctacttaagcctcagcaatggcgggcacccctcccccagccttgctgccgccttgcagttcgatctcagactgctgtgctagcaaggagtgaggctccgtgggtgtgggaccctctgagccaggcacaggatataatctcctggtgtgctgtttgctaagaccattggaaaagcacagtatcagggtggagcgcagtatcagggtgagagtgacgcgattttccagatgccatctgtcacagcttcccttggctaggaaagggaattccctgaacccttgcacttcccgggtgaggcgatgtctcgccctgctttggctcacactcggtgggctgcacccactgtcctgcacccactgtccgacaagccccagtgagatgaacccggtacctcagttggaaatgcagaaatcacccgtcttctgcgtcgctcacgctgggagctgtggactggagctgttcctattcagccatcttggaactgcccccctagaagctcttatcgtgagttttaatgtgattttaaagaatcttaattctaatgatattactttcaaatagagacagactattacagagttttatctaacaaagctaacatttatttagcatttcagtgatgtgagacgccttgctaagaggtgtctcagttcccattataatcctattataaaggtgccatgttatgcctattttacagaaaggaggactgcagcttgaaaacagttaagtgacttgttcaagctcacatatcagtcgagtaaatggcaaaacctagattcaaactcaatcttgtcaaactgccaaggccttgcttatcatcaccatgtgctatggtttggatgtccctgccaaaactcatgttgaaatttaattgccgttgtaacagtattgggtgctggatcctttaagaggtgattggcctggcacgatggctcacacctgtaatcctggcactttgggaagccgaggcagatggatcacctgaggtcaggagttcgagaccagcctggacaacatggtgaaacccatctctaccaaaaatacaaaaattaactgggcatggtggcagacacctgtaatcccagctacttgggaggctgaggcaggagaatcgcttgaacctgggagatggaggttgcagtgagctgagatcatgccactgcactccagcctgggtgataagagtgaaactccgtctcaaataaataaataaatacatacatacataaagaagtgattaggtcatgaggaatcctccgtcatgaatggatttatgttgttatcgcgagagtgggctagttattgctggagtgggctcctgataaaagaatgagcttgggcccattttctctctatgtcttgtgcttggttgcccttctgcaatgggacgaaccttaccagatgctcatgccatgctcttgaactcctcagcctccacaacagtgagccagataaacctgttgtttataaatttcccagtctgtgggtttctgttataacagcagaaaacagactatgataccatagtatgctgctttgaagtgggtgagcagctgggacaattaaggaatcagcttcagtactaagtgtctgggatgcaatgctttgggggccattttcaggttttgtacagcagtctttcttgggtcacattttcactgctctttacttcaaatggtcaagtcagacatcttttaagcaacatttatgggtaggttctgatggcatcttccttatatctgcatatgattggaaatctaagagcatttgggaaccttgtcactgaccatctttttttattgtaactctacattaaagtggggtgttttttgttgttgttgttgttgttgtttgagaatgataaggtaccatgggagcagaattacattactggaaaagtggtggctaggtttataaaagcaaaacagtcaatgatgttctcagtctcaaattatttcaaaataaaaagatttttaagaaaaatttacctaaaataattagtctcttttcagtttagccaccagcttcctatattcttagattgttttattttgatttttgggggttttttattgtgatttaattttttataatcatgtaaaacatttacgtggttccaaaggcaaactataaaagaaaatattttcaaagaagtatgttttctatccctgttcccaccctccttcataagtaatcattttcattagctttcagtttatactcattgtctttgctttaaaattgtaaatattgtagctgtgtgtgtttttacatacacatacatacacacacatttccctcttccttggataaaaggtggcatattctacacactattctacatcttcttgttttattaagtcgtagatactctggagttcactcaatagcatggtattaagattgtccttttttctttttaaagctccaggatattccactggatttaaatttttcaaaatctcatttgataaacatttattgtctactgtgtgtgtcatctgtcacgggtagtgcatagcattgtagggcaaacagaaatgaacaacatatagtcttcaccctcaagaaacttacagaattttaaaatacttttacaaatgtgtacctctcacagtagctgatccagtaacaattatttttatttttacccatctcctttttagagaacagagtaaaaatttttttgccatctattgtttctgttatatttaatgtcatttcagtagtatttataagcagtctaggaacacgtcccaacatttaaaatacttagatatatgattgtaaagtgtgaggcagagaagtacatcatatgaatgtatgctatttctaaatacttgctattaattttagtcactctaaagtcagaatataccagacagtccaaattactgtaattataccatccttttaaaaacttggcacctctttattcccaatattactccaaccattatcattataacaggttcctgttctgtacctcactcacatctgtactcttctccaatatttcttatttctttaatgtctgtacctcataagatgctgaacttttctttgaagacttaggcattggggctgtgggggtactagcctagacttattgaaagcagctcacctatggtactttgtcacgggagtgggtatatctgtgctaggtattgtccttcctatctctttgttggctcttaggggcactccgtctctcagggtcctgagtctgactttgcatctttgaatatggtgtctctccttaaagtcatcttggttacaccttgggtttaccttttctttgcctgtcctccagtagtggccctgaagcctatccatgttatcatttggctactcctggctcttccatcctggagctgttaacctagttgctcttgaactctgcatataaggcccccttccctttctctttcccctttccccagttgctctctaggttttctaatttctttcctgacactatgtatggctttagtcaagcgtaacccttgtccctaaatccacaaatataaagctaagacatgttacttgtctagttttcttagagaaggaaacttctcaggtctttgtatgcttcctcatacaattgtaggttgcagtaaggttaaatggctgaaaagcggtgaaggaacatgttcaagaagtttcatatgatttcactacatgaatgtagatgtggtaatctagcacctactgtactacttaaagcatttcctacagtgaaggcttctgagaaaataaatactattcctgaagtagtctcacaaaaaaaccttttttaattcagaaaattgattccaggttcactaagtcagcattttctctcatcaggcattgcaactaatgacattaatgagagccatgccatattttttaaaacaaaggataaaaagggcaaaactgagaattttaaaagggagttgtttccagtagtctgtttgaacattgtaattaaccaagaaataaaacaagaaaaggccattttaattgtgttttttagtactccattaacagtgcatcaagctccttatgaattgagacagtataaaatgagtgcttacgttaaagtaggaaagccatcagtctgcggtacagagcattgtatttattagagtatcccagacctgaatgagtattaccaccattaggtaatgcttaagtgtctattttaacaaaaggcatttttttttgttattatagagaacaaacactaaattgactaaataaatgaagtttaaacaagaaataaaacagctagaatttgcttgcttttgttggtggtgatatgctcttgtagccccagcaaattacatcagcattgttaccctcgacagggagctttataatttgtagcatgtaaaataacccttcccaaaaaagaagagagccaggacctgtgttgaactacttacaaagcaagcatgtccctggtgtcaccttagtagttttagtgagaaagatgggatttctaaggacagtagttcacagttgtgctctctctgttttctgtctttcatgctttaaggtttttttgctctcttattttaatgtgtgtgtctctatgtatgggcatgtaaataaatatgcagatggtggcacctatgtaagaaaatgtttgaacacagccccaatttcagagctcaatatggcatggggaattcttgggagaatgtgacctattgagggttggttggttgtttgtttttaagatggaatctccctctgtcacccaggctggagtgcagtggtgtgatcttggctcactgcagcctccgcctcccgggttcaagcagttatcatgcctcagcttcccgagcagctgggaccacaggcgcccgccaccacacctggctaatttttgtatctttagtagagacagggtttcaccatgttggccaggctggtctcgtactcctgacctcaaatgatccacccacctcagcctcccaaagtgctaggattgtgggcatgagtcaccgcgcctggccaattatcataaatatatgctttttagtggaccatatagaaagttctattctggttctttatatggttgggttttacttttatctaagtaatgtaagcacatggttttaaaagtcaaatcatgctacttctaacaacaaaaaagcagtgtctctcctaatttgttccaactccaccactttaagcatttttgctgtttcttctgtaaccagcaacatatattactatttcttgatttcatagtttcagatatcatcagttattgcctttttgctatgaaagatgtagctgttttatgttgctaccctcccaccccacttcctggtccctacttactttcccttccccatttttataatattcatatttcagttattcatataatatgattgtatttcttgtgtaatttattgttatatctggggtgaatcattgactcatttctttgattgcttagttttttgttgttgttgtttttgagacagtctcgctctgtcacccaggctggagtgcaatggcgtgatcttggctcactgcagcctccacctcctgggttcaagcaattctcctgcctcggcttcccaagtagctgggattgcaagagcgtgccaccacacctggctaattttttttaatatttttagtagagatggcgtttcactatgttggccacgctggtctcaaactcctgacctcatgatgtgcccacctcggcctcccaaggtgctgggattacaagcgtgagccaccgtgcccagcccgattgcttgttattttatgtattattgctaatttatccctaggctgtcccactaaactgtgtaactttcctcggtacattcaaccccattggataatttatcacattcattgtttttcttggtgacagagggccccctgcctgtgagcctttcatctgtttcattgtaagttggttgctgtcctggcctgctgggctcgtcatgagaattccttttgcctttcatctgtgctagagtctttgttccctaggtttcttgtttttttgcttttttggtttttttggcttccttcttcattttgataaagtatgccctctagtaactttctgagaagaggtgcttttttgagatacctgaaaatgtctttatattactctacaatttgatagtttggctgggtgtagaattctaggtgacaattttgaaaatatatagcatatgggtgaaagtttatatgatgcaacgagactacttaggttcatatcacacttaaccagctgtgtgtgacatgggcacatcacataacccttctgtgcttaagttttctcatctaaaaatcaggcataatatcttacctgcccttacagttattgagaggattgattgaataatgtatgtaaagcacttagggcagtgcctggccgtttttctcccaaagctttaatgatattctctttaccccagtgccctaaaattttacaatgatgtgctttactgtgggcctttttaaaagtcgttatactgattgcttagaaatatttttaaatctggaaactcattgttctttagtttagaaattctttaaaatatttcttagataacatccttttctccagtttctttgttcttcttttcaggagttgctgtgattcaaataacataagggcttataaggtagggcttcatctctaaccttttctttcctgttcctctttctttatctttttgctctactttgagagatttcttcaacttgatcttctaacccttctgtttgagtctcgtggtttagctctcattttttattttcaaggacttttttctgaatgtttttcttttaaactattatatagtttcatactcttgtcttcataggtttcatattcttatctatctcaaagtagtatatttttgaaattttctttgccttatacagggaacagtttcctcagaaaaatattaagagggaagtgttaaataggtgcctgggaacactctgtatatgggtaaattcattatcagtgatcagacaaagactaggccattttttgagcgccttatggatatccgttatctgtagatcttttgttcttaagcaggtcagtttgacagaagaatcttctgatcttctgccttgggctaagggtatgtgtattagggggagaaagggtacgtaggggcatttaagtctgactgcagtggttctgagagataaaggctgagggtctttattttaacatgtttaatacatggaactttccagttaatcctcttgtttgagtacagcacttcagtttgacgtgagctaggggtctggtgtccaaagtctccaaaaagtggggtaaggataatttgcttggccaaagatatccaaggtcatactgcatacctataaaggttcagccagtcctcctgttatctgctccaccatgcaaccctgccctcaaagatacctggtgcttcctattgctaaacctttcttagggacattttgacaggcatatcagcgtgcttcttactggctcgccttattgaaagcttgtgttcaggttctacagaaagcttgtgttcaggttctacaaaaagatgtcaagaagggatttgatgtgcaagaaatttattgagagtgaaaatgaatggtagggagctggaggaggctgggacagccatcacaggtcatgcaggtctgaccccgttggaggaaaaagggaagaaaaagaggaggattgggtggggaaattatttgaccaaggtgcagtttcaaggatgttttggcaaggcgtattgggagtccttgagccaaagttgaccatcagagacccatatctcacaggaattagcctgcttaagtattcctgctgctcttagtcaccagctgagagtatttataatagctgctttgaagtcttttctgctaattccaacatctgggctccctcaaaggcagtttctattttctgcttttttttcccctcctttgtaaaggtcacacttttctgcattttgcatgtctcctaacactttgttatagcaactgtggatactgacaccttcctccactccagggttattcttttttagttacttgctggactagttcagtgcaacctctgatgtccctcttcaggacaggtgtggtccttatccatgcatttctctgctacctctattggtgttaaacttaaccaatcgatagctgattgctcccttctttttgacaatgccttgtggtataaattgctccatagtctgatccaattaaaattgggtcccttcatggatgaaattggaaatcatcattctcagtaaactatcgcaaggacaaaaaaccaaacaccgcatgttctcactcataggtgggaattgaacagtgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaagaaaagaaaagaaaaaataaaaataaataaaaataaaataacattgagtcccttgtcagggacaagtttttctagtctttgagacttgctatacccttccctgagcagaatctctgcactatagagtaggagctggggaaaatggggaactcactcctcattggctgttccacccagatcctccctctgaagcagggtttttgtgttgccgggaaggaggaggtatgaactgtgcctccttttgcctctgctgctactcagtgtggatcttccacagctcaaaaccagggagtatgatatctgtcagtgttcaccaggtgctgaaagtactcagaatagttctttcaccctaggaagttgaaggagatgggagctgccactcagctgccaaacacatctctgtagctctcttgacaacacagagctgtgtgggcaggggggactacactgtttaccagcttcctcacctgattcctctgtttttagctggagttcaggggagagaaatggctgctgccatcagcttctgccgcttgctctatataggccttccacagcatggagccgtggaaaatgggatctgccaatgtttactagctgccaaatccaccccgagtagctcttccatctcaaggggcggatctgcccttagctgctgaactccttaaaacagttctttggcaaaacagagctgtggggggacaggtgcagtccctgtgtggtccctatctcgaatgctacagcctcttattgttcttatcgaatttctgtagattctattgaataaatgcttctctatttgttgtaagccctttgatcagtctccagggactttgaatgattgtgatttttgaccagctaaatatatgtctctccaggggagagatatccctgagctcctttatacagccattccagaagtcccacctagtcattgtgggggttttctgggttttttctgagacagagtcttgctctgtctcccaggctggagtgcagtggtgtgatctcagctcactgcaaccggctcactgcctcccgggttcaagcgagtcccctgcctcagcctcctgagtagctgggattacaggcgcacgccaccacacccagctaatttttatacttttagtagagacagggttttaccatgttggccagggtggttttgaactcctggcctcaagtgatctgcccacctcagcctcccaaagtgctgggattacaggcgtgagccactgcacctggctgtcattgtgtttttaatgattctgtcttaatagaaaactagttttacacaaatataatcaagtgacttaaattgaaaggactaagattgaaaactgaattgaaattgaaaattgaattgaaattgaaacctaagatttttttgaaaggtatgattttattacggaaatttgcttgattgagctttattttaatcaagactttgtatttccatttttagaattaattcagagaaatagctaacctataaagttcatcttcagaattgagtcattgtagacctaagaagcaatatagcagagttattaagagcataggttctggggccagactacctaggttccagtctttgctttgcagcttattggttctacctgggttccaatctttgctttgcagcttgttagttctttttatttttatttttgagacagtcttgctctgtcacctaggctggagtgcagtggcatgatctcagctcactgcaccctctgcctcccaggttcaagcaattcttctgcctcagcctcccaagtagctgggattacaggcatgtgctaccacacccagctgatttttatattattagtggagacggggtttcaccatgttgtccaggctagtctcagattcctgacctcaggtgatccacctgccttggcctcccaaagtgctgggattacaggcgtgagccaccgcccctggccgcagcttattagttctgtgaatgagttacttaactgctctctgtctattcatatataacatgagcatcatctgccccttagaattattgcgaggttaaatgggtcaacacatctaaaatagagcctgactcatagtaagtactcagtaaatgttagctgatggttattgttgttagacacattaaaggcaaataatcatctcatctttgtattttattattgagaccaataatattgtctaaagccagagaccttggtgaaacgctgggtgcccagctagctataatatgatctttagttccctctagtggaagaaaattagataggctctttgcataaacatgctgcttttggaattgtgatcatttaacctaataaaattacccctgaataattaaccaaagacaatatccacatacataaatggatttaagaaattgttaaaacttacaatcttaaatattctttccaagtgaaacttttttggggacgtgtaatttataatattaaataatatagtatataaaccatccagtgacataaaaagttaggcatatattacttttgtttaaaacaagtgcattcagtagtagtagtaccttgaagttttccattttaacattcatacccagttatctgcaagtagatggcatttcttggtcattctctgagaagtctttaatcattgtgatatgccacctggagtagatttccttgaagttttggcatttttagtatcctcttccacacagcctatggggtaacagaaagattgctagattgggaatctgagacctgggttcatcttccagttctgctatgaaatatctgtgtgacttcgggcatgtcttactagggcctcattttccttctgagtaaaatttgaggatagagaggagcatgtgatgatgactgtcttgctgtcacttctgtttctaacattctctgattcagtgatacatacactttgatgtgagacaggagatgtataatagatgttgagtctaagttgggtaaatgggtcctgtatgcttgatgttgccttctagcaggattggcaggaatggaaatcaccagcagtggaatgatttggtaaatgccaagatcttgaggcatctatggaggcggttgctagattgcagcagggtatgcctccctcagcttgggagattgttaaagagaactttgaggcaacgtctaagtgggatcttgatgaacaagtaggggtttaccaggcagagaaggaagcacgtggagtatcatacagagggaacaacatttgtcaggggacagagagcagggggccggtgcacaagctgcgggtggttcaggattggggtcagggaggctgaaggaagaagctactggaaaggaatgtataaatgtgtgacttcaaaaaaaaaaaacaagagctaaattgtttgactaagaagccggagagctagcttctatttccagttatactgttaaataggtctgtgaaccctagttaagttgttggacttaaaagattttttggaaggctttcaaagccatgcttagggattataatgtcttgctgtatggaatggagctcagtgaaggttttggaataatataatatctgttttagagtaaaactatgatgacactttaatgagtctaaagagaagaaactagaggcaaagaaacccatttaaagatctttgctgtgatccagtcaagaattgttgagggctgaaactagggtaaccgcagtaagggaaagatagttttgacaggtgttgcagaaatagaatggacaggttttggcagctgcatataggaagtagaggagaagtggtagatggtgtgaagatgactccaagggctgtctggaagattaataattttggtaatcagtaggccacacacatacagctacatgggttctgttttacttttcttaactagtgtccttattattaaacattttgagtgtgtctagtttttttcccaaataaccctatggtcatcttgaggttttttacgaaatatgtgatttcccaaaaaactgtagatgaaaaactgcaaagttaaagtaggcatagaactacactatatatagcagtgtggtttactaatagatgttcacattgctgccttcttggtgtcaaactcggtttgattgacatttgttaaacatagaatgatttccaccaaaaatgatgaaaggaaaagaaaacaaaacttattgtgcatgtgcactctcacatactttattaatcatccaggcctaactacaaccctgtataggagttgttatcttactctttctattttacaaatgaggaaacagatgttctaaggttatgcagctactaagtgatgaagacaggaaagacaggtcttttgactacaagtctattgccctatctattatatcataactgcctgccagcagaatgtgttagtgcttaaaaggatagatgccagatctgtggaagtagggtgaccagtcatcttggtttgcctgggaatgagggtgggttctcagaacccaggactttcaacctggaaagatcctcggtgccacaactgagaaagttccaggcaaaccaggacaggttggtaccctgtccagaaaagtcacttatatgaaataaaccattatctagaatgacttaaataaggtatttactgtatttctttcccataatattgtgtcatcaatgctaaatgacaaatgattcctaagtgaagaggagttaaggccccgccttccttccatctgtttgttttcactggctctgagcatcctgccttgctgcagttacactcaactgtgtgtgaatcagatactagatgcctttgcttctaagtcagttttattttattttttatttttatttatttatttgtttatttttagacaggatctcactctgtctcccaggctggagtgcagtggcatgatcttggctgactgcaacctccacctctcgggctcaggtgatcctcccaccccagcctcctgagtagctgggactacaggcacacgtcaccgcacccagctaatttttgtattttttgtaggaacagggtttcaccatgttgcccaatctggtcccaaactcctgggctgaagcgatccacctgcctcagcctcccaaagtgctagtagaattacaggcacgagctaccgtgcctcgtctctaagtcagtttttaaggaaacttatgctttgcccattccaaatttgatgaaatggcaaaagagctattcagggaaaaatcaaggagggctgtcagtatctgtgatttcaaagtatttatcaaaacaattaactcatttttcttggtcctttttcaaataagtatcacatattggtagttatttctttacgataaatttgttttatactatttttatgagactttgttgacaaaaggattctgtagctggatggggaaacccatattattaaaagaaaaaaaaacctcagataatcatttcactatgccgtacagaatttttacctcattcattttttacatattgaaacagaccacaaattgctttctgggaaaagttttggccctgctgtcagtatttcctgggctggccccatcctggaagaagatttgggggagaaatgggtggtaaggaaatctatcctgtcaacgtgtccttgttgagctcctcagctatcagttaataaatatagaaagtaaattatagataacacaattatgaaagtataaagcacaggtatgtgaagaacattttttttctttgacatattagttgaattcccattttatttcagtaacttctcgtttgctttttaaattttattgaagaacgtgtatgcacaataaaatgtacccatctaattgtacacttcagtgagttttgacaaatgtatgcattctgtcatcccacaaagttccttcgggctctaacatgtatgatttttaagactttaatattgaaaagtaattgagttataaactgatatttctctaattttcttgtataaagtaaggaataccatgttgaaataggtgtctggtttttctaatagtcaaatgccctgatcttcccccctttggtttacatttcccaaaatgaaaagcaacagagcaattgcaccttttagacaaacttagagcattgtatttctatttttgtcatatacaaatttgttacacttatcagaactgaaaactctttgggaaatatattaacaaaaccccattaatttgtaaatgcttaatgcagctaagattgatttctaattaatacacatttgcctatttaagaaaattttcacatcagtcaaacactgaattaatggtatgctgcttcctttctttattcacctgatgatgatatttggggccataggaattttttttcaatgggcaagaattcaaagaaattagaaggtgcttggatttctgtttgtgtgtgtgaaaaaagacaacaaaatgtatagagctagtagtgaaacatgtaaaaaagaatcaaagaaattatgagtttgcagttgacccagatttctatggtggcctgtctaggcctctactcttcactagctgaggtcaactttcctgaaggtcaatgaggaagatagcctcattaaagccaacctgacctgtgttgttgccaaaggcagctgggatctttattcttcaacttgattatgagataaaggtagaacccagcagcagaaattgactttgctactataatccttccaaggttctgcttggattcctttcttaaagtatcatttggtcattcatttcagtacactaaggaaaaatatgttgagtcaataatgactttcatttacttattttgttattaatatttattgaaatgaacacattagtacttgtcctagttctttctatgactagattagaatattctttattttgattttgagtccaggtcagctcttagcgaattttgtttaactgttgaatttctaacacaacctagacattgtttggaaatgaatgagaatacttgtatatttgttaggaaaagcgcagtatctagtttctgactatcactagttacaatgcagctgaaataagccggttctgtaacagtcttgatagcctgtcattcaagtcagtattaccatattagcactattgtgtgattggatcttaggatatataaaaactatgcagacccaggaggcactgtggtgtgatgtaaagagcaaagggctttggttattagtcctgcttcctccacttactagctgtgtgatttatatcattgagccctggacctcagtttctacctctgtaaaatggggagatatatgtgcatatatatgtatgtgtatatgtacatgtatgtcatgcagggttattacagtaacaaatgaggacttatagaggggcactttaaagtctcagagtttgcattagattaacaatagtgaagaaattccagatttagttattaaatgatggatttgggttattaaaagaagctataggatttccttctgtgaaagtattttttaaaaacacatctgtttgaatttagattctttttggaatgactgacattataaatatctgtaagaattacagaactcacaatcaggagaggataagaattaaagcaagtcaacttatctagagtggcaccattccaatttggtagacactagccacatgcagttattgagcacttaaaatgtggccagaccaaattgagatttgctataagtgtaaaaatacatgctagatctcagagataatagtacaaaaaaagtaacttattttattaattttagtatgattatatgttgaaataatactttgtatacattgaattggataaaatatgttatcaaaatgaattttacctgtttctttttacttttttaatgtggctactggaaaatttaaaattatatgcatggcttacattatacttaaattggatggtgttgatcaaaatctttattgagctaggtgcagtggctcacacctgtaatcctaacactttggaagtccaaggcaggaagattgattgaggccaggaattcgagatcaacccgggcaacatagcgagactctgtctctataaactatttaaaaattagctgggcatggtggcacgtgcctgtagcccagctgctcaggaggctgaggtgggagcatcccttgagcccaggagttcaaggttacagtgagctatgatcacaccactgcactccagcctgagcaacagaatgagaccctagctcaaaaaaaaaaaaaaaaaaatccttattgaatgctctcgagcaaacgaaatcttaaatttagatcttttaagttcagatacagatagaatgaaaagttctcctagttcttcaagaaaaatagtagtaaaataatactttacaggaaaatcatttttaaaacagaccacttgaaccagcttccctaactttcccttacttgaccagtctgataggcagaccctggtgggatacttgctttactattgttggagagcccaaactttttaggaaaataatagtcattctaatgccatatggcaggttgatttcatttaagtttctaatttgggttagaaaattaaatattgctacctgtattactagttccccttttaaagggaaataaattgataaaataaatataggcatatagttaaatgtaaggacactaaacacagaaatagattagtttaaaatatttttaaaatttcctgagaaattacaaaaaagaaagtacaacttagccataaaaaggaacaaaataatgccattcacagcaagctggatggagttggagaccattattctttttttttttttttaatctgagatggagtctccctttgttgccctggctggaatgcagtggcgtgatctcggctcactgcaacctccgcctcccaggttcaagcaattctcctgtctcagcctcccgagtagctgggactacaggtgcacgtcactacacccggctaatttttgtatttttagtagagacggggtttcaccatattggtcaggctggtcttgaactcctaacctcaggtgatccacctgcctcagcctcccaaagtgctgggattacaggtgtgagccactgcacccagctggagaccattattctaagtgaagtaactcaggaatggaaaaccaaacattgtatattctcactagtatgtcagagctgagctatggggacgcaaaggcataagaatgacacgatggactttgggggaagggtgggaggggaggtgagggataaagactacacattgggtacagtgtacactgcttgggtgacgggtgcaccagaatctcagaaatcaccactaaagaacttttccatgtaactaaacaccacccgttccacaaaagctattgaaattaaaataaaaaatgtactcattaaaaaaaaagaaagtacaaaggagagtgaagagaggtaccagttactagtctgtaaacaaaacaatacttcaaaatagagatggtaaccctgggtcatgtcattcccaggtacattttgtgctaacatctgtaagcagtcagataatcaccactttaaatcatattttcatcacctgctttcaaattccttcctactttgcctctagagttgatttgtaggcaaatagtgtttttagtttgctatatcagcgtggacttaatagcacttaatacatatatctttaattcacattcatatttagaaacaaacattttgagtttaatattcgtggaatctatagttggaatggatatatttgtgtttttaattgtgctatttgagctatttaatttatacttgaattcaggaaaacatgaccacaatttttctagatcattgcccttatcatttgaaatatatttttatgttgctagtttcatactagcaaatcaagtcaaatcagtgttctgactttagttctgaaatgtcagatccggtgacatttaaattgctttgaaggctggccccccagcaattctgcctttattttgagagtgggtaggtgataagagactagaccaaggacttgttcagccatttaccaaatcaaaatgtgaggctcaaatggagccaaatgtgtggcagaaatggagcatccatttctgcttacaaactttcagtataaccaatgtatcacatagcaaatggtgaatgtggagataaaaatacaatttagactgggcacagtggctcatgcctataatcccagcactttgagaggccgaggagggtggatcacttgaggtcaggagttcaagaccagcctggccaacacggtaaaaccccatctccaggtgctaaagttgaacgagctgatggatatgaaccaccagtccaagaatctgtttaaagttcagacttaaaatagtggcaaataaaaagtcctcatttgtgatggtttgcttctgaaagaaaaaaaaaagtctctactaaaaatgcaaaaaattagccaggcatagtggtgcacacctgtaatcccagctattcaggaggctgacgcaggagaatctcttgaacctgggaggtggaggctacagtgagccatgatcacgccactgcactccaacctgggcaacagagcaagactctgtctcaaaaaaggaaaaatacaatttagttacatgaaagaggcaaaatagaaaataagctgaaaataaagagaaaatatcagttttaattgtggcaaacaccaaatctgtttacttcatgactcctgtgtcacaggatagagttaaaatcaggcttttgattagaatagagaggaatggaaagagaaaaacttaagtcgaaaacagaagatatgaaagggtgagttctaataaaaatgggaagctagagataaacataaaaatgagtaataaaaattttaagcttttcctagaattagaaggcagaacactcctggagaggaaaaatctgtgcaggcatgtgattgatgttgtctggctcagcctggccctccagcacacttgttaaaagctttcctcatggttatgacttcccagcacaaaccccacagctgcttcacatcctcccctcctgcggggccttcctaactacttttggagatggaggcatctttcctgtgcctctgatctcttcctttgcagtaaacactgagcccccagccctgccatgctgggctccaaacatccagcttctcattagaatcttaacactgccctctccaactgatttggtagactctgcaggtaccacatcacttgtcactgccccatttcattgactctaagaaagtcatttgtagaagttagcagtcagcttgcagatggtaggacaaaggcaggaccagcaccatattttctgactccagatcctgtaggcttttcctcactgccacttacaaacacacagagtgcttcctttaaaaaaacaaacaagtaaaaccttctcttgaccccgctatttctttcctactgccagattcttctaatatgatcgtgttcaaacccagcatggcattattggaaggactgctgactttggaattgggcaggccagggttcaaaacctaccctcatgatagctgtgtgatcttgaacacgtttctaagcctcagtttctccatctgtaaaatacctacctcacagtgtggttgggacatcaagtgacagtgactatattaagtacttagcccaatgagaggtgtgataattttaactgattattacataattgtctctggcatactgacctcaaccctgactcctccccaaaagttgatcttgctcaggattctcattaccttttctggctgaatcttgtggtcttttctcagctttcagccttctccagctatttacaacttaatttcctctactctcttgattttcttaatattattgattcttcctttccttgtggcttctcttttgtcaaattttctgacttctttttctcattctacccttatgtaagtcaatcttctaaggttccatctacgatcattgctctgttgacaagactaagttgaattaataaatcagaaaggagataatattatctattttactttctgcagtacatccttagccttggttcttccttacctgtctcccttcgactttctaatataaaaatgtcacattggattttaagtcatcagcaaacgggtaaagccccagtgctattagcactggatggctttcattattctattccatgtagacatggcaagcgatttccatgcccaaactgttttgtatgatgatgatgatgatattaacaactttgttttccaaatagtattatagagtttacacagtagtcctacatacattatttggatttgttcttcaaagtaacattgtgaggtaggtagagtttggaattatccaacactttttttttttttttttttttgagacagagtttcactctttgttgcccaggctggagtgcaatgacgcgatcccggctcactgcaacttctgcctcccgagttcaagtgattctcctgcctcagcctcccgagtagcagggattacaggtgcccgccaccatgcccggctaattttttacatttttagtagagatgtgatttcgccatgttggccaggcttgtctcaaactcctgacctgaagtgatccacctgtctcggcctcccaaagtgctgagattacaggtgcgagccaccacgcctggccccagcacattttataaatgatattttaaaaattctgactttgactctaggaatagtgccttttctgtttaaaccatactattttttgttccctattccgtataacttccctgataggtctataaatgctagattttaggctaaagaatagacaacatatttttattttatttagggaaaactaagaaaaagaggtaaaaatcaaaacagtaaattgagttattagtttattagcagatcaaggaagagttacaaatttggaggctaagattttattagaagagttggggaaagtatttgtggtttgtttttttttttttttttgcttttggggaaagtattaagaaatgtgtactttttttattaaaagctcactctatactgtatatagatttaagcttgcaaaaaatatgaaaagctatagtcaaagattttaaagggtaaaaagttaagctaagtttaaatgggggatttcatctctctagttagagaagtatccatgttaccatagatcacatccattcattcatcattcactctaattgtcttttgttcctacctaatgaagtatgctgtatgtttgttttacagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaagtaacgacagacttagttcctcttttgatataatcaccatatggcatataagggcaattttatagatcacagtgtatcttgatttcaataagtcacttgatatgtctgtcgcagactttttgttggtaagatggagaattgtgagctaaggatagtacaactgggtcatccagctctggtcggatgattgtgtccaaagagattatataaagctttataggacagcatcctacagggttttatctttgatcctattctgttcaaaattgtaatcaggccgggagtggtgactcatgcctgtaatctcagtgctttgagagtctgaagcagggaggattgattgaggccaggagttcgagaccagcctgggaaacataccaaaacctatctctatttttttctaaaaaaaaaaaaaaaaggttgtaatcagtgactttgattaggaaaaaaaacagaagatatacttgctaaatattcaaaagataccaaggtcagaggttatattcattacctattgcttcataacaaaatgccccaaaatgtaatggcttaaaacaacatacatttattatcttagtctctgtgcatcaggaatgtgtgttccaacttagcagggtcctctggctctgggtctctcacaaggtgataataaagctgttggccagagctgaagtcattttgaggctccactacaatgtggatctgcttccaagctcactcacatgattgttggcagtcttaccttcctcacaggctactggactgagagccacaattccttaagagctgttggcccaagcctcccttggttccttgtccgttgggcctctccatagagcagcttccagcatggcagctggcttcatcagagcaagcaagaggacaagtgagagtatgagcaagacagaagtcacagtctcgtaacctaatctccaaaattacacaccatcacttctgcagttagaaatgagtcactagatccagcctatacacaagggggatgggattataccagggcctgaatatcaggaggtgaggatcactgggaggcatttcacaagttgccccctacaaagggctagctaacatattggctgtctacatcaaaattcaaaaatatttttacaagtttgtagcaaaggagctgaaacaaagaaggtgaaatttaagaccagttaatgttaactccttcattcaaatatgagtaagtgcaagatcagtgtgaatttagttgtgattatgtgaaaaaagatgtaaacattttagttgttgtttgcaacagcttaaaaagcgctgaatggaaggttatgctacattaattaggagtatatagtattcagaacaaagtcatactcctcccgttcaccctggaccattcatagtaagcaggacactggaatgtctgcagaataggataaccagaatggaaaggagcctgaaaattgtgtcatagagacacagccttcaaaatcttttctggcaaacctgctaaaagaattttgaggccaggcgtggtggctcatgccaataatcccagcaccttgggaggccaaggcaggcggattgcttgagctcaggagttcaagaccagcgtgggcaacatggcgaaaccctgtctctacaaaaaatacaaaaactaggtgggcatggtggcacacgcctgtagtcccagttacttgggaggctgaggttggagaatcacctgagcctgggaagtcaaggctttagtgagccatgattgcaccactgtactctagcctgggcaacagaacaagaccctgcctcaaaaaaaaaaaaaaaaaaaaaagaattttgaaaaacgtatgtaccccttcacatattttttaggttgatatataaaaacttttattgtgagaatataattctcagtatcttgaatattcttttaaatatgttttgtttgtttgtttttttgaacagagtctcactctgtcacccaggctggagtgcagtggcgcaatctcggctcactgcaacctccgccccctgggttcaagcaattctcctgcctcagcctcccgaatagctgggactacaggcacgtgccaccatgcccggctaatttttgtattatttagtagagataggtttcaccaagttggccaggctggtctcgaactcctgaccttgtgatctgcccgcctcggcctcccaaagtgctgggattacaggcatgagccaccacgcccagccttaaatatattttctacacaactgtagaattgcctgtttatctcattcactgtatggaaaatgtctgctatgtgacctacatggcaatgctagtccttattgtcaaatcactcagccaaatcagactcattttctgtcagggaaaaaaaaaatctgacttcatttttcaaacaaaattaaagtgttaaatggacatccctgtgacactcatcttagtattgattttgaattcttaaacagcttaccatgaatatattgcctggataaagtaaggtggaacctccctttttttctcaaactctctttgttttgctttcaaaggtctctccctccctcaggggctgtgcatttcccagccatctctttgaagttaggctttttgggttggaggagtagtttgccttttggatgggtaactggagatgtggagatgggtgattgtagttgtggagatgtaaaagaaaaaccgcagaccacagacttgtttacaaacagacaaaattatggaaaatgaagatatggaaattgattgccttaaaaatatcctagttcatgtgtctcctggaaggactttgggtattcccagagatacccaaatcctaggttgaagaccactggcctagaagagctgttgaaaagactgggaggctttggttatccacgaatgtattcgtttcattattctgctggaagagtccccaaagcagaagcccatagatagaacataatcaatgtccacagttatttgaaagattgtcatatataagactatatgcttattcagtgtggcatcagaggctgtaactagaatcaacaagtggcagacgtcacctctaactaaagaagacctttttgatgattaaacttactccatgaatgaagcagcctgtctcacagactatgtagtttctcactagaagcactcaagttgaagctggatccttccaaggggcctgaagataaggttttaattttggactagagatggcctctaacatcccttctaattttaagatattgtaattcttttgttttttttttttttttgagacagagtcttgctctgttgtccaggctggcgtgcagcggcgcgatcttggctcactgcaacctccgtctcccaggttcaagcgattctcctccctcagcctcccaggcacaggtcaccacgcctggctaatttttgtatttttagtagagacagggtttcaccatgttggccaggctggtctcgaactcctgacctcaggtgatctgcttgcctcggcctcccaaagtgctgggattacaggcatgagccactgtgcccggccaagatattataattcttttaaaattacttatctggtttaattttattctttattcaagaaatatatttctgtctgtatgtttattttctgagaaaactaagaacaagttgggtttgttttttgttgttgttgtttttgtttttaacagtctcactctgtcgcccaggctggagtgcagtggcgccatcttggctcacttcagcctccacctcctgggttcaagcgattctttgcctcagcttcccatgtagctgggactacaggcgcatgccaccacgcctggctaatttttgtattttttgaagagacggtgtttcatcatgttggccaggctggtctcacacccctggcctcaagtgatcaaccctcctcagcctcccaaagttctggaattacaggtgtgagccaccacgcccagcctcctaaaaagcaagttttacatactatataaagtaatgatcacagaaagcaaattttaaaaattcacctaaatttcaccatgtatgctaattgtatcaaaggggacttagtgacagtgtagtagagaaaaaaggatctttggtttcataaaacctgggttaacatcccagctctgtcacttttactaattatgtgaggttggccaagttttataagttccctgagcctcagtttgcttaccttcagaatcttcctaagattatgagaactagatgagaaactgtatgtgacttccctttgtaagtggtgaagtgctttttaactataaagtattatttccagtggctttaacaggatagttttagtccctcattgttgaagtagtctgtgtgggattttatgtaactaattttgtatgttgtgatggaaataattcatggttggctgtatatcgagatgagacctggttaaattggatattttccagtgacctgatcccagtgttaacccaaatcactagaacatggccttatgttttcttttgttttgttttcttttttaacagtgtaattgtggaaaatttcaaatgaaaagagagaatagtataataaaccccagcatactggtcaccaagcttcaatagttatcaaaacattttgccattcctattctgttcctcctgatgtctttttctcccctggagatttctaaagcactataatttcacctataaatactcttgtttgtatttctaacagataaggattttttaaatgatcatattattattatacctaacaaaatcaacaataattccttaatatcatgtcatgatcagttgatactcagttttccctgattgaacatgaattttaactgacagatttctgaatttagaattgttttattagctctagggacctgaaagtagattataaattcagttaaaataacttagttatttctcaaaagggccagaagcaaactagaaatagaaaattgttcttttgtatcattgttttgtaaattcacctcaacaattggccttgcacagttttttgcatcctccttatctcctgggtttcaaacaaaccaaaaatatcgattactctaagatttaaagtcatgtggagcaaaaaacaaagccaatgcacttgtgtatagttccacctactggctaggtgagagattgcttctatagctgctacgtagactaagctactccagaattgccctcatgtttctggcaacagatgtaattacccctggtatttaggggctcattgctcaggttatgggttatctggatcctttttacagtttttgtaacatgacacccatacagtgtagacaatgaaaggcaaaaaaataaaataaaattaggtcagttagttttgttgtttgttggctacttagaagcagcatttatcattttggtggagaaaaggctagacaaaacagcatatttggatcatgagtgagtttcttaatatggtgtccatatctgtctttgccacagactatgtataaccaacactcctttttttcttcctaaactgaagtcatgaaattatatggcccgagaatgttgtttatcatgttagaaaatccttagaactagttgatggctgggctcagtggcttacgcctataatcccagcagtttgggaggccaaggcaggaggatcacctaggggtttgagaccagcctgggcaatagagtgagacctcatctctacgaaaaaattttaaaaattagccaagcatggtggcacacacctgtagtcccagctacttgggaggctgaggtgggagaattacttgagccacagaggcagaaattgcagtgaaccaagatcatgccactgtactccagtgtgggcaacaaagtgagaccctgtctcaaaaataataagccggacttggtggcttacacctgtaatcccagcagtttgggaggctaaggtaggtggatcacttgaggtcaggagtttgagaccagcctggccaacatggcaaaaccccgtctctactaaaaatacaaaaattagccgggtgtggtggcacacacctgtaatcccagctactcgggaggctgaggcaggagaatcacttgaacccagaaagcagaggttgcagtgagccaagatagcaccactgcactccagcctgggttacagagcaagactctgtctctaaaaataaaataataataataataatagttgatatctacttaatcacaaatggtttataagtttaaagcatgcttaaaaacagagactcacaaaaccagaattttagatatggaaaagattagattagtaaatttcaaattttaggttagaaaatccggtataaaacttgttaaacaagcaggtacccaggtcccacctctagacattcacttttgcagatgtgagttctgaccgggcaggtcaagagatgattgacctttaaaatgggggtaatacaacataaaggctatatcatcattgtcccaacacacacagtagttttgtagacatctgcatatatttgcacatccattactttgggattacacttaaatttgaacctgtctgtagcaatttgctgaaacatattttaaatacaggttcagttttgaagacaggctgagttgggttatccccacaagttaaatatttatttctaagtgacacatttgggcttgtctttagtagtatctggtacttgagttaagctgtaaatcctaaattggctggccaaggaattttaattaccttattacagagcgattacatataccacggggagacttttacaataattaaatattgatttaaaacacatccgacatgatgtgtatcttttaaaataatttttttgtatcttttaaattttttatctttaatatttttaccttttatatctttaatttttttgtatattttaaaataatattagcagtttgtgtttttgtagctcacaaaggcgataaactgaaagctctttttttattattatttttttttggtctagtatttatgcctggggaagggagtgtttgtgaaatttatttatactgatagagtggaactgattactacttaccagcaaacttgctgcttaagggaaaatatgtttgtctcataccaagcaataaatatctgtactgtagcattttaatctatttgaagatttgctcatattttcatagctagtcttatataatctattttgattttttctttttatgtgtgatgatataaattgctatttgttctttcagcaaagtaaacatctcttttgactcacagtatcaaaatgtttagttgattttagttttgcaaactgtgtgtcagggatccccaagaccacccccaggcttgatgattcactaagaaaactcaaaggactcagcatatagtcatattcacagctatgatttattatagctaaaggatataaagagaaatcagcaaaaggaaaagatacattagctgaagtccaggggaaaccaggcacaagctttcaagggtctccccagcaatgagttgtgacaacacatgtgaaatggtgccaaccagggaagcttattagagactctgccctgggtttttattgggggctggtcacataggcatcttccacttggcacttaaccaaattccagactcccagaaagaaagcaggtgttcagcctaaatcacattgttagcacaaacagtttagacacagtgagtcagtcttttcagtcaggaatgtagaggaccgtcctgaaatccaagttcccagataaacctctcaagggccaaccttagtaggcctttcaagccttttatgagatagtagtttaggcctgctatattaactcttctgcacaaactaaaatagagataaatagaagaagggttttaaaagagttgatataaactcctggatctgcaaacaaaatataattgactgtaaagataatgacagggtttggagtttggggtttttttttttttctttttaactgtaaatacagtatcatttttatatctgttaaaaaacatttaggtggtcagatttttgtataaaacaaatcctggattgggatgttacagtatagaacagattttaaactttgaatgctatatgagaaaataaactattcagatgctactgtcttagaaatacatttgaaattgtcactccgataacttttcgtctatgacaactaatcttcaagccactaaaataattttgaataaatttgtgtacatataaaatctgaagaaaattcagttaattttctgttatttaaaagaagtatagtttgttcatttaaaaataaaagttattggccaggcacggtggctcacacctgtaatcccagcactttgggaggccaaggcgggcggatcacttgaggtcagaagtttgagactaacctggccaacatggtgaaaccctatcactactaaaaatacaaaaattagccaggcgtggtggcgggcgcctgtaatcctagctactcgggaggctgaggcaggagaatcacttgaacctgggaggcagaggttgcagtgagccgagatcacaccactgcactccagcctgggcaacaagagcgagactcagtcttgaaaaaaaaaaaaattcttagtgtacaacctttgccatatacataacttgtaaaaatttagaaattacagaaaattttgacaaaaaataatgtcttaattttgttataaaaattgtaacagaaataaatgtcattcacaaacattttggaccatttccttctattggaagcattttgctataccattaaatattttttggatacaatattttaatgacttcattaagacatctaaatgtgtgcatgtgccatgtttaataaattccctatagttcaacattaacattgtttttccctattagaaataatttataattaatatcttgtacataattacttgttcacgccccttgattgctttgtttcctcagaatacatttctgaaagtagaataactgggtaaaagagtatatgaatacatacaaatacatacatcatacttagatttaacctttttctcagtacaatgcctcacattttgaaaaatacattcacataaatatacaacttaaagaattattgtagaagtgaacaaccatgtaactataacccaagtcaagaaattttaaaactgccagtacctcaacagcccctgaattcccctttctcatgataatccccttcttctctcagaaataactaatctggacttcacttctgtgctttttatatccctagcatcaaaataggaattctcagaattctcaaataataaagttcactgtcgtctgctaaaatctattttttttttttttttttgagacgatgtctcgctctgtcgcccaggctggagtgcaatgctgtatcagctcactgcaacctccgccccctggattcaagcaattctcgtgcctcagcctcccgagtagctgggactacaggcatgcaccaccacgcccggctgatttttgtatttttagtagagacagggtttcaccatgttggctaggctggtctcaaactcctgacctcaagtgatccgcctgcctctgcctcctaaagtgctgggattacgggcatgagccaccacgcctggcctaaaatctttatttgaatggaatcctacagtatatactctatttttggtctctgagattcatctggttgctttgtgcagctgttcctttattttattgctatgtagtattgcagtgaacaaactcgcactatttattcattttaatgctaatgagtatttgggtgattcccagatttcactattttgtagagcagatccttccacgttgttcttcagccatgttttaagggatgtacttgtctgcatttctcatatacattttagaatgaggttgtcaatttccaccaaaacaaaaaaactattgagatttttgtcttgaattactatatcaaatcttgatagcaatttgagaataattgacatgtttacagtgttgaatcatccaattcgtgaacatagtgtctatcttcccatttatttagctctttgatttcttgcaataaagttttatatgttcctctgtagaggttgtgtacatctgtattagatttatgtattgtcagatttattcttaggtattttgtttttagggtaagtcagtttctctcattctcccttctctttccctttccttgtactaactttgtgttcctattcatcaggcttcattaattccaacaattaatctgtagaatcatttggattttctccatacataatcatatcatctgtgtataaggaggatttgatttgccctttccaacttttttacatcttttcttgcctttattacaatggataaaacattcagggcagtggtgatggcagttatctctgcttatttctgatcttagagtttgctaagcatgaatggatcatgaattttatcaaatgtcttttttctgcatatgcagtcatgcatcctataatgatatttcagtcaacaacagactgcatatacatgggtgctctcataagagtataatggagctgaaaaattcctatcgactagtggtatcatagctgtcataacataatagctcaacacatcactcacgtttgtggtgatgctgctataaacaagcctgtgctagcagtcatataaaagtataacacatacaattatatacagcacacaatacttgataatgataataaataactctgttactggtttatgtatatactatacttttttgttgttttgtttttattttaattttatttattattattataccttaagttttagggtacatgtgcacaatgtgcaggttagttacatatgtatacgtgtgccatgctggtgcgctgcacccactaacttgtcatctagcattaggtgtatctcccagtgctatccctcccccctccccccaccccacaacagtccccagagtgtgatgttccccttcctgtgtccatgtgttctcattgctcaattcccacctgtgagtgagaacatgcggtgtttggttttttatccttgcgatagtttactgagaatgatgatttccagtttcatccatatccctacaaaggacatgaactcatcattttttatggctgcatagtattccatggtgtatatgtgccacattttcttaatccagtctatcattgttggacatttgggttggttccgagtctttgctattgggaatagtgccgcagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcctaccaacagtgtaaaagtgttcctatttctccacatcctctccagcacctgttgtttcctgactttttaatgattgccattctaactggtgtgggatggtatctcattgtggttttgatttgcatttctcggatggccagtgatggtgagcagtttttaatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttggttgccattgcttttggtgttttagacatgaagtccttgcccatgccttgtcctgaatggtaatgcctaggttttcttctagggtttttatggttttaagtctaatgtttaagtctttaacccatcttgaattaatttttgtgtaaggtgtaaggaagggatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagttgggtagcgtgatgcctccagctttgttcttttggcttaggattgacttggcaatgcgggctcttttttggttccatatgaactttaaagtagttttttctaattctgtgaagaaagtcattggtagcttgatggggatggcattgaatctataaattaccttgggcagtatggccattttcacgatattggattcttcctacccatgagcatggaatgttcttccatttgtccttcacgtcccttgtaagttggattcctaagtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcttcttttcctaattgaataccctttatttccttctcctgcctaattgccctggcctacagtatgttttaagctaagtgttattacaggagtcaaaaaggttttaaaattttttaagtttattatataaaaaattatagtaagctaagatttattattgaagaaagaaaaatacttttatataaatttagtgtagcctaagtgtacagtgtctagaaagtctacaatagtagaaagtaatgtcctaggtcttctcattcactcatcacttactgactcacccagagcaagttccatgaatgcaagttcccttcatggtaagtgccctataccagtgtaccattttttatcttttatgctatattttgattgtaccctttctatgtttagatacccaaatatgtattacagttgcctgcagcattcagtagtcacatgctatgtaggtttgtagcctaggtgtgtagtaggatatcccatctaggtttgtgtaagtacactctatgatggttgtacaggaacgaaatcccctaactatgcatttatcagactatatccccatcgttagcaacacatgactatattgaaataattatataataccatccttcaatctattgctgtagtgaattgcattgattcttgggttaaccaaacctggtcatgatttatgatcttcataatcctttttacatattgttgggtttggtttaggctttctgtgtctctcttttttaatttatttttacttttttttttttttttttgagacagggtctcattctgtcatccaggccatagggcagtggcaccatcacagctcactgcagcctcgacctcctgggttcagttattcctcctacctcagcccctttctgagtagctggaaccacaggcgtgccaccatgcctggctaattttgtagagatgaggttttgccatgttgcccaggctggtctcagactcctgggctcaggtgatctgtccgcccagcctcccagagtgttgggattataggtatgaaccactgtggcttcctggttttcatacctagattacacttgcctcataaaatgaattggggaatgttctctcggtttttttgttgttactattgttctattgattgattgattgactgagatggagctttgctcctgtcgcccaggctggagcgcagtggcgcaatatcagctcactgcaacttccgcctcctgggttcaagcaattctcctgcctcagcctcccacatagctggaactacaggtgtgcaccaccacgcctggctaattttttgtatttttagtagagacagggtttcaccatgttaaccaggctggtctcaaactcgttacctcaggtgatccgcccgcctcggcctcctaaagtgctgggactacaggtgtgagccaccacacctggcctctattgttctctttatgtgatttgtagaactcacctctaaatccatccaggccagagttttcaatcttagttcaattccttaaatatttataggaatattcagggtttttattcattactgtgtcacttttagtaaactgtattttgctaagaatgagtgcattttatctaaattttaaacagttttggcataaagttcataataccactgcaggttctgtagtcatgtcttctttttcattcttgatactggtaatttgtgccttctctttttctttctcagccttgccagacatttaccagttttattattcttttcagtgacaacttgtagctttgtaattcttttttttttttttttttttttttttgagacagagtctcactctgttgcccaggctggagtggcgtgatctcggctcactgcaacctccacctcccaggttcaagtgattctcccaccttagcctcccaggtagctgggattacaggtgcctgccaccatgccaggctaatttttgcatttttagtagagacggggtttcaccatgttggccagactggtctcaaactcctgacttcaagtgatccgcctgcctcggcctctcaaagtgctgggattacaggcatgagctaccgcgcctggcctgtaatttctttttattgtgtgttgttttctattttagtaatttctacttgctgttatttccatccttttattttgggtttaattttctgggagctttttcccttttagtttcaacctttttgtatccttgggttttatttgtacctcttgttaaaggcatatagttgtgttttattccagtctctcaatctttgtcttttacttggatcatttagtccatttacatttaattatattttagtatattttgagttttatctatggtcttatgtgttctctatttgcaccacctattccatgtttttttctctcttgatttatttgaatcaaatgaatatttttatcattctattttccctctgttaattttgaagtttaagcactcttttctgttatcttagtgtatatcccagaaattacagtatgcttcgtaacacatcaaattctgatattgataccattattgtcctcctgaacagtgcaagtactgtagaacatgttaattttatataattccttccttgacttttaggctatgtttttcatgtatttaaattatattcgtgtgtataaaaacataaatcccatgtatttatatcatctcctatttcttatattatttgtatcgatttggatttacccacacacttatcctttgtttgttctttattctttcagcatctctaaggttttatctgggttcattttccttgtgtcagtctgctggatgcaaactttccatttttcttagtttcagagttatttcttatatccccttcagtcatgaaggatattcactgggtagagaattctagattggcattttctttccattagatatcattccactatgttctggcatccattgatgtggagaattcagctagcaggggctgtaacttctctgaaggtaatgtcattatttctcaggttattaaaaattatttcatcttttgttttctgtagtttgtgatgtgtcttaagagtgtgcgtatgtgtgtttgaaccttgccttaggttctttgttttttcaatcagtgtattgatattattcatggttttagaaaattctcagccattatttcttcaaatgttgcttctgcccctttatctctttcgtcagctttgtgaccaaattaaatattggtagaggtataccttgtggtattttctatgtcttctaccttcttttctgtattttgcatgtttttttttctccatgctttggtctttttgtttcttctgtcctctcttactggtctctttctcttcagtactgtttaatctgatgttaatctattcactaatttttaaatgttaattatatttttcagttttatgtttctatttcctttttaaaatctactgtattattttttggccgggcatggtggctcacacctgtaatcccagcactttgggaggctgaggcaggcagatcacctgaggtcaggagttcaagaccagcctggccaacatggtgaaatctcgtctctactaaaaatacaaaaaaattagctggacgtggtggcgagcacctgtaatcccagctacttgggaggctgagggcaggagaatcgcttgaacccgggaggtggagtgagccaatcagcctgggcaacaagagcaaaactccatctcaaaaaatagatagatagccagccagccagcctgggtaacaagagcaaaactctgtctcaaaaaacggatggatggatggatggatggatggatggatggatggatggatggataggtaggtaggtaggtagatagatagatagatagatagatagatagatagatagatgatagatagatagattgtattatttttggcttttattctcttgcaaaaaaaaaaaacaagctcagcttttatgttctagggcatagtaagcttcattgtttgataatctgtgctggataatctcagtatatgaagtccctgtgggtttgcttttattgtctgttatttttgctggttattggtcgagatctcttatcccttcatgtaccttattcatttttgtcttgtgctagaaattatgttgaaaattattggcctaagatgatgctttctttctccaaagaggaattttgttgttgttgttgttgttgttgagacagggtcttactctgttgcccagactgaaatgctgtggctcaatcacagctcactgcagcttctacctcctgggctcaagtgatcttcctgcctcagcctcctgagtagctgggatgacaggcacacaccaccacagccacttaattttttttatttttagtacagacatagtctcactgtgtttcccaggctggtcttgaactcctgggctcaaggaatcatcctgcctcctcagagtgctgagattacaggcatgagccactgtgcctggcccaaagaggatttttatttgctgcttctactgcgaaccttcaggcacctagctgtttaagactttcttactcaagatttaaggcttagattttcagtgccacctagatgtaaagccgggttgcaagtctgtgaaggggctgattgcttccagttcacccctagctctttagggcatcagctcagtgctggagagtagagtttatcagattctcttgaattctcactcattttcccttttgagcccaggaattagagaccagcctgggaaatatagtgagacctcatctctaaaaaagtttaaaaattagccaagcatgggggtatgcacctatagtcccagctactcaggagactgaggcgggaggatcacttgggcacaggagatggaggctacaatgagccaagatcatactactgtactccagcctaggcgacagagtgagactctgtctcaaaaaaaaaaaaaaagaaaaagaaaaagaaaagaaaaaagtactttttttttttacttatttagttgtcttcaatgggagacatcatctagtctaccattacaagaagcagaactctagcaatgtatttaaaactcttttaacgtagttttcatattactctccataaagatttaccaatttatattcacacatggtaaataaatgtatctatgtttacattttgataggtcaaaaggatgttttggtttaatttgcatttattttgtcattagtgtggtcaaatattttaaaagtaaatttacccatttcttttgcatctagtcactttcattagttgtttagttttccttagttgttttagttgtaagaattcttttttgtttgtttgtttttgttttttgtttttaatagagatgggctctcccttgcttgcctaggctggttctgaactcctgggctcaagcagtcctcccaccttggcctcccaaagtgcagggattacaggcatgagccaccacacctggcgaagaattctttatttgctaaagatatttacctttttcatgtatttgtaaatattttccccaaatctgcctgttttattttgcttgttgatttttttttaacatgcagaacattaaaattctgtcagaaaattacagataagcaatagggaaggctagaatgaactcttagctactagattagagttgaagacagcagtataatctcatattgaatttattatatgtacacacacgcacacatacacatatacatgtacagatatatacagaaatcataaattatatgtgcatacatgagttagtacacatacattcctagctctgtccacttagagagcctaaagcatacccacacctagatttttgtttctgaatgtcctcctctaatttaagcagccagggatcctcggaaaaatgattataaattctagggctggaaaagagaaaatataagataaacatgaagcatcttagagtgcctgaaggtaaggaagtattcaaaaagatgggggcatatcagagagacataggaaccaacctgaaagcatgtccagtggccaaaactggaacaatttgagcaaaaaataacacagtatagattacaatccaaagtataaaataaatacttatgagtgcatagtgatataaagaaataattagataaacaattgagagagaaaaaaagaagaattccaagtgttaggtatagataatttccctccacccttgagtgtaggttggacttagtaactcactttcaaagaacaaagtatggagagggaaatagtaattttacagtagagagaactaacagattatcttcaccaagtgatcacattagcattaccagtgatcattcctgcgtatatcatccgctccttgatatgatgtgatgagaagggcatttcacctctgatattcttcccaagaaacccataaccctgacctaggcaagagggagacatcagacaaacccaaattgaggaacattctataaaatacttggccagcatgctttaaaactatcaaggtcatgaaaaacaagtaaagactaagaaactgtcaccaaccagaggagactaaggaatcttgacgactaaatgcaacgtggaatcctaaatggcaagggaaaaagtatatagttgacaaactgatgaagtccaggtaaagtctggagtttagttaatagtaatgtaccagagttactcttagcttttacaagtgtactatagttacctaagatgataacactagaagaagttcatttagtggtatacaggaactctctgtacaatcattcctcagtatatatgcaggggattggttcctggaacctcacgtgtactaaaatccacgcatctcaagctctgcagtcagccctgtggaacccatatataggaagttagccttccatataggcaggtttcgcatttagcaaatactgtattttttatctgcatttggttgaaaacattctgcatataagtggacccatacagttcagaactgtgttgttaaaggatcaactgtactatctttgcaacttttacgtcaatctaaaattattctaaaataaaaagttttctttactctaaacaaacaaaaaagaaaccatgagtttacaccatttccagtttaaagtagcaattacagatttttatttacaagacagttattaaattataaggaattattataagtaattttggtattatagttatataacaaaaaagagttcttaccttttggagataagtactgaaatatttatgcataatgctcttgtttttgtttttttgaaacagggtctcactctgttgccccagctggaatgcagtagcccaatctcggctcactgcaacctccacctcccaggttcaagccatcctcctgcctcagccccccaggtagctgggactacaggtgcgcgtcaccatgcccggctaatttctgtattttttatagagacagcgtttcaccattttggccaggctggtctcaaactcctgagctcaagtgatccacctgcctctgcctcccaaagtgctaggattacaggcgtgagccagtgcgcctagccatttatgcataatgttttattgatgtccgggatttgcctcaaaatcaagcagtgggtaggcagtgggtactatgttggaatacaggtgaaacaagattggccaatgtgttgttaattgttagagcagtgtaatgaatgtatgaaactctgtattttctacttttgaaattttccataatataaagtttttttaagtgagaaagaaattacatagtttttaactttttaagttttatatttgtatatcttatctctgaaaatctgggttccttgccacattaatatacttatttgcttcatcctactagtttaaatatgcaataaaaataagactattgaatgcagattaggatttctttgcacttcttttcatccgaagggtatatcccacaggaatgcacaatcaaaaccctgggttttaaagaaattttaaataactcttctcattgtggttttgccacaagcttgatatagatagatttaagtttgtttgtttgtttcagtttgtttttttatttacatagtttttattacaattttagattcacatacagctataagaaatatagatccttgtagactttgcccaattcttcccaaaattaacattctgcaaaactactgtgtcacagccaggatattgacattgatacaatccactgatcttattcagatatctgcatcagtttgtttttaatttttaaaattgtcttttttttctccttgctttaattttggttttagattatgaaaaacatgtatatgattacacaaagtcaaacctgtgaatagggttcattcagaaaggtctagtttgcatccctgtccccattcactttcttgccctaaagaaaacaatttttaaaaattagttattttatttttccattatttttatttgaaaatatgagaagatatgtatatgattttgtgccaccccccttcttacacacttccatatattctcatctaaaccttgatttttaaaaaattttaatatgaaaacactggggatcactccatggcagtaagtagacatcttcttcattcctgtttatgcctgctgaatactccattatggcaaagaattgtttattaaaccattcccctaatgatggactttgggattattttcagccttcttttactacatgaataaccttgtgcatacgttatttcatactgttgctaatgtcaaattccttcctcaaatgttgtgtcattttgcatcgccaccagcactgtctgagggttgtaggcttcaattttaaattgtgatttaaaggactaatctctgtcatataaattagtatatgtcttacttcattaaaaaactgtactcatatgtataaggctagacaaagagagtcatagataaattctgatttattttatggccctcatttatatctgtggacttgaccagaatgcttttaactagagtgggtttcttatcattgtaaggtcactaggtctaagaaaatttgtaatactcagaaatagagagaaggtcatttgtccctctgccatttgtttactttagatagtaggcagagtcattgaatcttattaggaaatataaaaaacatacttgctctttttgccagactcgaaaaagtactaaagctattcatatttcttatacacaccattgagagctcaagaggttcacaggaaataaaggcaagattttgatgggacttttaagacaaggcaaggatttggggtttatcttgaagatgtggatgccatcctaaggcatgtgatcagatcaccatttttaaaggttgtttttttttggctacagtatggctatagtataggaaggaacacatttggatatggggagaattgggaggccattgccattgttcagtatggatattgatggctaggatagatcagtgtcagcagagagcaacagaagtgaattaggaattagaaaggatagggtttgatgattagataaaggaagtaaaggaggaagaggagtcaaagctgacttgccgtctctggcttgggcacctgatatatgatggtgccactgactaacttgggcaaccctggaagcagatgatgcagtatactttggacatgctgagtttgaagtctctgtaagatatctgaatgaaaggactaaataggaagttagatatgtggattaggagcacagagagagatcttgggtagatacagagatttgggaatggttgctacttagatgatttagaagagtatatagagggagaagaaaaaaggacttgaggactgaggttcttccaaattttggaggttgtagaaaaggaggaatagctagcaaatgagatagagaaggaatagctgaagagatagaaaatcacgacagcaaggagttgcagaagccagaaaaaaaaaagtgtatcaggaacaatattataggaaaatgaagggtttgggtaattcttagttccatcctttactagattcctgtattcttcaactattgtcgagtgttcatgctctgcacagctcccattcggcctcatttctgagatgtgctgccttttggtatctattggtatctctttgctgccatttggtattcctatctgatatctcatttccttagtgagggacatagtgagtgaaagaacattagaggacaaatggaaaggcctatactgttgtcctagctctgtcaccaactttatttagtaattttgtttctttatgcctattatctgtgagatatagctagaatttcaggacagagatggctacacatggaaacaattacaatgagaagtaaggagagagaggaagagaaagagccgtcatagaggaggtgatactgagaattgaaggatgaccaggagtttgccaagtggtaatggcaaggatgaaactagaaagaagtagtaaatatattataaagatacagaaatatcataaagctttctttttgagacagggtcccactctgtctcccaggctggagtgcagtagcacaatcatggctcactgcagcctcgaccacctgggcccaagctgtcctcacacctcagcctccaagtagctgggactacaggtgcacgctaccacacgcggataatttttgtatttttttgtagagacagggtttcaccatgttgcctgggttggtctcaatttcctgggctcaagcgatccacccacctccgcctcccaaagtgctgggattacagacatgagtcactgcacctggcaaaataataaaatttaaagaaagaaaatagaatgaagccaggcctcataggaactaggaaaaaagatctcaggaatccaagttactgttctcttcattccttagggttttgtgtctactttgctctggaagaaccagctttctccagttactcaagcgcttgcacatgaccccaaaacgggcaccccagtttccaaaatttgtatgaccttgaagcccaagtaatttctttctgcttttcttacttcacattccagatagaaaaaaaataaacatgaatgagtgaatgtatctatctgattatctcagtttcccccccttttttctagaactgagtatcctaagttgttgacctgacccccctatagataaccttcttttgaatcagggatctgtttcatccagtggcaaacagaagcccactgctgtttccatgattgggctggggctttagatgggagagtttaatagaatatagatggcaaatcgactatatgagtgggaaaagagagaggcattacaggcaggcaaagagcatgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccagttgagaatatccaacacacataaacaggaattctagaagtagaacatagagggaatgatgaagaaaagagaccttattcaaaaagataatagcccagaactttcccaaattgaagaaacattgtaacctcagatagatgtaaggtttggagaagaaaattgctaattttcttggattatttgagtttatggtggttgtaggatacccacctgtaggtgtctactccaaactgcctgagtctggcccccaggagaagaacctaggctagcaataagagtttaggaggcattaccattagcacagggtccatttcacttcttggcacctcagtttctaccctagcaacttttgagaatgaaatgaagtgtaaaagtactctgataatcacaacactacatagttttaccattgtcttcattgtcattgtcataaattctattgagtatagagcctcagtattagaggagaagagctaaggaacctggagccagatttcctatattcaaatcctggctctgctactttgtaaccatgtgaccttggacaagttatataacatttgtcttaagcctcaatttcctcatctgtgaaatagtacctgtctcctagtgtttttatgaggattaaataagttactacttgtaaagcactttaaatggcacttggcatgtagataaatgcccagtaaatctttgctattagctattaaagtacctgcatttcacaggaaccttcagtatcttatttcagaggagtgactaatgtaaaaatcatagtctatgaggataataaatttaggtatctgtgtcttcctgtaatactcaaaggatcagtttagttaactgctggcttttgtctatgtaaagagttttgtggttgtttgcaaattgctcatgatgttatttgaacattcaaggacttctatttttttcttggtaatgtctgaaacttggaaataattcatgggcatatgggatattctcctgaggacacaataatggttccatttttcttgctaagttggaacaatttaatcttgagcaaatacctatgcttgtgcttctgtttttgtttatatctgtatacatctatagttttacaaataccaatattgacattttcattttagccagaaacttgcctaaaagtaagattacacgagctagtttgatttcagagtgcaaatggcagtaaaatgaaagcagaaaataaaaaattaaccatatgattattttgtaatccccagtgtgtttgttcaaggtgagatcattttccagattcatccttcacctgtaccaccttcctgatctgcaaggccatatcagggctggcatggttatttacagttatttagatgttctgtgaggcagataaacagaagacaggacacaagtagaactgtcaaaaaaaaaccccaaaatccatgaattccacaagcgactagaaggaacttgttgtggttttcatatctacatcgtttgaaagggcactccctctcctagagatcaggagctgtactgttagtgatggcaggggctgcactgatacacctgcctctgaatgaagagaaggttttgaggagcaagaaggagaacttatttctagagagaagaatggaaataagggctagagagacttagaaacaatcgcagatacacatccataccagagttacaagaacttacacaggatagcaagcaaactgatgcaatggttatgactgatttggtttggggtggcagaggatccatcccagcttctacctgcaaaagtaagtaggactaggtcaaaggtctaagaaacttaaaaaaaagtgtgtttaaactagctgaactaatacatccagtagataaagaattgcacataaggtatttgtataataattttttttgaattaatgaagttaaaaaatttggggagagagggctgggtagaagagagagaaactcgagaacttgggcctttaaaccctgcaagcataactggggccatttaactaaccaacgtcctagttgaacagagctcattttgagtacagaaacaatagtagcttggaaacttagttctacctaaccccatgaaaccctgtctgtctcctggtcagttgggaaagaacttgtgaggatttcagtaattaaaaaaataatccccttgaagaattagaatgtcactgttctctcgataacccccgtaagtccaagttaaggcaatagcagcctcctccttcaaaaaggtgaacaggaagcatggagttatacagcgggctgagaatcaagagactgaggttctagtcctatctgctattaattagttactaacctaaagcaagtctcttaaacttccagttctaagattctgtgatgtaactcatcgtgatttatatctggaggtccctccccctcactttagtgttagagattagggaggtgggtgtttagctgtgaggattagtgagtacactgaggactaacagtgaagttcctacatggtagaagctagaacagaataggggctattgctcttatctgccttgctttttttctggaaattattagaaagccatacagatatgtatgttaacgtaaacaacaaatccagaggtcgtcttagaattatttgctatcccttgtagctggagcttccttatccactaggaggcaccattgtcaaacaacattgattaggggtcaagagctcttgatcatttaagcaattggagaggaaaaatgtctagaaagaagaaaaaagaggtaaatataggaccctggaaattgtgaaaaatcaatctttgttatctagatggacattagaacagttctcagtttctaaaattcgataaacagtatttcagactacatatcaattttagaagtggcaaaatctttcaaggcagtctttttttcgaagaaacaaataagatatgaaaaaagaccttagaaattactgagccaaatcccatctttattgaggagtcatgatcaacccagaaaggttaagtgtcatgaccaagatctgccaggcttgagcctaaaaccgatgtgtagggggggcatttctcattgattttggccatcccaacacctgaactctcttcaagtatttggagaatccctcattttaagagccttgataggggaaaaaatcccatattctactataaaagctaaaaatggcagatatttgcactactaaacatttagacccacagaactaccacaggacacacttggcatcagattcacttagaaggatacaggacagggggaaagaaaaaacagctttttagtcaggcagcaccaggcattcctctgcagtacgagtcctttcagtagtatatacaataaagttcagtaaatataacagggaaaagaaagatttttaaatagtgttgagaaaacaagttaacagttcagaaatcaatttagattcacccttccccacacacatgcacatacaacaaaaatactacaaacaaaatagagttgatagaagctaatcaaatcataggaaagctagcaaaagataaaattatttaacagatctttagagagcttttaaaacttcaaagaactgggatccacaaagaaaaaaggtatcaatagatttaacaaaaattgaaaaaactagaaaattaatttgcttcaatcttgacataaaaggtttacattctatcgaacataaagagttcaccccaacgaaagggaagatattaagcttcatacacaaacaggcaaggacaggaatagacagcttccaccaaaagaactacaattggtaaagaggcatttgaggatatgctcagtcattttaatgtctttgacagtatatcagaattgctttattaaacagtgaatattccctttctccattgaaaaggtgaaggtttctatctacttgcatatcttaattaacaatcctgaataagcaccattcatattgaaaaaatatgattatatcctatttacagtatcagtgcaagaggaggccttagctccatttatagcacctcagacattcccaaccccaaacccacctactatgttgacacatttcctggtgctccaggccttattgttctttgtcggaacaaatgccttgaaatgctgctgtcctcttaactaccatgtagtcaccaccactcccccatgctctcacccttgcttcttgaggacctgtctcagaggctgactactccatgaagactttctttttttttcctttttttttttttttttgagatgaagtctcgctcttgtcacccaggctggagtgcaatggcatgatcttggctcattgcaacctctgcctcccaggttcaagcaattctactgcctcagcctcccgaatagctgggattacagatgcctgccaccacacctggctaacttttgtatttttagtagagacggggtttcaccacgttggccaggctggtctcgaactcctgacctcaggctatccgcccgcctgggcctcccaaagtgctgggattacaggtgtgagccactgcgcccagcccatgaagactttcttaatctctccttctgtaatgtaggctcttagaagatgggatcttcatgtaactggtccttctatcctctacaaatagtagatgtttaatgattgaatactgaatgaaacataatccccccacaaatacggagtagtttagatggggaaagggtgaaaaagattatgcgtacatgactcctttctttcagaaatgaattcgccaccaacaaatatttgtatatattcatcaatatgtgggatagtatgctgaagacaaaatacctgtttatgctctctatttgtctatagacaattgtacagaccagaaggcacctacccatgaaataaataatagtaactgccaggtgcagtggctcacgcctgtaatcccaacacttcgggaggttgaggtgggaggatcacttgagaccagcctgggcaatataacaagattccatctctacaaaaaaatttaaaacttagccagacatggtagcactacttgtgaggctgaggcaggagaatcacttgagcctgggacttcaaggttacagtgagctatgattgtaccactgcacttcagcctgggtgacagagcaagactgccattcattgacttataaataaatacatacgtacacacaaacaaacaacttgtagtgtaggtctaaatgaccgtagagaggtacagattgttagggcctcataagttcattggaagaaacagttaggagctagaataggcagacaggcttataggaagttgataaagggcatcagcaccagtgtaggagtcagatgggtggaaaggtgaagaaaggacatcccaggcaggagcataaagaatgcaaaagtgttgggaaaagatggtagttatgggacatttgtgaagacatcaaaacagtaccacaaacaaagccctgaattagaaaaaaaacagaattaaagatttttttaaaaaagactgatttgtgtatgcaaggattacagcatttatcaacaaacttactaaatatagacaattcatttaaattatatcaataatatagtattcatatgtatcatctggaaagatggggacataggctctgtattttaaaaatccccctatatggttctggaacatggggcccccataataggcatgaaaatggatttcacatatggagcctttctttacattatgattttacctacttagttgtaatctcttgtcttccattaagtaactgaaagcctggagcagaagtgaggaagtttccctctttgtaacctgagcattttgtggaggataatgcatggactgtaagtcagcttgcctgagttagaatccaggctctaccccttacaagctgtgtgatctcttggtcaagttacttaacttttgctgtttctcagttttctcgtaagtaaaataggggaggtagtcataatacctatgtcgtagacttctcgtgtaaacattgaatgagttaatgcatataagggacttagaaaatacctttcacgtagtaagcactcaataaatgctagctttaattatttattacagcaaaataaggttacttctgtctttgaactgtatataaaataaaccaagcagtttaggtttggctacatctgcttcactcagtattttgtcttcaggattcagccatattcctttgtgtagctgtaattaatttcctttcattgctatatagtattctatacccattttatctattctactattgatggacattgggttgttcacagtttgtgaccattgtgaacaatgctgctataaacattcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtggacatggaggtgggggctaaattttgaaatcaagtacagcaaaaactccaagaggtgttattcttccagaatatcttgagtcttcttggccttctgcaattccatatacattttagattctgctttagagtttccacaaaacctgttgggattttcattcaaattctgttgaatctatgcttcaacttggaagacatcggctgtttacaatattgagtcttcttgtcagtgaacaggataattttctctccatttatttcatttgtttaatttctcttaaaaaaatcatacttttctccacagagatcttatatacctttcttttagatttatttctacattcttaaagaaacactcttttaaaatttcatataacttacaatgattttgctgaactctgcttagttctaattttaacttagattattttggatattctatatataccatctgtaattagtgactgtttcttccttttctattctcatacattttatttctttatcttgccttactgccctggctaggacctccagaataatattgagtttaaattgttagagtggactttcttggcttgttcctgatctaagagttttttaagttttttaatcacaaatacatagttttaagtgttttgacatttattgacctgaccacataatctttcatctttaatctatcagtgtacacaattatattaattccaaatgttaaaagttttgcattcctcgggtaaactcaatttggacctggtgtaattcttatatattgcctgtttggggttgttaaacttttgtttaggttacttgcatctatgttctttagtgaggttgtcttttaattgtctcatactgtccacagtaggttttagtatatggattaaactattttcataaagtgagttggaaactattcctgctttttattcttttatttctccttagaatgttcaatagaacttgtcagaaatgggctgggtgcagtggctaacacctgtaatcccagcactttgggaggccgaggcaggcagatcacgaggtcaagaaatcaagaccatcctggccaacatggtgaaaccccatctctactaaaaatacaaaaattagctgggtgtggtggtgcactcctgtagtcccagctattcaggaggctgaggcaggagaatctcttgaacgcgggaggtggaggttgcagtgagccgagatggcaccactgcactcctgcctggtgacagagcgagactccatctcaaaaaaaaaaaaaaaaaaacttgtcagaaatggcatctaggcctagagttttctgtctcagaagattaaattactgattcagtttcttgaatcagtaaaggattattcaagttttctaattctttttgttaattttggtgagttttatttttctgagaatttgtcggtttcatatacatttttaaatttgtgacataaagtttcagtatcatcttttatttctgcagcatatgaaatgatatctccttcattgttaatactgggtgctatatgtgtcttttctcttttctttttgttatcagtcttgccagagattcatcatttcacagggaacaacttttagctttgttaatttcttgaatatgtttgtcttccatttcattaatttctgcttctatttcctttcatctaatttctttgaatttaatttgatgatctttatgtaacttatacaggtagatgtttagttcttaaatgtttagcccttctctttttttgagtcagggtctcactgtgttgtccaggctggagtgtagtggtgcagtcatggctcactgcagccttgaccttccaggctcaagcaatttggccgtctcagcctcctgagtagctgagacaacaggcccctccatgcccagctaatatttttattattattatttgaagagatgggggtctcactatattgcccaggctggtctcgaactcctgggctcaagtgatcctcccacctcagcctcccagagtgctgggattacaggtgtgaggcactgcacttggccagcctttcttttctaatatgtacatttatagcagtaaatttccctctaagtactgctttacctacattttacaagttttgatgtgtttactgttattattattcagtttaaaatattttctaatgatttattctgagatacatgtaataaaagtatattgtctagtttccaaatgttaggaattttctagatttattaattgctttaaaatttatttatttacttttttagagatgaggtcttgctccatagcccaggttggagtgcagtggtgccattatagctcactgcagcctcaaactcctggattcaatcaagccttccacctctgcctctggagtatctgggactacaggcatgtgctgccatgcccagctaatttttaaatttttagtagagaaggagtctcactgtgttgcccaggctgatatcgaactcctggcctcaaatgatcctctcaccttggcctcccaaagtgctgggattataggcatgagccattgcacctggcctttattaatcatttcagagaatctatttgttgctttgctttttctctattttgtctctttacttcattaatttctgcttattatttccttctaccttcattgggtttaatttgctgttttttaaaacatgtctcatgatgagatgtcactgacttggtaacttttcatattttctaatattttaagtcagcattcacaatatttctattaaatttctaattaaagttttaaaacaagtttatggatacaaactactttgtaagtaccatttcatctgcattctgctttttttttttaacagaactgatttcctatgacaaaagtatagtgcctattcatttttttaaaagtaaaggtaaaaagaagaaaacaaaaaatttcaaatagaattctacccagtctttaacaccccattttaatagcaaaggcttcacactgcatctacttatacataaatatgcatatatatgtttatacatgttaatgtattatgaacatctatgtcaataaatatatgtctataacatcatttaatggcaatataatattctactctagttaccacaatttatgtaaccattctgttgggaatttaggttgcttctaatttctccctattataaatagctgtgataaacccttgtcattaaaacttgaccagtattcctaattatttcccttggaaggaaataattgagccgaaggacatatacatgtttaaggtttttgtcacacattataaaattgcccttcagaaagttgtattggtgtattgttctatcaatagtagattacctactttaagcaaggtttctccagtgccaagttgtgtatgtaacatggatcaccagcttcttaacctgtaagattggacctatgcccctcctcctttcagccatttttctatatttgtgggtctattaatggcaaaaccctgatcttgaaatgtaacgtaccaatcctgtacaagttttgatagtactcttttcattatcattgttaggaatatgttctgctgggcatggtggctcatgcctgtaatcccagcattttgggaggccgaggcagaggggatcacttgaggccaggaactcaagaccagtctggccaacacagaaaaaccctatctctactaaaaatacagaaattagctggacgtgaggtgtgcgcctgtaatcccagctactcgggaggctgacgcagaagaataacttgaccctgggaggtggatgctgcagtgagccaagatcatgccattgcactccagcctgggcaacagagcaagaccctgtcttggaaaaaaaaaaaaagttctaattttcattatgatgatttcttatttgattaattggctatttagcatgatttctcaatttccaagcatttagggttttctagttattttgttaatttatttctaacataactactttgtggttaggaaacatactctgagtactcgtttcttgcagaagtttttagactgagcttttatctccatagtaagcattgaggtttttggggtgttttttttttgtgtttttttttttggtgggtggggatggggtcttgctctgttgcccaggctggagtgcactgacagagtcatggctcactgcaacctcaatctcctgggctcaagcgatcctcccacctcagcctcttgagtagctgggaccacaggtgtgtaccaccacacccagctaatttttttttattttttgtagagacagcatctcactcttttgcccaggctggtcttgaacttttgtgctcaagcaatctgcctgcctcagcctcccaaagtgctgggattacaggcctgagccaccaccatgcccaaccagcattgaggtttttctgtgctaccaacatgacataccagaatttattctgtaccccatttttcatagtgcagctctatggtcccagccaggagcaaagggtgtttcatcagagccttaacctcttagatcaccctggtgcaaaagcaactggaccctgtcattctccatctgaccaccccaccccctcctacctctctagagttcctaaaagtacccctcctttccaaaacccacattcttcccctagggcagaagcagctcttgttcacctctttgagttgtaatcctttctctgttctcaggactagtttttcactcactatactgttaattctcacaagctttaacaaaaactttttgtttgactgggcacaatggctcatacctgtaatcccagcactttaagatgagaggcccaagcaaaaggatcgtttgagcccgggaattccagaccagcctgggcaacatagccagatcctgtccctacaaaaattaaaaataaaaaaattagccaggtgtggtggtgcatgcctgtagtcacagctacttcagaggctgaggcgggaggatcacctgagcccaggcattccaggctgcagtgagccatgattgtgcccctgcagtccagctctaggtgacaaaacgagaccctgtctccatttaaaaaataaataaataattttaaacatttcatacagtttttgtagttggcgtttttgtcatcctcagaaaaaatgctggttggaaaaatccagatttgctctgtacaacagtgttcttcaaggatatttgcagataagtaccaatctgtcaccagtctgccatgagatacatacagaaattgacagtaaacatttagaaactgttacagcaatttgacattgctgtgaaatcatagcacgtgattttgtgccttcaactccagataatcctgttgccaaagcagcatattttggagtggcatattctgatctccctcaatgtgcagccagtaataccttgtgcctcaagacctgtgatctgttttgtttatttgatgagtttggttttggataatttcttaattatataaataatgcatgtttattataaattttaaaaattcagatggatgaaaaggagagacagctaagctcattcataatcccattacttttcacaattcagactaaactgcccttaatttctctctgcatacagtatagaagtccacctcccccatactcttccataggagggtttcttctccctctcctttcattccctcagaatggagccaactaggaaaattcacaatgtgttctttgggggttcttgacagccccagaagcaccccaagatgggaagccaaagagaagagcaataaaagatgccttgtcagtttgtagaatcattatattatcaaataaagtttatcaaagaattgagtcatcaactttgttcaaaaggttcaaggttaggatatcaggatggtatgtattatgaatatgtgtattttaaatttcgttgaataaaatttgcataaataacagtatttttagtttttatttctatatctcatgaaatttaaaattagtagattgcttcttttactttaatatcaattaatattataaataatcaaatagctttaataatagaaaaatattttcacagtgatgcctctctttcagagtaacccttcaaagaatgtgcctgtatatttactaagttgcacaggtggttttgtttgatatctgtggttatgaagcattgaattaaaaaaaaacatataatggctgaaagatcccatttacaatagcaactaaaatataacatgtacagggaaaaagcctaataataaatactttaaaccaatataaagaaaatcgtaaaactataacttagagacatgaaaggaagtggagagacatatcatgttcattgatgagaatattagaaaatgttaatttctagaagttaacctatacatttaccatctgaatcaaaatacaaagattttttatagtttgacaaaatgattttaaaagtcaactgggaagaaaaaaatcataagaaaatgttggtgaaggccagttgtggtggcttgtgcctgtaatcccagcactttgggaggccgaggtgagcagatcacttgaggtcaggagttcgagaccagcctggccaagacggtgaaatcctgtctctacaaaaaaatacaaaaattagctgggcatggtggcaagcacgtgtagtcccagctacttgagaggctgaggcaggagactcacttgaacctgggaagcagaggttgcagtgagctgagatggcgccactgcactccagcctgggtgacagagcaagactctgtctaaaaaaaaaaaaaaaaaaaaaaaaaaaattggtgaagaataatgagatttttttttgccaaatattaaaagctgctactacagtattttattttgtctgtccatgtttttgtttttgttttgagatggagtctcgctctgtcaactggagtgcagtggtgcaatctcagctcactgcaacctctgcttcccgggttcaggtgattctcctgcctcagccttcagagtagctaggactacaggcgcaggccaccatgcctggctaatttttttgtatttttttagtagagacagggtttcaccatgttggccaggctggtcgcgaactcctggcctcaagctatccgcccgcctcggcctcccaaagcgctgagattacaggtgtgagccactgtgtccggccctacagtattttaaatggtaacttgatgcaagaataggcaagtcagtggaagaaagtagaaacctaaaaatacccccatgtgtgtatgcacatgtgtagagattgtcatttcaagtaccagtatttcagatatgaccagacaaaatggattgatccttgctgataattatagcacagggcagtaaataatttccaagtatttctcacggactggttccctccttagtctttatacttctcaccactttgctgcctcctccccaggctccgtcttttccctcatcccttctgggtccctccagaaagtcctctagctctcagaacatctcccaaattctttttggaaacaccagagtccattgaggcattttatttgtaagtatatattacatccctagaaaaagaattccaggattttccctcctatatgttttcatcttgcttcttcatggtccataatgccagctgaggtcgttagtacagtgaatccaaactggtgggataggaacaggttattctgccattttactagatctttgggttgcacatcaaatctgggatctggggctgatcactccacacttgtttaacctacctcaggttcacaacaattttcccagctctatgatcatcagtgatttcaaattcaccaatgtaaccatgcttcatcatcacagttagaaactggacagtaactttggagcacaacctaataagaacctggtgtttgcctctttttggtattgttgatgctctggatagcatcagccaggacattcatgcacaccattatggcagcatggagagatggcagaaagagcctaaattcttattgcttcattatgcaatcagtttagctctctccttttcctaacccctctctcatctaagttgaatcgtgcttaccctcatatatcacaattacaaaggaaaacgcctaagcaaaactgattccttcgctatgagatgttttttagtcctcatagatcaactaaccagcttaaactacagccagtttttaaaatagcgtttcttttctccccacaggacaaagaaatgaaaaatatttactctctgtagtaatcaaggaaatgcaaattaaagcaatcatgaatgacttttttcctcttatctaattggcaaagatggaaaaaaaataatcattatcctagtagagcaagggacacattcacacatggtagtgggagtataaattgttaaactgtttctggtcttgtgtatgtatcaaaagtgttattgtaggccgggcgcagtggctcatgcctgtaatcccagcactttgggaggccaaggcgggcggatcacgaggtcaggagatcgagactatcctggctaacacggtgaaaccccgtctctactaaaacaaatacaaaaaattagccgggcgtggtggcgggcgcctgtagtgccagctacttgggaggctggggcaggagaatggcatgaacccaggaggcggagctcgcagtgagccgagatgcaccactgcactccagcctgggcgacagagcaagactccgtctcaaaaaaaaaatgctattgtatataccccttgtcctagcaactcagcttgtaggaattttaccatacagataatcagagttgctcaccaagatgcatgatcacgttcatccaggctttatttctgatggtggaaaatgagtgctgccatactagggagtagactagaccattataataatgtttatagtagactaggcaactataaacattattttggagaagaatcctatttgacattggaaaatgttccttaggtgtgaaatggaaacttggtaaagtttttagagcctgtataaatgtgaaagtattttcattcatttatataaaaccacaccgagaatcaaataatagaatcaactgttcattaggtgtctacagtgtgtcttctgctgagtattaggtaggggtacattgaaagtataaatatattttttcttgttctttaggactttacactatcatggaactgttgtagggcttaaagatgtgcatttgttccttgcacacccagtaggtatagctataatcaatgggaagagcacaggacatagctagacagagatttcgatcttgtccctatcacatacttgtccactcacttagacaaattatttgaaaatgatgctgacctcatggggtggttataagtatgaagggaggcataacaaggactgcttcctatgatgcctcatgaataggaagtatgttagttcctttactttcccttccagaagtttctatttcctcagtataatatctgcagcaggtatattgggaaactgaactactgaatgaatgaatgaatgaatgagatactggatttaaaaatatgttataagccttaaagcattatgaaaatgttagctgttaatatttgcatagtttcattaatatgtataatatggcaaaattcatgtatacatatataggtgtatgtggggggagggggaggtgtttgtatgtgctaaatgttatggaccatatagagttgttatagaatgaaaagcaaaggaaggcattaatatggctggtaatcattgagggggcttccagggaaggtaggattggaatgaaaccttgaattaaggtaggttttgaaaatgaaaagcaatatatacaaaagtaaaaaagaaaatggtgtactcagggagtgataataagaccattctgcctagagaggaagattttcttgaaacatcagtggacaaggtaggtagaagaggcaaggtgtggccaagacaacaagaggccttacttatctagtaagaaatagaaaactactgtaagttctaagacaatatcgtgacattgcgttaccaacacatctatgtgttacaatatgtttgtagcgatgaactttgggaatggcagtgtaaacaaaaataaattttattttatatatgtcattgttttttccttccacagtatatagcctgaattttccatttagtggtaataacaatagcaagattgttttttaaatccttgtattctacataactgaatatttttggaatttgacttaaaaatatgcacacaaccctagcattgctgttttctgatgcttctttttgtgaaaacctaaagaaaaattatagtcaattttatatactcaatgttatttgatattactgttagcctactcttcctgtttctttccctgcagattttcaatgtgaagatgactgtcatgccctttataatttatgtctatatttcattgaaagaaaggagatttaaataacataacccttagcagtaaatcaactaataacttagttacaatgtattcactttcagtgttgtcttcctggaatttcctcttttcttatgttctttttcacatttttttacagtatggatggagcagatctgtgttttgaaatcgtaaagcgagctgacgctggttttgtgtacagtgaagctgtagccaggtatgtattgtatatctaatcaccagaggtcaagttgaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggtcaggagatcgagatcatcctggccaacatggtgaaactccttctctactaaaaatacaaaaattagctgggcgtggtggcatgcacctgtagtcccagctactcggaaggctgacgcaggagaatcgtttgaacccaggaggtggaggttgcagtgagccgagattgcgctattgcactccagcttgggcaacaagagcgaaactcagtctcaaaataaataaataaataaaatgaaaacgtgggtttataatacaggcttacattttcagtactgctgtctttcccatttctgatgatttttgtacaggaagcggggatctaatagctcaggaaccatgtagaattctacttgggtttttttatttttgttttggcaaatctgcctcattagttcttcattttgccttttagtgatatcaaattatctcacaataattaaggaaaagtaaagaacagtaaaaggaagagaaataaaagcaccatttttaaaaatatatttgcttcaggccagtgtgagacctaccaatcaaatggcagctgttgttctaagtggagaagttgtttgtaaagacctaatgactcaaaataagaaggaaatatgggccgggcgcggtggctcatgcctgtaatcccagcactttgggaggccgaggcgggtagatcacgaggtcaggagatggagaccatcctggctaacacagtgaaaccccgtctctactaaaaatacaaaaattagccgggcgtggtggcgggagcctgtagtcccagctactcgggaggctgaggcaggagaatggcatgaacccgggaggcggagcttgcattgagcagagatcgtgccattgcactccagcctgggcgacagagcgagactccgtctcaaaaaaaaaaaaaaaagaagtaaatatgaaaaatcacaggagccatgcacgtgctgggccacttgcttatacatttagagcaacacagctttctgttttggttacattcaatcataattacccactcctgtaggttgcctttttaatacatggaatacagcatccctccttagtcaccagccatagtatgttgaagggttcaaactcacaaacatattaagtttttttttttttgcggggggtgcgggcggcgggggacggagtctcactgtgtcatccaggctggagtgcagtggcactatctcagctttctgcaacctctgcctcccaggttcaagtgattctcctgcctcagcctcccaagtagctgggattacaggatgcgccaccatgcccggctaatttttgtatttcttttaatagagatggggtttcaccatgttggccaggctgatcttgaactcctgacctcaagtgatccgcacgcctcaacctcccaaagtgcttggattgtaggcatgaactacctactgttcctagcctaggatttatgaaaactttttatcatttgaaaaacagttatattaaatgatttcctctgtcttaccatttcttttacaattatagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgctcaatgtgtggtcgctgtgtttttgtactgctggggctagggcgaaggagcaaatgaaagtttatgtgtgttctttaggcttctgatctatacgcggtagaactaaagctaaatattctcttttcttttgtgcaatgttctctaaagcacattccagggtttttttaaatcccatcttctattattttgagtttttattacaattttaaatttttattctttcttgtccctcaaaattttaaagcattctttcataccaaaaatagtcaatactagtgaaactcaatggaagaaggggatttttcccttcttgaaccacaataacacggggatacctggcaggtatgctgacaggattgatgtgaaaccagtaccacttttactctggtccccagtcatctttattgcttttccttaacttcaagcctatctctgccactgggctacatgtcaggataagcaggatggtagtgtgaagagatgatgtcatacaatgacatgacttgtggtctctcctaatcttgagatttatagaaaaggtagatgtttatacacatcaaaatgaaagcctattgatttttaaagccacctgtataagctgttaaaatggtgaaaggaactttccagagtggaccagaaaagagtagcattgggaccagtagatgacattgcaaagagagaggtttggaggcagtttattaaaggttcttcctctgaacaataaaaaaaagtaggcggggactcagaaagtattattatgtgtgtttgctattgcagaggatcaatgaccatgcaacaagggcgcgtagattcttccattggtttaatgacagatgacttctaatctttcttcgtcctctctgattctgtgatttattgttaggaaattcagcttgtatcagtattctagtgagaccgactgcaagaagactctgagacaccaagtaatcaaattgataatgttgtttttctccaactggctgagcttcaagaggagcagcaaagcatggcataaaataaaactgtgttcagtccttagtgcaacccaattagttattacctccatcctttcaggggtgatgagttgtggagtgagctaacacacaagatcagattatcaaatcaaactctcagagatcttcttaactagtaccaagctttactaaataatctcaaggatacaggcagtcagaaggctcaagtgaagcagagaagggaagggcagccccccacgtcacttcttactgcctcagaaatgcacctctggcccagaatagatgaggtttatactggggtttgtgggtttccacacacaaaggggagcattgcaaatatcttcattttacaccccagagatttggatagctccattgacattctccaggaagccatctgtgcctcagagatcccgtgttctacttaccatagtaatccttagccagagatatcctattaagggcatttcagagataaggtctcttctgcctagcaaatagcattaggcttttcacctgcattgacaagaatagcagactgaatcacctctcttctaccatgctgcacccctgaaatgcctccttccaaaggcagtaaatgcattgctggccagctttttccttccatggagttattatcttgctgatccttaggaaagataaagataaacaaatatattgctgagtttctctgaaagcacaggtctctatgatgcttcatgaagtgaagttttttgattaaaagtttagtcagcaacttcctagaacatgtgggcagattttagttcttgttttattctgcttgcacactttgacatgcattgcctcgcaggatcatgactgggagggtggagaaagatagttcagttctgttataacttgggaagaaaaacagttccactgtctccacacacgccgcaaagattctgctgtgtacatacgtttgggtcaagtaattgagtgttctcatatgcaaatgaaaaaagcctcattcattgagtttggttttgtgttatgagactttgagataggaattttctttaggttaaagataatttaggtggctgtctcagtgctttgtatccaaaatagttcattctgtgggtacaagctatgtccactttaactaatttaaatttacccagtatttccatgttgacatctagatggacaaataagctgttcctaaatctttgattgaacttaacaataataatattgtactaataatgtcttaacctttgtagcatggtttagagtttacaaagcactttgacaggtgtagtctcttagccatttcaaggggttacagatcttccaaagcctgatttgaaccagtaatgggccacaacaccaagttaacccctcatttgaacaaaacttatggccaggcgtggtggctcatgcctgtaatcccagcactttgggaggctgaggcaggctgatcacttgaggtcaggagtttgagaccatcctggccaacatggtgaaaccctgtctctactcaaaatacaaaaactagccaggcgtggtggcgcatatctgtaatcccagctacttgggaggctgaggcgggaaaatcgcttgaacccaggaggcagaggttgcagtgagccgagatcccaccattgcactccagcctgggagacaagagggaaactccatctcaaaaaataaaaataaaaaataaacaaaacttaattacaggctacaatggcccaagcaaagagtatatgagcacaaccccttatatgtgcatttgcaaagtaagataaattaaaacatcagagctaatgattacatgagcctagctctctggcttaaagccccgttgtaaggagcctgtgattagtacaggaacaaggcttgtgattagtacaggaacaaggcttgggtttgtttttgtttttgttttttctcctacctttcatttttaaaatggaacctttccaattaattgtaatacatgaaataatgcatatgctaactagagaaatattcctgtgagcttgattaaatggtatcatgccaaagagggaacttgatggaaatgtcttttaattgtaaagccaggatagggattttttttttttttttagtcctgagtcacatacacatgttcaaggtcacttgtatcagaaatataagatctggaaacaaaacaaaattctataaatattatacagtgaacagtgttaagtctattgcatttctgtcatgctggttgggaaggaaaagggaaaaaatgagaaaagaaggggaataggaagaaaagagacaaatatggagggaataaaatacagaaaatgaaacagatactcagagaaagagtaatagggcaattatagaagaactttagaaataggagaaggaggttctaaagtggtactgaatcaactgctcttgtcacacatggttgctagttaaccccattaccattttttaattcctgttctttaaaatgctgatttcttctttgttcttcacctgtgctccatgagggctcctcagctggccatgtaaggagtcaggctttctaggacatgtgcctagaattaactccactttgttcaagggagccccaactaaaacttgattatgttacaaaaagaaattgtccgataagggtggctcttccctcatttgtcctcacagctaaatagaagtaagatgaagagcatcttattatttgctggcagatcaaaggctcccactgcttgagtctgaatccttggggcagccctgagcactgtttacataacgcagtccagtttaagtagaattacctgagtattggggaaaaaaattgtcatgttttaagcttgaatttttagtttgcaaagcaaatttacttatgaactatgtgtaattcttttgacttagatagcttagaaaatatagagcatactatttcttcatgaagcccataaacttttgagtctgccaacattttcattattaagcctcactttacaccaatcctgtctgctcaaatcaaatgtgtccatggacagctaatatgagagtgggagttataaactaggagcactgtatattaagttttaaaataaaaattgtttacagtttttagatttcttttgttttttacagccattatatgagacagatactggaagctctacgctactgccatgataataacataattcacagggatgtgaaggtaagtcatttgttatcactaactttaatgtttgtgaagaaatactgatataacaatgataatcaagaattcttctttaatattgtcataaagaacatcttaattttacttctaagtaaaaatgtatttaactgctttgtatttgggaagtcattgtactaattcttactaggaacactataatttcaatttatttatttttactgaagtgttcatgcaatctaaaattgtattatttctcttttgccattgtgtgtgagagagaaatgaaaaatccaataaataggaaaaaccaaacaatatcctatactgagttaattgggggggaaattagaatttggtttatatagtaaaagttaatcataacatattttcataatattgcaatgcagaatagtcagcattgtatttttttgcagatagtttttaaatatagtatgaaatcataattatacatgtaatacgattttatgcttggaataccggtattatcattattcagtctttctgcctatttcatcccagtatcgggttaatgagaactctcagttcctggttctttaacggtgtcaagccaaacatagagggaggcaagaaatgagaccagtaggccttcctcctgatccctagcttctcccaaggcccagaatcactagggagcccctgaggtccctttgaccctgggctacacttttaagctctgatattttgtcactggcctttctctaacctccagcatgcacatacatagtgttccttccctcaagatatattattaaaggcctggcttcttcgatgtatttaatactttaaatgattaagaaaattaagtagagtttaattaaagtgtctataatgtttgggaaattttcacagaaatccttgtagttaaaagctgagggaaaacatgagcaattccaaaaccatctagtaaaatattttaatagcaaatgaaaatcactggagaaatatacaaaatacacattagtgtaaattagttgtaaaatatctcactcatccttttcagatgtgttaagaaaatgatattgttattatcagaactcaacaccgagcatctcaatgggtccccctttatgaaaaagtattctggccaagcccggtggctcatgcctataatcccagcactttgggaggccaaggcgggtggatcacctgaggtcaggagttcaagaccagcctggccaacatggtgaaaccccatctctactaaaaatacaaaaattagctgggcatggtggcacatgcctgtagtcccagctacttgggaggctgaggcaggagaatcgcttgaacccaggaggcacaggttgcagtgagccgagattgtgccactgcactccagcctgggcgacagagcgagactccgtctcaaaaaagtattcttcagttatccaaaaagaaataaaagtgtggaaaggtaaaaggcgggaaattgtcaactgtagtagtttgctgtgcagttattttgcattaattaatgtaagaaagttcatatgtagagagtaaaatatatctctttgtatatattctaaactatatacaagaaaaaaatgataatttaaaaacctaaaatgtgttcatgtaatagcattatgttaagaactgttttgctcaagaggcaattttattttgaatgaattattctcgaaagataattatatcaacatcatataataaacaatgattgacaatatattctactgtaatactttcaataatgtagtcagcttttgattaactggtatttgatatgacaacctaaacctaattaatatccaaaagtagataatttgacctcaccttttaatttaccttctgatttatttatttaacaaatatttgagtgcctactttatacagattactgtgcttggagccctaaaagtattatggtctcagtagggagataaggctcggtatctcttatctactgtagcagatcaacacatgccaaaacatagtgacttcaatcaataactgctgcttacttgctcacaattctgcagtttgggcagagcttgataggactgctcaattctgtttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttagggctccaaaagagcaaaaatggaaggtgctaggcctcctgaagcaaactgacactgtgtcacatcttatgcatttcattagttgaaacatacttcacaaaaaggtcacaaggctagtctgagttcaaggggaagaaacatagattcatattttgattgatggagtgccagatatatacaaggatgggagaacttgttcgtggccacctttagaaagacaaataattattgtgcaaggtagaaggtgataagtatcattaaaagatgaggtcagagaagtttcctgggggaggtcacattggagcttgttcttgaatcatggggtagttatatggagacaaaaagacatttcaggcagaaggaacagtttgtgcaaaggcccaaaagtagtcttacgttggagtatgttagattagtttattatttctaaagtacatgctaaatagtttagaggaagcacgtagaaacatgccaaggaatgaaaaagaagtaattctcaaactgcaaataagtaagaagaaaccaccccaaaaattgccattgttcagttgggagacacactcaacacagagcacacgttaatgttgatattctttttttgtttgttttttgtttgtttgtttgttttgttttgtttgttttttgatacagggtctcgccctgtcacccaggctggagtgcagtggcgcaatctcggctcactgcaacctctgcctcctgggctcaagcaatcctcatgcctcagcctccagagtagctgggactataggcgtgcgccaccacacctggctaaattttttttgtagttttttgtagagacgaggtttcaccctgttgcccaggctgctcttgaactcctgggcttaagcaatcttcttacctcagcctcccaaagtgctgggattacaggcgtgagccaccgcgcccggtgttgatattctttatatttcagaagccgaaatccacacatttttacatgggtgaatagaatactcacatttagttaattgaaaatttttaatgttggtgtatttttcttaagacattcatccaaaagatatttattgagtgcctactgtgtggcaggcactgtcctaggaaccggagctacgtcagtgaagaaaacagacaaaaatcactgccctcatggagctgacattctagttcagggaggcaatactcagtaaacaaatgaactacatagtaggctagaatgtgaaaagtatcacagaaaaaactagagtggtcagaaggttagggagtgtccagagaagggcttgcttttgtaaatatggtggtcaaagtaggccacattgagatgatgatatctgagcaaggacttggaagagaggaagcgggctaatctgacagctgagggaagagcacttcagttaaaaggaacagccagtgcaaagaccgaaagacaggaacacaagtagcctgctcgaggaacagcaaggaggccggtgtggctgaggcaaaatgtgcaaagaggagagtaaaaaggagacaggagatgatcctgcctggctcagaccagagtagtagcagtggaggtagtaaaaaaaaaaaaaaaattagttagattcctgatatattttggagattatgccaataggatttcctaatatatctttggtaacgtaggcaaaacttagttttattcaagaccctgttacaggggtattccaacatagtggtcattgtaaaacttcaagaacaatacatttcacatgctaataatgtaaattttcacttggtttgatttgttaatatttttgccaataaagcaacctatgagcttttctttccattcagatatatattcagtgacttatctgtatgtagatttggtttgtatgtagatttttgtttctgcagttaaagtttttgtctaagttttctttccttatatttaataacgaaaacagaagagcattgcaatattttatttctctaagaaaaatttattttatcatctgtttcatctagccaagaatattctcattctctctctctctctcataattcttggcatatgatccaaaagcattacatttcccaaggatcctgttattatatttattaatacttttttctttacttttttacaaaaggtatttccttttgtaatcattgtaactgagtcttaaaaggattatttggttagatttgaatatatggtaccatgtaatctatttttgggaactgcttgctctgaagaagcagtttcacataaaactgcataaaaagcaatcatataatcctttgaaattcgagagatgtgtgaacatagtgctgggcctccccacagccacacttagtgacatatcaggctatattctttgctgtgggaggctgtcctgggaattgtaggatgctgctaagcatccttcacccactagatgccagtagcatctccccctagttgtgacaaccaaaaatgtctccaaacattgctaaatgtcccctggggcacaaaaattgtccctggttaaggcccactgtcataatagactgttataattctcaagatttgcctccctacaggtattaattaaggcatgcatataaatttctatttttttctgtcatcttcttccctttaattctactttttcttgtgaaagaatgtgaaaactttcattatgtttctggtatttttttttcttcctctcacccctaaattaaaagtactttagaaagaaatagcacagttgtcaaggtaaatgcaactcctggctctttgccttctttcatgggctctactaagcactgagagtttgtggaattttctcctctctcctaactcttgcaggcagccttagatcatgaggttgtggggagacttagttttagacctttctgtcactctgacctactcatgtataattctaataactgaagttgaagtgaaacagtttctctgagaatgcaaattgctacccacaatcactttctattctgaatggtgcctgtgcccagaaggtctgggtgctgtttttagttcttagaactgtgcaaaccccagtcacacacacactcagccagaggccagagtgtttctgagtgtgcttcctttaaatggttttccttgctaacctgtgtgaacacgcctggctgctttttggttcccttctggtctcagttctccttttacctatttaaggccagactttatgataaatttgtgtttatcatataacactggttggcatgacattgtggatttcttaaagcattccgtagtctcttgttctccgttactgatgtttcttttacacctgataccacaactccccaaagtttatcatgttgtatagagaaatttaaattctcataaaacaaaaacgtatttattctttatttattttatttatttatttattttttttgagacagagtctcactctgtcgcccaggctggagtgcagtggcgccatctcagctcactgcaagctcaacctcccaggtccacgccattctcctgcctcagcctcccgagtagctgggactacaggtgcccgccaccatgcccggctaatttttttgtatttttagtagagacggggtttcactgtgttagccaggatggtttcgatctcctgacctcatgatctgcccgcctcagcctcccaaagtgctgggattacaggcgtgagccaccgtgcccagccactattctttattattatattaacattggttaatcttctgcatttcttttataagattttttaacataatgtgcacgttcagttttaatgtggcattttaataattgtacttaggaagatctcatggattacatgattattataaatttatcttgtgtttctaactgctatacttctctttgcccagcctactcctacaaaaaaagaaatcaactccttggttttaagtttctcagcctgagcaacatagtaagaccctatctctctctctccttttttttttttttttttgagatggaatctcgctctgttgcccaggttggagtgcagtggcacggtctcagctcactgcaacctccacctcccacgttcaagcaattctcctgcctcagcctcctgagtagctgagattacaggcgcctgccactacgctcagctaattttttttatatatatattttttagtagagacagggtttcaccatgttggccaggctgatctcgaactcctgaccttgtgagccaccacgcctggccagtaagaccctatctctatcaaaaaataaaaattagccaggtgtgttggcacacacctgtggtcctagctactggagaggctgaggcaggaggattgcttgagcccaggaggttgaagctgtaatgagctgtgattgtatcactgcactccagcgtgggcaacagagtgagactccatctcaaaaaaaaaaaaaattcttttgcttattagaagtgaatccttttactgttcctctccttctgagccaggagtagcgtgtgtgatatagccagaggtttttctgtcaggtgcaactatagctgtagtaactcttcccagtgttatcaattccatttgagtgtaggggccatcagaggaaggtttgtggcattaggctgctggattgaaatgcttatgcttagcagattaccagtgttccctctgttctccctttgtggtttgccggcaggatttcctttcaccttgtcttcccagatttgcccgtaactcccaccctgacagagcacaaggccagtgataggcctagagtcctcagcaaattgaacagaatgggccatcttcctcttctatccagggagtagaaacttacttccctgttaagttgtttatcctaaattttgtctagtcttaatggtttgtgttcctgattatagtttgaaagctgccttaatgagagtatgtgtatgcctgttttctacagtttaagataaaatcttgttggcctttgagtcaaaatttgagattcctgaaaccccaaatttgtgtttgactgtaactcacacagacacattaaaaacactgtttttttgaaatccaaactttaaaatagggtaagttttgaaggtgattttaaaaccaggcacagtggcttgcacctataatctcaaaactttgggaggctgaagcgggaggatcgcttgagcccaggagttcaagaccagcctgggcaacatagcaagagcacatctctacaaaaaaaaaaaaaaaaatacaaaaattagccaggcatgatggcacacacctgtagtcctagctactcaggaggctgaggtggtgagatcacctgagcccaagagtttgaagctgcagtgagctatgatcaccactgtactccagcctggacgacagagacagaccctgtctccaaaaacagaagtgatattttaagtaaaatatttactatgccattaaatagccagttcttcaattacataaaaaaattcaacatgatttaaaatcaactgtttaggaaagcatctatggtgtaaagatatccatgatgataatgagctgagtatatagttcattcttcagtataggaaattaaaatgtgagtttatcagaatgagtaacttaaagagaaattgcatatctcttttcctgcctttttaaatgtaagaatctctagaaatattttttgtttaaagtagtggtagagctgtaaagtgattgttttttaaataattatttttagaagttgtattttttgggttttttgtttttgtttttgagacagggtctcgctttgtcacccaggcaggaatgcagtggtgcaatcatggctcacttcagcctcaacctcctgggctcaacagatcctcccacctcagcctcccaagtagctaggactagagacatgtgccaccatgtccagctaatttttctattttttgtagagacgtggtctcactatgttgatcaggctggtctcaaactcctgggctcaagtgatccccccacttcagccccctgaagtgctgggattacaggcatgagccactgtacctgactggaagttgtatttttttaaaactcctaagtccagtgagattattacatgcagtatagcttatgttaaacaaacattactgtcttagtcggatgagttttggtctcaaaactcatgtaagaataaaactacttagtctgggcacaatggcttgcccctgtaatcccaacactttgggaggccaagatgggcagattatttgagctcaggaattcgagaccaacctgggtaacatggcgaaaccccgtctctacaaaaaaataacaaaaattagccgggcatgatggtgggcacctgtggtcccagctattcagaaggctgaggtaggagaatcacttgaccccgggggggtggaggttgcagtgagccagatcacgccactgcactccagcttgggtgacagagtgagaccccatctcataaaaagaataaaactacttttgtaactgtggagaaatctgtgcatctcaggaactctccctgatggactttgagttactctatgatttacatgtctagaaatcactagattggacacttccatttacagctagcattcagggcggtcacctcaagttcccaaatctcctttgtctctgcacattaatgagccaaaaatccaattactactataaacgaattgatactcactgtaaatatttgaagccagaatgtgttcagacttttctcagaacattttcatgtctcagttaagcatcaaagtagaaaaggaaaaaaaaatttactgggtttttgtgtgtgtgtgtgtgtggttttttgtttgtttgttttgcccccggaataacctctggtgatttttgaacacatggctcttgggcaatgtactgtgaattgcttttacagctctaactcaggaacaaaacatgctatgagattaaagccttggaaggattacgtgaacttactttaaacttcattttggacactgaagtaattactatgtgaagaaaaaaaggagtctttaagcagtctctaacaaagtggcaagttactattaatggttgattttattcagctgtttttgtttggttatctgagaagagaatatcagtaccatggaagtagaaatagacaagaagtttatagctccaaagtgcttatgatctctttgggcagatagtacacgcttttttttttaatcataatatatgtacttattacagaatatagtcaccatcatttgtctactgacaagattacatgaaagaaaagaaattaacattaagaaatgcttatctttaaatgttcacttaaatattagaaaaaattggggtgatttacttaactatgcacatatacatacatacatacatatatatatatatatatatatatatttttttttttttttttttttttttttttttttgagacagagtctcactctgtcgcccaggctggagtgcaatggcatgatcttggctcactgcaacctccgcctcctgagttcaagtgattctcctgcctcagcctcccgagttcaagtgattcttctgcctcagcctcccaagtagctgggactacaggcacacaccaccacgcccagctaatttttgtatttttagtagaggtgggtttcgccatgttggccaggctagtctcgaactcctgacctcaggtgatctgcccacctcggcctcccagagtgctgggattacaggcatgagccaccgcacccagcccacttcaatattttcatcagtaaattagtatactttagagttgtggtgattaaaataatatatgtaaagcatataagtagaatgcttggcaaacagcaagtgcttactaagcgttagctactcataatagtaacagctgatttaataataggatctgtaaataagatagtattttctgctctacaaatgaagaaattaacacgtacagaggataagttaatttgcctaagattgtccagctaaataaaaagtagagccagattgaacccaagaagtataacttcagagatcaatctcttaactgcaatactattacactcccttattattcattcatttatttcacaaaaaattaactgccaggtactgtttgtcactaataacattatttatattgaatacagaagaaaatatgcacaatgtgatgaagatgggcatataatgacatagctttttactttgacaaagcctaatccaaatatttaagcatttttataagtatcatctgctttaaaaatatagtcaatgaatattgcttctccccaataacatgagccagataatttcaaataaataatatgtttataaaaccttggatttttttcactgtattattcatgcatttaggtaagatgtgaatgaggatatttcttatttatttttttacttatttttatttttttgttttgttttatgagacagagtctcgctctgcctcccaggctgtagtgcagtggcacgatctccgctcactgcaacctccgtcccgggctcaagcgattctcctgcctcagcctcccgagtagctgggattacaggcgcccaccaccatgtccagctgatttttgtatttttagtagagacagggtttcaccatgttgcccaggctggtcttgaactcctgacctcaaaatgatccacccacctcagcctcccaaagtgctgggattacaggcgtaagccactgtgcccagctacttatttttaaagattttaaaattaccaataaacactagccatagattgacccttgtattctaactaccagaaagcagacaagtcataaaccatttgcttctttatcctagtcatgaaataacgtgttctgaacagaagcactgacagttgagtttaaacagaaaacagcctgttagtttcatatgagtgggatcctttcaatatgcttaatttttgcttctgaaagtttctgccatctcaacgttcagtataactgttttttgagttttatgaatatatgtttatttatttttaaaaaccaaagagattttcttggtgattattgtcaaccaagctgtgacatgttaatgatgtagtttagtgtccctaataaagtcacatgaatgcttttcttaatattgtggggttttccattcaaaagtcaaccatatgattgcatatgtgctgaattagactttgtaaagagattatatagtgtcttcttgaatgttttatctaataaaagaaatataatggggtctgtgctacttctggccgaagcaagacaggtgagaatgttttttgtttctattaaataattcaattgctgacagttatctctttggtgtagaacataaaaaatgggtttaaaaatactataaggaaggaagcaaactattagtagaatctggatgaccaaaagatgtcttttcacagaactgtaagtcaaatctttctccataatggacgtacaggttcttatttttctcagatggcttacaaaagagtagtatgatgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccattggaaacctttcaggaaatagatactcatgaaaggcatggcactgcacacaagtaagtttgcagtcacaaggtgtgacaggtagatgtgcgttgatgtttttttacctatttttgttaaaaatatccattgagagagagtgtttccaaaaacaccaacaatacaaaggaggatgtaaatgattggtaaagccatggaagagatcatagatggttgaatacatgttgtattgttgttcatttatgtcaggttttcttgaattttgtcacaggagctagaatagaattgcagatatttaatattaaaattatttttggtacagtatttaagctgaatagtttttaaaaaagaaaaacattgaattaaataaaatagtaacaaaaatgtattggatggaacgggaaagtatagatggcttcttaccttttctaatcacgattgtccggttgaaataaagacaaaaagttacttattgtgatggataatgcctttgtctgaaaaacaaaatttgatgtgaatagttacatgcctgggatttataattttacttagagaaatgtatagttcttagattgtaaaacaatttgtaagtgatgattgatttttcctagaaatataatttaaaaaattttaaggcacatgtaaccaattcatgttggccaaagtattacagaagtattttgcggccacaataatagagagttgactggtttttaattaccacattacttatatatagttttcaaaatggtgtctttttgtggctaggctaaaacactcctttataacctaatactattagaagagtctcttttcatatttcagaagttaactcagttctacatgaacaaaaattcaggcaagatcctgaattgaacagaagtatagcaaccaaggacagactccaaaatcccagggtcattaccaaagaatatttaaaatgtcctttcaaatatttaatgttaaactgtcatacttcaataaaagtttacacatgtatgtcaaaactgtagttacagccagatgtggtggctctgcacctgtagtctcagcactttgggaggctaaggtgggaggaatgcttgagaccaggatttcaagaacaccctggacaacatagcgagaccctgtctctataaaaaatacaaaaactagaccgggtatgttggctcatgcctgttatcccagcactttgggaggccaaggccagcctgggcaacatggtgaaaccatgtctctacagaaaaattagccaggcatcctggcatgtgcctggagtcccagctacttgggaggctgaggtttgaggatcagttgagcctaggagttcaaggctgcagtgagctatgatcattctactgcactccaggctgggtaacagaaagagaccctgtctcaaaaacaaacaaaaaaaaactgtagctgctatgcttgttggttagagtgtccttgtgtgtaatttgctatctgagtttttcagaggattttttttaaaggatatgatgttttaatcacaacataaatgctggtttttacttttttctgtcttatatttaaatctttctcgcttcaaagggtacacatgaagtgctgaagaatcatatacaaactgcttttattcttatttttctccttatttcctcacttctttcaggtgagaataacaaaagttactggattctggtcaaataagaaccatgatctctattcagaatgtgccatattctctgtgttcttcaccatagccttctgagcaccacattctccactctttcatgatctagagcaaggtttctcaatcttctttttaatcatgttctcttttgataaacataaaaactgtaccatacacaaccctttgaaattcttatatccccccagcccctcagggcaattttactctctacccccttcagaattatggtttgatttattttctgcatcttggattacagaaattggggttttttttcaaatatgatattataattttataataactttttaaaccaatccacacccaaagtcttgaaaacttgaggactgtgcagtgtctgtgggtttaaataacaagattcttaattaatgtttaccactgtctttataattttatttctttgctatttttatttagaaaacagtccatatgcttcattgtaagtttgtatctgaatctagtgcaacctgatgaattataatctggtttcagttagtgtagaccctggtataaatatataaaacctaatctgtaacttcaccagttcaaaaatcagtcagacagtgaaatgagccagtttatttaagaaaaaattatctgctcacagtaggttttgattttacataaggattggagcttccttttatgatgctgttaaagaaaagcagtagctcctaccttgtgcagataatgcatagtatactaaaaactgcaaaggtaatggtgcttctgtatgaatattaaatgcttccaaacaaaagggacatagacttctgcagaggctagctttatcagacagaagttgagtctctgtaggactctcagtgtagcagtcaacaactaggtcaccatctttaccttcccaaacttgtatctactatgtacatctccttcaaaaataaacttggatcataaaactactagataactattttccagaatttggaaagtactattaagaaatcaaataaaaattacatgttacagatgcaaaactggtctccagaaaatgtctctaagtctatattcccctcaggagaatgtctatctcaagtcactcatgcatacattttgtctctgctaatttgacaaatgaaaaaagttctacaactcttaacttcagttactaatgactgtctacatagttaatatgctgactgcctttcttaatgatcagctttcaaaatttaaaccattaggtcctgtttatttttatagagtttaatttttaagctaaaaatgaataataatcactcttacctgtatgagtagtttatgccaactaaggttatattgttcagggcagtgatgccaaatttcagacttaaaattctctgatcttcactcttccaatatctttagtcagtgtgaatagattcttgcatgacaccaactacagtgggaggaaaaggggaaattaaacagaatattgaagaaattcaatagttatggtcaatgtggcaactgcctcctcaaaaaaccctcatttctctatttctgtagtgggaggaagtggtgaacaatatacatattatacttccttatgattatttcatgaactagttacactccagtaacctttgtttgcacgattgactgaagttaagttcacaggtttaatcccccatggccagttttatatgacacagtgatagaaggagccactctgtagtaacccaatacaaatattggtgcaaactcgtttgtaaaattgtttgtggatggcttatttgcaatccatctttatcaaaaatagaaacaaaactcaaagttttcttataacttactagaatcaaatattatagagctaaaatagaacttcatgatcatctgtggactgagaccctttgttttaaagttgaagaagctgaggcccagaggaactcactgtaagcacagactgcacccagggttgggtcccagtttggttactaatgagttaacccactctgtttctaattgccctgcactatctccatttgtcaacataatacactgtttggggcatttcataatggatttggcaaatcctgggaagtgccaagtatgcctcagatcaaatgaatagttataaagaattgtgaaaccatgactagtctaaaacaataaaaattttaaaaataaaaaatagaattgtgaaaccaatttttttgttcaggattgtcgaatcagtctgtgacctactaactaaatgaaagctaagtgtgtacatctggggaggaagacttgcatcaagcactccctctcatccttgagtagttaaaccagtgggagtctgaaaaagagaacagaaatctaatttcatcaaacctgagcattttagttatcagtaaatcttcacttaaaatttacagaagtaccttgccatttctcataaacccgcaatgcttaccttatttcatgtttatttcataaattctctatgatgtttgctaatatttctctccaaaacaaaagtgagaactgcctaaagtgtccagattgtgttctgctgctgttcatctttgccttgccaccatttacttaagaacagtgactcatccagggttacatggccgttcattacagagtagtttggcttttagaattcccatcacttttacttcagtaatgtatcatgttccaggaaggaattacatagaacaaaaaacagttttaattaatttagagaagaacagaaatggaatgctatttctaagtgattgaaagatagttgtaatattatctgttcaggcataagcgtctttggtccgaaaaaagaacgctcttgttttcctccattgtctccaaactcagtaaatgataccatcactccttcagttattcaagccaaaaacttacgaatcatccttaattcctctttctttcacatctcacatctaatcaattgctggtactacagcttctactatcactaccatcattcattagccacatttcatgagagcttactatgtgccagatatctcgctatgtgccttacatccaagtcttatttggttttcacaacaccctgtgaaatgtctcattttaaaggtgaggaaaactgaaactcagaaagatctcataagttgcccaaggtcacacagccatctgtcctcacaggatggtgattggctcacctcaaagcaactaattcaagaacaagtccatagctgcaatgcctttttgtgatctagcctctgaagtcaacagtgtcacttctgcagtattctattggtcacacagagccagccctgcatcagtgtgggacgggtaaatatcaggaggtgatgatcactgggagccatcttggaaactggctatcacagatgtcaatcaaccgttgaaacaaaggaagagtcagaagtactgcttaaaaaccgttgtcagtccactggttgtttattggacaagcatacctggataggtgtaagttttgccagttcttacactattttggtttttaggtctatttttgttaaacagtgtaattcattcaacaaatacttattggagtttctactatgttcctagcagcatgtggaggtcacagaagtaggatgtttagtcacaagctaattgagggtctctggaaattgagcagattccacaagcaagccaagaatttagattaatatgtgatacagatttcaaatgctctgtgaattagagaagggcagaaacagtgactcaaagtggttctgaaaggctttgtgaaagcaaatggaaggaaagagaggagaacataacctagtaagtgacagttttgtgccaggtatgggacagagcattttatgactaagaaccctagagatgtgtggtgggagtcccattttacacgggaggaaattgaggctcaaagaggttaaatagcttgcctagaggaatacaattagtaaattagctttaaaatgacctcattctctgccttagaaagaaattattggttgttctagcaggtcaataagggtaccttatggtactcacaatagggtcatgttttaagtatttttaactttgttcagatagggtttcctgttctgatttatgtatttgtgtatcctgttctagacttgaggtagcagaaactgaccatggaagaaatcaagtccagtttttttctgtctttgaaaactctggactttgttaagcaaactattattccaacaatggcagtataaattctttaggattcagtgattttgagttccccaattgaaatatatgtaaattttattttcattcttctaagaaattaggaaatattgttacaattggtaaaaagagtaaatgtcagggaatactagattaataaagtatgttacaagtattctgtaaaagtggcccctttggacttttctcattcaaatcaccaatagttttctttggttctcattcatcttgcccatccgtctcttcaaggttccccttctattgtccaagtccaaatgctcttggcctaacagttctagttgattcctgtatcatctgccaaatattgatctcctaagtgttctgctgtcacccttaggatttacttccttgaggtgttagagttatgtcctacaattgaagttctgtcttgtattaattttcctgcttttgagatggatttgtgtatcaagtgtgttttttaatctggccccaaaattcatctggagtggttcagtgagagtgtttcaaagggcaggcatatacttacctggcagaggagataccatcatcaaagggcaggcatgtggacatttattttggcaatccatggtgggctatacatagcaaggggacatgagagctttcctgactcacatggattgttggggttagaattagggtcccttatcaatttccctcagagccagaacccagaggacacaggacagcttagtcattcctgaagccatgtgcttcatctagaaattattttaggctatccaaactagtgtttaaactggctgcaactggcctcttaagtactctcactaaccaatcaggagctcagggcattgggaggctggtatgcagaaagagaagacatgactaatttagtacacattagaatatcatattcaaaagataattatttctttaaatcaggggcagtggtaagtaagccttgtccagttcaacatacacccaagccagtggttatctttaggaggagtgagacacagtgcagttactcaaagctatggtttgttcaaggctcactgagccccctgccctctccaggaagtggtgtctggccacagccttgtttccagtcacactgttctcaggccctcaccgcctgccacaagcagctctgatcgtgggtgtcccacccttaatcagagtgtgaagaaaaacctctccttgttctgaagagctggtttctcagcaagcaatgggagcgtttctctcaagaattacttttaaaaacagcagaaaatacagtctgaagtttgtaaatttataataacacagaaaagttatcagcttttgtaaaaagtaaagcagaggttcctcttcgaagactttcctccccatttaattaggaataaatagtaacttctcttagaagtgaaatttattcaaagacctgtgctaacattcttaaatatctgctagccgtgataaagaaatcaatgtactttatgttcttagctcccacaatttagcctaaatatttgccctggcatgcttatactggtgcaagcaagcattgggtcatagcctgttcctcttccttatttgcaggtttttacttttctcagcattccacaagttacttcctccttcttttgttctcctctgcctttgccttttttaagaagttctaagttgctagccaatcgggacagatacagaatgcgaggtcccgttccagccaatggaaaccggacacagcagtagggtggacacgtcagcttataaatgaccctgtctcctttgttcagtgtactcttgtggcaaaactgctggcgagtgtaccctttctgcaggaagtaaaaatggccttgctgagtaaattaaatttatgttcaagtggtatttctttatggtaccggggaacaagcatttcaaacgcttttaagaaaagactaatgacaaaacagaaatggacttggtgagttgaaaaacacatacacaaactcaaagggcattttcttattagtttgcatttccttgtgcatccagtgaaccaactccccaggagttggatccatctctaaattccgctagtaacttcaccttcagtaaccgattgcagcacagctgctgctccaaactgtgggtgaccacccaggaattaaaggttcctcatctcccaaccctttcatcctttgtcttaccaaaccacatgtttccatgaacctgaaccagggccattccagcaaaccccacttcattgacactgagaaagagtagagacaggcttggcttcagctcacctccactagagcactcccactgatcacaaaacccacaccactacctcaaatgctaatagttcttaaagaattccaggaattggccttatgagataactaagattgcctcaggaaggaatgctgaacaattgatttacagccttgttgccacaggccacgccaccaggtggcccattactcaagataaccatagcaaccagatctgctgacctgctttgctcagcccagcctgcatacccttcccctgttaccagttcctgcactttgcctaataagaaagccctatgactcttttcagaaggaagcccgggaattctctctctcttgtgctgcctcccttttgtttgggcataagctccagtgaagctttgtctatgaaagcgcttttggcctcatatcaatttctattgcattgagagtccaagaacccatgatcggtaacaatgccaattgagggtagaaaaaagaaaaaaaatcacacacaaacccaaagtgctttttctattctctcattcaacaagagtctaaacagatgacctctgtgaccaaatgtgtggggatttctcccaatgaacaagcaagcaagcaattcagtggacaccagctgtgtgtcctctaattcagttctattctgacactatctacctggagatagcgtcagatcccacaggttgaaggctgagtccccaagacttcttcctaccttcagatgccagtggcaagccccaggttgtttcacctgtgcttctgaccgacaggctataaatcaaagatcccacagcccctctttgggtccaattaatttgctagagcagctcacagaattcagggaaatacgtttaccgatttattataaagtatattacaaaggatacagttgaagagatgcatacagtgaggtgtgggagaagagagggacgtggagcttccatgccctcctgggcgtgtcaccctccaggaacctccacatgtacagctatccagaagctccttgaaccctgtcattttggggttttatggggacttccttacacagccatgattgattaaagcactggctactgttgattaccttaaccttcagcccctctcccctctctggagggttgggagtagggctaaatgttccaaccttgtcatcctgccttggtctttcctatgaccagccccatcctgaagctacctaggagctgccagaccgcagtcacctcattagcatacaaaaagacatcactttggagtttttgaggattttaggggttgtatgccagacaacagacgaaagaccaaatatatatttcatagtatccagtccaccctctgtcttggatccctcacatcaaaaggatgtacaactcaaaagataccgccaaattactagaatctcattcaatcagtaataatcagtccagcccatcatattgtatgaatgtctcccaaggcgaggccactcaggtttgcaggcttccattcagtcttgtcagagtgctctcggcaaacatatagcttcaccctttacagcagctggtataattaagctaggagacagatatcatttcttgctctaagcctctttcaaggtattaatataatactgggtttctttcatttcataacccatttattctttactctcactactatttttccttatctctataaactcccaaacttttccacctttggatgggacaatagaatcagccactgtgcttatctagattgcaggcaacaatgctagtctagcaagtgctgccccctcagtccactcccattcatgttagaaataaattttcggtgccacaaagaagaatcaaatcagcactcccgcaaaaagttttctcagcaaggcaaattaacttccatagaagcgtgcgtctcgcgggtggagcaatggcgagagcacacagaacaaaggaaagcaggggtttttattcctaatgcaatgagtttctactactgtgtcctgtctccattggatggagctggaccacacaatcgaaactggtcttggttggctaatttgaagtgtgcagggagggggttacactggcgggaagggcagttttgggggtaagagctgttatggcaggaggggtaatttgcagagtgagtgactaagggcaacgagcaagaaacagctgtggactatagactggcgggaaggttgtttacttcagtcaggggcaaggagacatgaagaacaaggaagttgagattgagaacaaagaacaagggagttaacatgccaaacttttgaagagaaactgattgtatctgacattcagatagagtaaggttccataggcacagcagaacgagtgggctgtttttaccaccagggagtatagctgcatttattgttagccccaattttgccagatgggataaggcacaagccaccccttaggagtccaccccacaatcagacccttaggaattctgactcaaagtttaaaaacatagttacagtttcttacttaggaattgcccctgcttccagcacttgtagttgcagccctggtcctaggaccaatgcatcaggtaggggaaatgtaaaaaaaaagttgaggtgatgtgggaaagaaaaataaagagtgatcattataccagtgtactcctcccttagcaagaaatgcatagtcataccagcatccttccacacctcctcttcccggatacctcagaaaagcggagaaatctattgagtggggaaattcccttagccccactcatgttgaatgtgagcacacacttgcgaaggcaaataaggcagctcttcgtgctttcatctccctctgttttagacaaccagtgttttcattgcctgttccactctctatcaaaccgttactctgaggaagatatctctctgcccattgctgaacattataggctatataatgtgttcctgggtctgaagaagtgacagccatccaaatctgtgcaatatcttctgctctagcttttatggcactctgagcaaactattattctgagaagaatatctctgcccactgctggaacattatgggctgtaccgtgtgttctttggcctgaagaaatggtgttcagctctccaaatatgtgcaatatcttctgttctggcttttttatggtattctcatcattcacatcttccaccgggcaagcaaagcccagtccagaatcagtgtctactcctgtcaaaacccatttgtggcctcccagggctaccagcatcagcctcacttgccagcttgttcagggctttcccaccagggaaatctgccccacagccatgggcaatgtctgtctcttttgctggcagacagaacagtttttattggcattttgtgcctaagatggtgcaaaagaaacatgtctaaatgcagcctatctctgcactgttgcagtacccgtttatccactcatttcacagacccaggtggccacttcaagggagcacccagggttgtctgcttgtgatatcaatcactttctgaaccaggatcttttttttttttttttcaagtcagagttttgctcttgtctcctgggctggagtgcaatggcgcaatctcggctcgctgcaacctccgcctcctgagttcaagtgattctcttgcctcagcctcccaagtagctgggattacaggtgcgcaccaccatgcccagctaattattttgtatttttagtagagacggggtttcgccatgtcggccagggtggtctcaaactcctgacctcaggtgatccacccaccttggcctcccaaagcgctgggattacaggcatgagccaccacgtccagccaagaaaggagctcttctgatgggcattgacatgttctactttaatgcactcctcaaatttccatagggccattctccatatgggcatccctttaataaataggccaggtttccactgcccttctgcctgaccatgtggccaggccactgagtcagtaaaaaaatcaaacacaggggtttttgctattgttcatttctgcagaatgcaattcagccaccaagctaatttggtcttaccttctttgatcaagagtggcatccttccaaacaagattgttcaccttggaactgtcatttacacaccaagcaactctttgttggtcagttgagagctgtttacggggccctgtccaagtctcagtagaatcccgcagttcctcacacagttccagagtcagtcctaggggaaaagaggctccctgcatgagagtatttcctctttgcacttcccagggaggatgctcctgtataaaccatttccattttattatggaagtgttctgggcactgccatccccatttgaatgtttctctgacatcatgtgagaaagcatgggtatttcaggtgtcaagatcattttatgtccttcagtcataggggttaacttcagttaatgtcccatagcaaggtagtaaatacccccaagtggaaattctctactgcaaagtcccagtagttgtcactgggagatgctcacagacttctgagtaagccccagtaaacgctgacaaaggggtagcaaatggagaatttgtccctatgatattccagcttctattctacagattgtgggcttgggtaatcttactggtttgccatttagcatgttcaattaatattgctacaagggtgttttacaatacaaggtaagagaaacattccccagtcagacacaatatccccataatacagtcaagtgaaagagatacaaccacttcatgtaaagtgtgttcaaatgtaccaacttaccttaattttctcaatgcttactttcctaactgtagcctctattacgactttaccaacaggttttgagtttacagtactaggtaggggaagtgttccccacccagacataatatccagttccatcaaacattcaggtaaaggagacataacttctttacataaagcctgtttataaacattctaaatctcgtattcctaccaacccttactttctgtcccagtcccagaatttctcttcttcactcccagaccattttaccattttctccttagaaaaaagctttgaatccccagcagagggttgagccaagggaccttagcccttttgtcaatctttgtcttgattaacctgcctcaacactgctccaagtaattgttggtcagctttctcattgtaatctcttcctctcattttttcaatttctcctaactgggataaatacaccaaacctgtttggatcctcttaccgttaggagaacagcagaatctccctaccaaccttctatagtgatgacctttgttttaaccccatcgatttccactttattcatcccattttttaatagccctctaaagactctaccctgcttagatgagtcccatgactctcctttctttttcctcttagtttcaccccatcaatgttttcttcattcaccttatttctcaataaccatttagactttccaccttcctgggatgagtcctgtgactctcccctctgcctttccccagtctcttgttaattacgctcatgttttcattggtgcccatacaaaagaggctcccttagccatagcatttactacagccagagtaatggatgtattcagtgagtgaatatctcagtcatcataaagccagtcccacatggtctacataggaagcaaatgagctgctgcttcagggtacaccacttggcatttataggtgaaattggacagtccccttctcagggtaaacaggtccagtccaccacgctggccattcccttggaaataacctcctgtgtgtctggaaatctacctttccatctgtgattgttcaataatgaactgcaggtcctacctcaaccaaacatgctcttccactcttgagcatttaaaaccaaagaaactgctctgacagttccttcacagtataccctccagtttcaatagtttatcagttttaccctttccccacattgactacccttcttgataaccacaggttgtgtaactgtccagtgggttcatcttgcccgctgtctagacagagctgatttatcaatacagggaaattgcaatagaaaaaaagtaattcacgcagaaccagccgtgcaggagagcggagttttattattactcacatcagtctcccagaagactcggggatcagagattttaaggataatttggtgggtagtgggctgtgaatcaggagtgctgattggttggctctggaatgaaatcatagggagtcaaagctgtcctctcatgctgattcagttcctgggtagggggccacagaactggttggcaggtccaggtggggccatccagttgttagaaatgcaaatacctgaaaagatatctcaaaaggccaatcttaggttcacgatagtgatgtaagttgcaaatcttatgacctccagaataatggctggtaacatttagaattccagcccctctcatccgtacttggtggctggtggcctttcattcgttttacaagaacagtttagcttttgggaagggctattatttaaactataaattaaattccttcccaaggctagtttggcctatgcccagtaatggacaaggacagtttagaggttagaagcaagatggagttggttaggtctgatatttttcactgtcataatttccttagttacagttttgcaaaggcagtttcaatcgtaaaggtacttcagtgtccttgcataatttttccttgggggtcagctttgaggctagtggcctgggctcagacagacaaagtctaacctagcattctcctttaatttcatttagctattagagataaacaccaaagaatttagtatttcactttttcatattagtctgcataccctcatgcaaccagtgaaccaactccccgggagttgcatccatctctgaattccaccagtaacttttacctttagtagctgattgcagcacagctgcagctcaaaacagtgggaaaccacatggccacccaggaatcaaagattcctcatctcccacctttttgacgcaggatttttcttggccactttgccaatcagggacctccatggccagcaacgcccccctacctggcctttgcttggccatgggcctgctgaggcgtcaggcccactcaccccacctgtgctatggcttgtacctgcgttcagcagttcccaagctcctgtccttatccacgaagaatgaggatacgctgacaatttgaagggtgaggatgggtagggaagaattttattgagcagcagaacagctttcagcagagaggggacacgggtggcccccccacccctgcagtcgggtggtttgtctctctcagtgtggctgggtccatggtattttatggattcagaatggggcatgtgtgctgattggtttgtgagtatgcagaaaaggttaaagcgaagacaccactcaaaggtgggcacaacagtgtagaaaaccaattagggaagggtaggtatatgtaaaataggtgaggggcggggatcaatcagaggaaagcacaccaaacaggaagacaggttctcaatccagtccatggatttacccgggacatgtaggtaggctttaaactgtcttcagcttgaaggtcaatttcactgaggactcgcccctatctgtctaggcattttgtctgcctcctgctgctgtcactttcattctttctcttcccaaaccacatgtttctgtgagccaagtccattctagcaaaccctacctcactgaaaccaattcatagtttggaaggaaaacaaaactcacaaagtacttttctactctttcaacaacaattaacacagatgatttctgtgaccaaatgtgtggggatttctccccaaccaacaagcaagcaagcaattctgcagttgacaccagctaggtgtcctctaattcagttatgttctgacactatgtacctagagatagcatcagattccacaggttgagggcttagtccccaagactggcccccacctttagatgccaatggctagccccaggctgtgtcacctatgcttctgactgactagctataaatcagggatcccacggctccctctttgggcccaattaatttgctagagcgcctcacagaactcagggaaccagttacatatacccgtttattataaaggatacagatgaaaagatgcataatcctggggcacggagctttcctgtcctctctggacagaggcaccaccatctgggaaactccacaagttcagctatccagaaactctccgaacactgtccttttgcggttttatggaggcttcattatgtaggcatgattggttaaacgattggccattggagattaatttaaccttcagcccctctcccctccttggaggttggggatggggcttaatgtcccaaccctctaatcctgcctagtctttcaaggctaccagcctcatcctgaaactacctaagggttccagccatcagtcaaccattagcatacaaaaagacatcattctggagtttctaaggattttagcagttgtatgcctggaaagagggttgaagaccaaatatatattttatagtatcacagacctgatcatcaaagtttcactatccttcagctttggcttttggcttttcatataagcttgagtgtgctggctaaacattgtcttttaggaatgcacagcatagaaactctagcgacttcagtggcagtcataagaactggaatcatttcaggggtggtagttgaaaagcagacaggaaattagcaggtttagaataggggagaaactttagcattgaattacgtgaggcaaaaatatatttgagggacaaattttgaattttgacatcttcaaatcagtcaaacttggttcatattatgcttcagaactaaccattcttttctgtagattctttaaaaagccaaaagtagataaagatttctatgaataaagcagttgaggatagaattccaaaaataatgctgttccattgtatcaccccaggtacaaaacacacacacacacacacacacacacacacacacacacacacacacacacaaaatctataccctgggaaacagtgacttggattgcagtgagatttagcgaatttaaaaggcatcatatatcagtgcccagaattctccacttcactgtctctttctagggccaaggtttcctggccattttattaccaatcacttcttttgaatttctagatacaattgtcttaaggtgaagtcccctgctccatgtaacttcctgtccttaatcaaggggaaaaaaagagatagatgtcaagggaagagaaagaagaattgaatatctcatgtcttccctcctatacccattagtgtctgtattcattttctcttaagcgccccaagcatgaaagtcacaggtttctctgagaaccacatttagaaaattaataataataagtgacagccactgatctgcttttatatatatattcatataattttagaaatatctctgagatagattctattattactgtcactttctagatgatggatgtgggtccacagaggataacttgcctacagtgataaaactgctctattataaggtctagatttgaacccagatagtctgactttagagcccacattctttactgttttatatggactctcataatatatgataatactcaatagaatctagtttattgctttaaataaggagaccagctatccccaatgaccaaaaatatatctcatttatgtacttgtttccaattttcaatctcgagatttattaactcctgccaactctccactgtaaaggtaccctgttttcattgtaattgataagtaatctgaaggtgatattttaagactctatgagtatactgtgtttccctttcacccactggattttgacattcttcgatgattctcttcttgcctaaatcagctgtttccttggtggtggcatcttggtaatcttttggtgaatggatatattagatttgaagtagtccttttaagacatcttttggtgagtggatgtattacatttgaagtagtccttttaagacatcactctaaacaagtcttgttgttttatattatttctcaaacagcactgtatgtggcatagtttctaatattttcatgttgcctcttcttccctttcctctatcaaaagccagcctaaaaatgtatggttttaataaacctacaaataaagtattgaacttggaagtataagttctctagagttccagaaatatctggagaaaaaaaaaactggaaagaagaaacctgcgttaaattttataataacactgaaaaaagtctttaagagggtcacttttttaatagtgccttggccagcagagggtaatatattaccagccctagttaaaccacttttgctgacgcataaactgcccacattgcactattttccagctagaaacataaagcaatagaaaagtttggggattttttgaagctctaatacaacaataaatttcttttagtagctgaaaaccactttacacatgatagaaaaaaagtaattgtatagacaatggatttctgtccttaagatgaaagcccggtgccactcatctgcccttaatagggtatgtcctttagggatagtttttgttttgttttgtactagtgattatcacaagagttacttttgtaaagtattcacaactacagttatcctagtggtagaaagaaagtcttacatttcagtatgtgaaagtttttattactgtatcttttagtttttctttaactttttttaatcatagaaattgatggacatagttttaaaagtcaaataacactgaaaagcttgtaataaaaacatgttatgtctattaataaatgtaatttaaagtattttcacctaatgaagacagtataggagaaatcacctctatcctcgactatagtcacttcctcctgtcagtgtaacaacttacgctacatatcccttccacttaagtggtaattttttttttttttttttttttgagatggagtctcgctctgtcgccaggctggactgcagtggcgcgatctcggctcactgcaacctccaactccctggttcaagagattatcctgccttagcctcccgagtagctgggattacaggcacgcgccaccacgcccagctaatttttgtatttttagtagagacaggatttcaccatattggccaggatggtctcgatctcctgacttcgtgatccaccaacctcagcctcccaaagtgaagagatagcttataataaccattccctctttattcagctctcttcatcagggggagcatgtacttgtttttatctcctagaacaagtggtttgttactaaatcttcagcagctccactactccctgcccttcattggtttggaaggtacattctgtctctctctctttctctctctcgctctctcatgcacacacacaaagctttcaagtaaaataactcaaggcattgtcttttttgttaaattactatatttattgtcatctttttagaaatcagtgctacacatattcttcatttatattttttatgcatcatttatctattgctgcatacttaactacccctagacttggtggcttaacacaagaaccatttattcactctcaattctgcaatttgttctagactcagctgggtagttctgtttgtctcacctggtggtcattcatgcagcttagtcatctgtcagctcagctgaggctagctggttcaacatggcctcactcacgtgtctggagcatcacctggaagagttgagcaggctgtgcccctctctccatgtgatctttcatcctgggcttctttacaatgtgatggtctcaggttccaagagggcaaaactggaagctgcaaggtctcttaaggccttattcaaatgtcatacaatgtctaccacattttattggtcaaagcaagtcttaatacctgcccagattcaactgggaaagtagactccacctctggatgagaagagtggccaggaattgggggcaatttttaatctaacacatttccttggatgtgctttcaactttaatgttctaactagacttgttatattttctccttgaaatgcagtgaattggctctttctttagggattactatagtatgtgtatctcagagttcgtagtttcctgggtaatattcctaaaagaaaaggaaattttgctttgtgagagatacccaccctgtcccactttggtcttggagctgtcatgttgttttggttgtttcttgtattaaaaggtatattcagtgtgccatgaatccagctgggtacagtggcacttgcctgtggtccctactacgtgggagactgaggcaggaaaatcgcttgagcccaggagtttgaggctacagtgaactatgatcgtgccactgcactccagcctaggtgacagagtgggactgtgtctctaaaaaaaagtatatgtgtatatgtatatataatatgccatgaatccatgatgtttcctttgtgctttttatcttctataaatcctctccctttaccttctctttccagaatattaatctaacttttcaataaaaccagaagaaaagtctgttgctcttgcttcccaatagctagtttgatcctgagagctggataagttcattgacatcttcaataccagagcttaaaaggatgtagaaagatgattagtctagcatggtggggtagctttccctcctaccatgcttattccctcctaccattattcaaggtttcattattttcaggatcataaatgtcaaactactgggccatgagacttgcattcacttacttagctgcatcctctccctacttgccacatctttttggaaccctgtaatcagtccccacaagagctgaccctgtgtgttcctgtgtttttcaagtttcactagccacaaaggggaactgaatatgaacatgcatgcaaacctcaccagttccctttgcagccagctgaaagttatttttcatgtagaggaaacagtgtttttcttttgagaacaaactgaatttccacacaaatatgaagtgtttcatcttctgacagttcagaggacccaagagaagagggcaccaaattgtgagaaaggccattaaaagagaaactaggaaaacaaagagacaaactgaattggggaagagagaggtgctgctgagtacaggaaaggaaaaaagcagaccacggggaggggtgccggggtgctagaaagtctcaataagtaatggcacacaggacaaggcaggaaatgtaggaaggaactgtctgcaaagggcctataatagctatgccagcagtattaatggaaggcattaagaacttttggtttagaaatttgctgttggacaaaatttcaaaatataccacatttacgtgattactgggcctgcctgagttcatgctatggagccaggtttagatgaaggtgccttgtcctcacttcagaatgcaatatggtgacctgtttggtgtctctgattagacggagaaaaaccaagaatcagatatgtattaacatctcttctaattttttttttttagaagatctctgtcacccaggcttgagtgcagtaacatgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcattcacccttttaaccagtcttttatgctgcctctcagtttgttatttaataatgcttaatattattgggataagaaaacctattggattcagccttaccataattcttgccatggccttaatgatgggaccataataatccgtatacattggccaagatcaatcccctggactgtgttggatgggcaataccaacatttttctagcactttttttcttctaattttccctcatctcctagtgaacagccaattctttctgtagatatgctaatgcatttaatcaggtcatctcctggtctaagagactttctgtctctgaagttgttttacatatttgtactcaggtatttggattttgtagttgaactcttagaaaacatttctattttcatgttctcaaggaacacctgatttcgactcctctatactatttataactgaaataccaagctatctaattataagataatttcatctgcaagttctttagcttggtccttgaggaatgcataagtgccagtgtttatttcaatttattgattagaaaaatttttagctttgcttctagtgtctgacaaaagaaaccataagcaaagtaaaagacaagtgcatagtgttagaagttatttgcaaactatataaataacaaaggatttagaacccagaatatataaagaactacttcaacaattttttaaaaagaaaaaggaaaaaaaaagataagcaactcattaggggaaaagggagggggaggggtatagatatgaataggccattcacccaagaagaaaactgaatgagcaaaaagtatatgaaatgatgcttcatttcactagtaatcagggaagtgcaaattaaaaccacaatgagataccatttcatacctaccagattggcaaaaattagtaaatctgataaaaccaagtgttggtaaggttgtgggtaaacaggaactcatttctgccttgtagtgagatgggcatataaattggtaaaatcactttggaaagcaatttgtcaaaactgagataagctgaaaatgtacatacccttacaaccaagcatttctgcttttaggtgttagccataaacttcacacatgggcattgggtatacaaaagaattcacttgagcatggtttcaattagtggaaaaagtggaaaccaccaaattgcccattgttaggggaaatggagaaatgaaccattgtttattcatgcagtaaaacactacatcagtgaaaatgaatgaacaagacctacatgagtctacatagataaacaaaatttgagtgaaaagagttacaaagaatgtaatagtaagataccatttgtgtaaatttttaaaagaaaaagtgcatattgttatgcatatgtatgttgtaaaagcacaaaaatatacgtcagagtgatatacaccaacttcaggaaagaggtttcctcagggaaggatgtgaagtgagctttaatatatctaacattttggatgatgtatacgggtatgaaaaaacttttaagtaaaacgaaaatgttaacatcttttcaattggggtgatgggtacttagctgcctgttatgttgtgtttttccatttttgtatgtttgaaacgttttataactaaaaactatttatatgtgaaattaccaaaaaagaatataagtgtaacagttaactgttgctcccaaaaaacttgcatgacttattaaagcaaaaagagattccatgtatcatcaacacctgtatccaaaccataattagaaggcctttccatcttctgatggttctttatgcatttcatgggccagaagcaaaactaataagggtaggatgctctaatttgattccattttttttcttctattcaacctgtatgagtttgttctggattatcgtacatgtttcagagagagcttccagagtatataaatgtgtgatggttagaagactagttttaaagattgttttttgtttttgtttttgtttttgttttgagacagagtctcactctttcatcaggctggagtgcagtggtgcaatctcagctcactgcaacctccacctgccaggttcaagcgattctcctgcctcagcctcccgagtagctgggactacaggtgcgtgccaccacacccagctaatttttgtatttttagtagagacggggtttcaccatgttggccaggatggtgtcgatctcttgacctcgtgatctgcccgccttggcctcccaaagtgctggaattacaggcgtgagccaccacgcctggcaaagattttgtttctttggcatcacacaattatgatgagtggtaagcagaaatttttgcccccaatacatattaatggcaatttatgtttttttattttattgtaatttatttatttatttatgtttttgagacgaagttttgctcttgttgcccaggctggagtacaatgacacaatctcagctcaccacaacctccgcctcccgggttcaagcgattctcctgcctcagcctcccgagtagctgggattacaggcatgcgccaccacgcctggctaattttgtatttttagtagagacggggtttctccatgttggtcaggctcgtcttgaactcctgacctcaggtgatccacccaccttggcctcccaaagtgctgggattacaggcgtgagccaccgtgcccggcaaagattttgttttttttgacatcatacaattttgatgagtggtaagcagaaatttttacccccaatacatattaatggcaatttatgttttttaaaataaaagacatctcagcaatcaccattgtgcttggacagaactaaacaaaagtgaaaagcattagcagagacaatgtcagtagaatggaagtctaccaacttgcatccctacatatgtaaaatacagttgctgcttacatcacaatgccatgaagattaactgatgataatgcatgggaagcacctagaacagtgaagggcacataaataaacaaatgttactttgcttcccattcccttgcatgtgaacttgaagtggggaaataaaaggaaaaatagaagtttcgaacaaacttactacctcctttccagttctgtgctcactgttaccatccccaaccagctctccaagtcttcatctgaaaacatggactgactgaggcactatggcagccactcagctgggccatgtagctatgacagaggacactacatcatccaacatgggaatgccgcatagtttatctctcgtctgagttgacataattcagattatattccgagtttcaaatcttttcttccgattaaaaatacccctacaagcctctttacaagtgaagtttgtttgttggtggctgaaataaaaggctctccagtaaatgtcatatctgttgtgaatatttttcctgctttgtacttttgcttcagtttttatggtttgggacaaagaatctaaatttttaagtcaaatctatgaatttttccctatagttatttctattattttgtttgaaagttctttcccatctacagatgaactagtcattttttaatcttttatggtctcattatttacacttaattcttgagtgtccttataaattttggggtatgataaaaggtaaggctgtaaattggccttttattttaaataggcacagcactattatttattaatccatcccttccttcctgatgctttttgtgatgtttcctatatatgcagtgattttctctgagggaggagaatgtatgggggtcacctgagctttgcaaaaacacacttaaccccacctttgcaagattccagcacatcttgactaacaggaaccttttttttttttttttttttttttgagacggagtctcactctgtcgcccaggttggagtgcagtggtgcaatctcagtggggcatggtggctcaatgcctgtaatcccagcactttggaaggcaaaggcgggcggatcacctgaggtcaggagttccagaccagcctggccaacatggcaaaaccctgtctccactaaaaatacaaaaattagccaggcatggtggcacgcacctgtaatcccagctactccaaaggctgaggcagaagaattgcttgaacccaggaggcagaggttgcagtgagccaagattgcaccactgcactccagcctgggtgacagagtgagaccctgtctcaaaaaaaaaaaaaaaaaagtcatatacgtattttgtacttttctcatatatcatctaggatctgcttagacatgtgtattcagttccacagataagtttatccttgtgtctgctccccagtgttatccttactgaaggataagaatatattttaatatctgataaagtattatattttgaaaacctaaaaaataattagcccattaacatgttgctgcagcatccaggttgcttgttgggagaactctcttcatattgcttttcttttgtgggataactttcagtaagtctttcgttcaaatagttatattacctctacttttatgtcagcaggaataaagaatccattttttaaagttgaaaataaaactgtactggaagaggattgtctttttctactgacctaatcttagaaattcaaccaccatcaaacctggctctatacagcatacttttctaaaactaacagcaatattcaacactgaggtctcactctgacagccagacaattcattttgcccatatttggttttgcatgtatgagatgttatttagaaagctgttctgaaggtctttgcaaggtaaagatacgtatatacttctgaatttccttttcctgtatgcttctagaactaaaccttgggttaggagaggtaggaactgtttcctgcttgcaaatactaatgcttagtaagaaatgaaagattatatgtcataagtagccttaactttggtaagacagtagcatattttttctaaaaatttagaaaccttctcaggattcaagttactctaaggcatgttatcagatttctctcagtaagcaatctgttataaatagacagattgatttatatcaaaatgtattttattccaaataatatagcaataattaattgagtatactttaaaattttcttaagaatgccattgtgcagagctttatagtaatcatctagtataatgagacagcttctagaactatgagtgtatttatattcattttaatgtcccttaaaagtgataataattgataatataatttcaccaaactgtatacaatgagatatgtaagatgtttaccagtaatgtaaaataaatttttaagtttgaggacatgaaggaaaatagaagttttcataacttaaaaccatacaaacagaaatgctaaatttcatttagatggtatgtgttaacattgtcagggcaaagtaattaatataattttgtcacctttttctgaccctctaatttttctgcaaatttcagtatttatcctcaaatattacttatttttaaaatatacttttgctttgacttattctttattcagttaattatatttgcgggcacttattgaaatatagttaactggccgggcgcggtggctcatgcctgtaatcccagcactttgggaggccaaggtgggtggatcacttgaggtcaggagttcgagaccagcctggccaacatggtgaaatcccgtctctactaaaaatacaaaacagccggtcatggtggcgggcgcctgtaatcctagctacccgggaggctgaagcaggagaatcacttgaacccgggagacagaggttgcagtgagctaagatcacgccactgtactccaacctgggcaacagagtgagactccatctcaaaaaatatatctatatatagttaactgagcactgtatacaagccaaatctcattaaaataaactcagttctgatcaaaatcttcatggtcattcacattgatttctcagccaatggcctaccttaagttttaagaagtattctgactctaaaaaaattttatacaccatgatagaaactttcagatgagtccttggagtttgtcctaagatgcttttacataaattcagtcaataacattcaggttctgtgtatgaccaaagaactggacaaatgctggccaaactttcaagaatgtttgcctaatgacaccccctagattgcaactgtatggtgttctatacagctatattcaaatggactaggaaaaaagctaattactcccaactttttttcttgtaagcaccccttccttccctttctccctatcttattcatccgtccattcttcttaattattcaataaatgtgtattgatctcctatagccaagaaacatactaagctccagggaggcaatgacgaacaagactaagaccgctttcttttagagcttgctgtcctgttattttttaatgtacatgaaaattgcagagtttgctccttttaattctaatttgcaggtttttattgttgtaaagtatttcaaatacccaggagtttaccaaaaataatataatcacgtgcctactacctagatttaagacattaacattttgccatatttgcttcaaatttctccagatataaccattaagttggtatgtatcttgtatatattatcatacatgttttgtatctttattttatatgtattgatccataagaatgtggtattgttttctaccaggcgcggtggctcatgcctgtaatcccagcactttgggaggctgaggcaggtggatcaccctgaggtcaggagttcgagaccagcctggccaacatatgaaaccccgtctctactaaaaatccaaaaagtagccgggcgtggtggcatgcgcctgtaatcccagctactcgggaggctgagacaggagaatcacttgaacgtgggaggtggaggttgcagtgagccaagatcaggccactgcactccagcctgggcaataagagtgaaactctgtctcaaaaaaaaaaaagaatgtggtattgttttatgtttttatattttacataaatgatttcatgcagtacatacccttttgcaattttgtggggttttttttactcaacattatatttgagatatacccatgttgatgcatgtgagtgtagttcatttcattgcatcgctacatgatattccatttcgtgagtaaaccagttcacttctccatgcctttgctgttatgtccttatttccagttgtttcgtattatgaatgttagttcactgagcatcattacatgtttcttgtgtacgtatttgaatgattctgtaagatgtataccttgtagatgacttgctggatcacagaatatgcatgttcaatgttactttatcaaactgtggctgaaatgaccctattgtttataaacctgttttaagtaaggtgtggttttaagacctattgctaggctattgaatcgttagcttatctgttaatttttactatacagtatttaaattctttccctttttatctaagcagtgatagatagtgggtgatctcattttttaattaggattttattaattatcttttcatctgttatagagatttaggcataaatgaatacagtggcaaattatacaagattttaaaatgataaatgaacatatattttctgacacattgtcagttcccaaatcatttacttttaaacacacttcaaattagtatcaagtgcttgattttaataactactttagtcacttgagaaactatggcactttaattattttgctgttagagccataaatttcacttaacttcataatctatgttaagagtattagcttaaaaatgtattttgaaaagattttacatacagatttaaaagttagtaccttgaaatggtttacagttaagcaaatgaaatatcacaaatacaagcagagctttgagatctgagttttgtaaatgctagaactttgtttcctaattttttagttcttcaaagaattaagaggctgcattatataattcattttagtatgtttacctcaagtacttttagaactagactgtattttcactgccacagatgtatcatgcagggagtatcctggtttaaattctgaagtgctttcactcctacttggttcaccttgaaatcgtctaaaaagaagttggcacattattttgcgaatgttactggacatcaggaaatacatgactggatctaagcaactattgaaagatgagagaaccagcatgatctcattggttttgtgaacaatttctttccagtagcaagatgatacatttagctgtgaagaaatgtagatgaatcgaaaggcatgatagggaacaaaacatatagtaaaaatgataagtacaataaaggagttacgagctgtagtggcatatttaccagaattaggaaattttgacctccttttagaaatcctcaatagattcttcccaatcttaatatatgaaaggattattagtaagaaaattagccagaacattaccacaagaatgaagttaaaaatggcttctccttttgcgttatgcttatctctgtaatggaaacacattgtggaattatgccctcctttcttaagtgttaaaataatcatagttaggaatccaccaagagcaagcatccatactatacaacagacataaatactttgtttggttgttattgccttccgttgctgtatagaccgattaatttttatatagcgatccaaactgatgaatccaagcaaaataatgctaatgtacatgttcatataaaacagtgttcccacaaccttgcacagaatcacacctagtgtccacttgttttggttaatatgatacattattcggaaagggaggcagaagatgagtaggaggtctgcaatggctacgttaagtagataaatttgaatggaatttcttttacggtgaatacccagaaatacatagagggcgattatgttcccaaccagtcccacgatgaaaataacagagtaggatgtggttaacacagtagatagcaatttttcatccatgggacaggtagtaacatttggtgttgctgagaagttttgtggcggttggtcgctatgattggttataaagcgcattctgtgggaggagtaaggccagctgctgactgaagttgtcgtcattgttatggtatgacttctcattgtcttctgtggagatcaaaaagtgaaagtgctaaatgacatattcctcatgtgtagttcttatgtcttcagatttttcctacaacggaatgccaaacattgagtcatttgctattttaataacagttactttaactaaaagtgtaaataataggctgggcttcccagcacacgcctatggtcctagctactcgggaggctacagcagaaggattgcttgaacccaggagttcaaggctgtagtgagctataattgagccactgcactccagcctgggcaacagaacaagaccccatctctttaaaaaaaaaaaaaaaaaaaagacagtgtaaataataaatgatttattttcagacattgcgagaaactttacttttatcctactgtatgtagtaacattattgtatcattaaacaagcagcacatagtgtggtatctcatggagtttcatgctctaacctttcctgtggccatggcctacattgaagttctgtttcatgtattatattaaaataactcaatttatgagatcatcttctcttagggaagttcttatgggaatacagatggtggtgaagagaaatgacagctcatatttctcaaagatgagcatcagtttctctaaaggtatgtacagccataagagagctgggcccactgctggccctgcccagcttcagaaccacttcctgccttgactttttccctcatatgtggcattcattcattttgacatgtattgctacatggcgtgtgacttgtggtggtctcattctataagtgggaataaagaagaggatcctaaatttcttttcagcctaagaccaaggtaggggtcttagggcatgcaattaacataatagactaagagaatacagcacctgcaaggttacacagactcttgtatcactggacaggagaaaaaagtaaccaaacaaaaccaagttagctggcagctgccagttagccactcctaacctagaagcatagagtaataacgtagatgggaaacagcatgtgcaatccaagattttgaaagtaacctgaccaaagcttaaatgtgccctgggttcaataatttgagacttgctagaaccttcgaagagatagtgtttgaattctacttgtttgtggcagcagagaatatttgcaaagctacttattattggcccattgactgctgtaaagagcttagtctgagagctggtcataacaagtaaagaaagcatttctggaggtctcatcacattcctctcatagagtgactgccctatttctctacagcagccacttagcagggttaacataaagatgcccagagcaaggttctcaaaatcagacccaactaacttgtgaccaagggcaaataacttaatcttttctatgccttagttttctcatttgtgaaaatgaaaaatgcataagaagaacttaatcctggcacatagtgactgcttaataaaagttagctttaataaacaccttttgattaatctcattttagtaaatatctcacacttggctaagtactgtgtgggaaaggaaggtgaataagacagagaccctattagtaaacattttggaggagtggacattcaaaccctgactgctaccatgcaaagtggatttgaattacataaattaagtccctgatttgatcttatacacagagaaaaatagcctttcttaaagctctacacataatttgattaaaaacaaagcattttggtagagggtaacattaagatttaaaatgttgtaaagttggggagcattgattccacagaagaggaactggctggtgaagaggaagttatgtaatccctggtaagagcctgtttccagaattcaggaaagtggagggagaaaggaagggagcggggaaggactgagtctagtctgtcatgtgtctcaactgcaggaagacaaatttcagaaagtttatagaaaggtataggcatgtttcttgtgatctaagattctggtttttgtttgtttgtttgttttgttttgtttttgagacagagttttgctcttgtcacccaggctagagtgcaatggcgtgatctcggctcactgcaacctccgccccctggcttcaagcgattctcctgcctcagcctcccgagtagctgggattacaggcgcccgccaccatgcccggctaatttttgtatttttagtagagatggggtttcaccacgttggccaggctggtctcgaactcctgacctcaggtgatctgcccacttcggcctcccaaagtgctggaattacaggtgtgagccactatgcccaacctgtgatctaagattctaaaaggaaagggcaatctagaaagaatgtcaggctaccaaaaatgaaactgataatgcaacctgcattaccaggaaaaggaaaagggtgtctgtagaggaaccacctatattgtgtggttatgtagggagctctcataggttcagggaattgaggcacaagaagtaatgtgattttgagagctcaagtagctgaaatgacgtgaaaaactcacctgtgagtagttattttggattttttttcttctctcatgttagaatttaagttccattaggattaagaaccaagtcaattttgttcggctctctgtacctaatgcttagcataataaatattattaaatcaaagagggaatttagtagaaatgtatatgaagttctacatgtggatattaaaagcagctgtacaagtacaggaagagctttagctgcattaacaaacacaattgcaattgctctatcactagcgtagtgtggtggcaacgaaaaacccatctttagttgaattcctagatacgtgatgtctgaaatgaaaattgttactactatgctgcttctgtcccaggctggtagggtctcacctggaatgcagtgtttgatccacagcagcacacttagaaaaggccatggaccaaatggagagaagaactcaaatcatgtcaaagaagcaagttgaaggaaataggcacgttaccctggagatgagaatgctttacaaagccatagagaaaagggtttcactttgttatatgtgtcttcacaaagcaaaacaagaaccaatgatagaaattgcagagacagatgttgcctccttttaaggaaatcatttttttctaatgaaatgatctctcttgggaggcaatataaggatcttaccactggagatttttgagactaccaccaattgggttctttgtagaagggattatcagtggttctcaatcctggctgcatattagaatcctcttgagggttttttaaagataccagtgcttggctccttccccagatattctgatttaattggtctggaatgggtttcaggcactggtttcctttaaaagctccttaggggattttaatgtgcagtcagaattgaactcttaagctagatggccaaaccattaactaatatttatttagtactttctgtgtaccagacactgtgttaaacacatttatattacttcctttacataattcttgcaatactctgtgaggtaggtatcacaaaagaggtaatgaaagatcaaaaggttggccaggtacagtggctcacgcctgtaatcccaacactttgggagactgaggctggagaatcacttgagaccaggagttcaagaccagcctgccagccaaggcaacatagcatgaacctgtctctaaaataaaaaaaggaagaaagaaagaaagttcaagaggttatgatctttactcttggccacacaactctttttttttttttttttttttttttgagacagagtctcactctgtcacccaggctggagtgcaatggcatggtctcagctcactgcaacctccgcctcccgagttcaagcagttctcctgcctcagcctcccaagtagctgggaccacatccagctaatttttgtatttttagtagagacggagtttcactatgttggccaggctggtcttgaactcctgacctcattttccgcccgcctctgcctcctaaagtgctggggttacaggcgtgagccaccgcacccggcaggccacacaactcttaaatgacagtgcccaagttaggactcagatctgacttttagagcccatgatgcttttcaccaaatctcactccttatcacatagggtcagcattttctttattaatattgagttctatcagcagtattttgacatgattcctttaacatacactttaacaattttaagaacaggttatgccatctagctttacttctttggaaagggtattaatcttatttgctatgtccattattataaggaagtaaatccagagtttacagaatcacaaatcattcatcagaatgattgccactacccacagagcatatctttttaaacttctagacccgatagccataatcaagatgtctccagaaagctgttagcacaaagcacatatcctgaaaccatttgcctcagctctaatctgcaaataaaataagtaatagttggacaaatctgtcagtaagcatttctggttttgctttagtcttcagtttaaagagcataaagcaaagccagtgcatttgtttatgttataatagtggccatcatttagaactatgtattagacagctagcatacaattattgattcacaaattgacagctgagcgccatggttcatgcctgtgatcccagcactttgggaggctgaagtgggaggatcacttgagttcaggagttctagaccagcctgggcaagatggtgaaaccctgtctctacaaaaagtataaaaattagcgggtatggtgacgtgcgcctatagtcccagctactcgagaggctaaggtgggaggatcgcttgagcctgggaagcagaggttgcagtgatcctagatcactccactgtactccagcctgggtgacggagtaagaccttgtctcaaaaaaaaagaacataaaaaaaaaaaaaattggccgggagcagtggttcatgcctgtaatcccagcactttgggaggccgaggcaggcaaatcactggagtccaggaattcgagaccagcctggccaacatagcgaaaccctgcctctactaaaaaataccaaaaaaaaaaaaaaaaattagcagggcgtggtggcacgcacctgtagtcccagctactccggaggctgaggctggagaattgcttgaacccgggagacagaggctgcagtgagctgtgttcatgccactgtactctagcctgggcaacagagcgagagtctgtctcaaaaaaaaattttttttttaattaaaaatcacaattacattctgttttaaacttggtgactgtttttttttctcctttgaagttggttagtacattacaatgtcattcactatataaggctatttactgatattttttaaactacctgtttgatatgttaagaattgcttgtgaagacaagaaacaaaccactgtgtttacataggggattaatttcccagtgggcattacttgtgacccatgtgctatattgaagtggtcacaatagttttgtaatagtagatagtgttttttaaatgttgttacttggcaaatcctattcacaagttcaaaaacctagtattagtgcattgtacccccgcaccaccacctactcctgcagttttttttcaactggctcatgtaggagtactggacccagagggcaggacccaacagattccactgtgactccagatgagcagaagcttttaaaatgcagtttgggtatgtttgtgaaaatatcacattgctatgttgaaatacatacctatttggtaatagtcgcaacctttcaccgtttttagtttgacttgataatgactgaatctattcagggcatgcttcaaaattgcattaactgctgtataaaaaatgaaaattgaaaacatattactttggaaataatactattaatagtgtgttaggttttgttacaaatttaactgtgtccctagaaacacattttaaaaaattattatttgaactaaagcatattttgctttctctcttatctaatattcaccttatttacttctgaaacaccaaacttaaatgttatatggtctggtaatactataaaatagtaataatataataaagaaaagacagtaatttaaaatagggagacagcataacttaaagtcaataagttataatttataatacattagaaataaaatgtattgcatatgaaaataacttttaattcatgcaagtagatctgcaaaatcttgatggcagtatccaaatgcagtatcaacaatgtgactatattgacagtaggagcttaaataccttgaatgtcttaaagtacttaaagtaactaaaaagacagtctcatttgaaatcaaggcagaggtgtcattcaagcaatttactcagtagttctaaaagcgaataactgctgacattagagtagccttatcaccatgaatcacgtttcactttgaatgttcagataatcaaattttagctgaaataaaggttcatttatgtagccgaaatcaagaaatactcacagttcaggttcgcctgaagtaaaaggagcagaaccccaagcttccctagacactgagactcgtcttggttgtgtcagctgggctcttccatccggtcgtggtgcaattggttggggttctcttcttttttatgttcatatgtggtggtagggttttttttttccccctctttttttttttcttttttcggtatgacaactctcagattccttttgaaaatattaaaaagccctactaccatggaacaactttaagctcaaccaacactgaactttaggaaattatttatatcttctttatgaataccttccaacttgacaattgtggaatgttttcctccccccgctcaaaatttaaaagttttataaattctaagcagaaatatgtattttctgtgttttgtaagaaatgatacataatatgctatatggactttcaaagcacaagcactgaatttctgtttcttaagttttcatctgtacattattttagcatattttcatgtattcctttaagacctttgctaaaacaaacttgtattattaggactagatgagatttctgatggtgttctccccttttgatcactatgataaactctcccgagcaaattaaaacatcacctgtattttaagcgaaataatgatgggattctgcagtcttggttttgatcctagtccaaaatttaaccactatctgtccatctatgtaactgctggccctgcagtttagtgttatttccctttttttgttgtcatttgaaatgaagaagttagtttttattctccccataattgttatcctgcagcttgtttgcactaaatatttgactcattgggctgtatctaacattctaattatttctgggtacactcttctgaacattatattctccagagctttttgtttgttataaatatgatttatgggacaggatatttttaaattaatagaataaaaatgttttgtagctcttacttccccttagaacctctgagaaggaaggtggttgctgtattagtcctgcaatattgttgtattggcaggattttattttattgtggtacaatatgtaacattaaatttaccatcttaacttttttttttttttttttttttgagacggagtttcgctcttgttgcccaggcgacaagagattgtacaatggcacaatctcggctcactgcagcctccacctcccaggttcaagcgattctcctgcctcagcctcccaagtagctgggattacagacatgcaccaccatgcccggctaattttgtatttttaatagagacagggttttgccatgttggccaggctagtttcaaactcctgacctcaggtggtccacccacctcagcctcccaaagtgctgggattacaggtgtgagccattgcgcccagccccatcttaaccatttttaagtatacaattcaatagtgttaagtatattcacattgttgtgcaacagtttctagaagtttttcatcgtgcaaaactaaaactcttcaccactaaacgatttctctcctctccccctgcccttgacaatcatgattctttatgtttcattgatttggactactttggacacttcatatgagtggaatcacacagtatttgtccttttgtgacatgtttatttcacttggtgtcatatcctcgaggttcatctgcgttgcagcatgttacaggatttccttcttttatcaaactgcattatattccactgtatatgcaccacattttccctatgcattcatctgttgatggatttttgggttgcttccacctcttgactaatgtgaataatgctgcagtgaacatgagtatgcatatatctcttcaagatcctagcaggaattttttaatgactaaataggcatttaactacgtgcattctatttcatataatctagcatgaatatatttttttctatattattttcctacacctaagacaacccttttcaaaacactaattgttttaatcttcagtttcctcatattgtgaccacattttctcctcaatgtgagtcagcacagctaccaccagatttgagtataatctttttctagttctttctttatataagctttttcctgttcattctgaacattctggtttgtctctgcgttcttagctcattttcgatatgtcctcttcccttcacgcttcctctttctcttgttgggattataaggtatttatattaagatagaagtagaaaagaacaaatgtatacgcttgtttggtgccatctattactgatatcactgttctctttaaatcccaaccctggttaaattcagctcaccacctactccaggcctgaaccttgccatgtaaaatgaggactgctggatacaaacactcaatgatgctgattggtctcacttcaaattcatgactacaaacctcaagtgggcccctgggctgccaacagtcctagtatatttccttagtccagtggttctcaaaacaggggtcccaaacgagttgcgtcaacaccactcagaagcttgttagaaatgtatgttcttagctgggcatggtggcgtacgcctgtagttccagctacttgggaggctgagatgggaggagcacttgagcctgagagtttgagtctagcctgggcaacatagcaaaaccttgtccctaaaaaaaaaaaaaaaaagaaagaaagaaaaggccaggtgtggtggctcacgcctgtaatcccagcatgttgggagaccgaggcgggcagatcacctgagggtcaggagttcgagaccagcctgaccaacatggtgaaaccccatctctactaaaaacacaaaaattagctgggtatggtggcacgcacctgtaatcccagctactcaggaggctgaggcaggagaatcgcttgaacccgggaggcagaggttgcagtgagccaagattgcaccattgcactccagcctgggtgacagagcgagactccgtttcaaataaaaaaagaaaaaaaatgcatgttcctgacttcatcccagacctgtgagccagaaattctggggatggggctcagcagcctgtgtgattctgatgctaaggtttgaggaccactgcttaatcagttcattcttctattccttgaaaatactttttcacacctgtactcttctcagactgccaggaacccctctccttcctcactcccacctggtgatcactttttatttcactgagaaaatagaatcactcagaagagaattttattgtcttccagtgtccacctctgctagtatatacaaatgtctctctaagaaacaaaagccgggcgcagttcttcatgcttgtaatcccagcactttggccagctgaggtgggcagatcccttgagctcaggaattcgagagtagcctgggcaacatggcgaaaacctgtctttaccaaaaactacaaaaattagccgggtgtggtggcacatacctgtagtcccagctactcaggaagctgaggcaagagggtggcttaagccccaggaggtggaggctgcagtaagccatgattgtgccactgcactctagcctgggtgacagtgagaccctgtctcaaaataaataaaataaaaaatttaaaaacctccacaaaaaagctctaggtactactatggaattacctgtagaatatattgttatgtggaaattttgaatatttgtacatattttcttatttttaaaaaactgaaggataaactgaaaactgataaaaatagttaccaatggggaagaaaagattgggagtgggggaagagtgcaaaagctagacctctctgaatagtatctgttttacagtttgtactttagaacctatgtacatgttttatacaattaaaacaccaaattaaggcaaaatctagttgaaacaaatgaacctcactctattgcaaagtgaaagcataaccacaaggagaattatttttggtaacttttaaaatagggtaggggtttttgttttgtttttacgtaattttagacttatagaaaagttatgagaacaagtacgaggattctagataccttttactcagattctctatgttaacattttttccttcatttgtttaatccttctcaatctctcactcttatccatttatgtatttcctaaaaatagggaattcctttacatagctgcagtacagttatcaaaatcagttaatttatgttgacctaatatcattatgtattctacagaccttgttaaaatttcatcagttgtcctagtaaatatcctttataacaaaaataaaaacaaaccgggcacagtggctcacacctgtaatcccagcactttgggaggatgaggcgggcggatcacttgaggccaggagttcgagaccagcctggccaacatgccaaaacactgtctctaccaaaaatgcaaaaaattagtcaggcatggtggcacgctcctgtaatcctagctacttgggaggctgaggcacgagaatcgcttgaactcgggaggtggaggttgcagtgagcagagatcatgccactgcactccagcctgggtgacaaagtgagaccctgtctcgaaaatatatatatattaaaaacaagatctatctttttagtctcctttaatcactttaacctggaactgtatttgaagaatataggccagttactttctagaatgtccctctttgggtttgcccagggttccttcatgattagatctcgttatgtactttggcaggaataccacagcagtgttgccaagttctcaatgcatcatatcaggaagcacatgctatcaatcagtcccattagaagcagtgttaacttcgctagtttctgctgggtttctcccttgtaaaattactagtttcctgtttgtaattaataagtatgctgtagggagatatttagagatcacataaatatcttaccactcttcaaacttccactcacaagttagcatccttgatgattcttacctgaatcagttacgataatgaaaactgacagattccagcatttcttctacatttaattgattttctacttaaagcttttcctccttccccattcatgtatttgtttatttatttacatcagcatagactcatggattctttacccagtagtaaaatgctattttgaccgggcatacctagtgggatatatcttaaggacaaaaagaaccacaaaatcttaaacagcattcagtggtgttgttattgataatgtaggtattactattattttaaaactttcacacacacatacacacacattctgaagcacaaagcaaatgagtaattatgttagtatcattaggtaccaagattacagttgacccttgaacaacatggggattggggtactaatccccgcacagttgaaaatccatgcataacttttgactcccccaaaacttaactactcctggaagccttaccaataacatagttgattaacacatattttgtgttatatgcatcaagggagcctcaagtgatcctcaagtgatcctcccacctcgaccttccaaagcactgggatcataggcatgagccaccactcccagccggtttgataattatagaaagaggtttggctttaaaaatgtcaaaatagcaggatgcagtggcacatgcctatagtcccagctactcaggaatctgaggcaggaggtttgcttgaacccaggagttctgggatgtggtgcattatgccaatcaggtgtccacatgaagtttggcatcaatatgatctcccgggaggggggtaccaccaacttgcttaaggaggggtgtgaactggcccaggttgtcagcggagcaggtcaaaactcccgtgctgatcagtagtgggattgtgcctgtgaatagccactgcgctccagcctgggcaacagggcgagactcccacctctgaaaataaattaaaattaaataatgtcaacataacaggaggatcagtttttgtcagcaaagaggcagcagatgagttctcagatgccattcagaaaagtattgaagaggagcaatatctgcctgaacaggctgttaatatggatgaaaagtgccctattctggaaagaaaatgccacagagaacatctattaataaggaacagaagcaagcaccaagatttagggcaggaagggatacactaactctaataagcatagtcctgatataattccaactgcatttgcacaaaacagtagagtcagcctatctgcctcacttgaggtcaggagtttgagatgagcctgggcaacataacgagacactctaaccccccaaaaaatgtttttaattagccaggcatggtggcacacacttgtagtgccagcttctctggagactgaggcaggaggatcgcttgagcccaggagttcaaggctacagtaagctatgattgcaccaactgcactccagcctgggtgacagagtgagaccctgtctcttaaaaaaaaaaaaaaaatttatcaaactgtcttttgccaccattgcattctccagcttttagatccttcattttttttttttttttttttttttttttcctgagacagtctcattctgtcacccaggctggagtgcagtgtcagcctcctgggtttaagcaattttaccgcctcagcctcctgagtagctggaactacaggcacgcgctaccatgctgggctaatttttgtatttttagtagagataaggtttcgccatgctgcccatgctggtctcaaagtcctccactcaagtaatctgcccaccgcagcctcccagagtactgggattataggcatgagccaccacacctgaccccttcaccttctttttgctttaagttgctatttcgctttttctcaaattatgttagaatctataggtatgtcttttttatacccacataaaagctgcattttcaatactacttaaaaaggtatttcacaaaaagtgcaagattttagcacctactggtgttagctgcaggagtagcttcatgaatttcctttcctttttttttttttttttttttacaatggtccttatgttggattcatttatcttgagatggcagccaattgcagttgcagacctcaatctacaatacatatcaagcaattcagctttttctttttttttttaagatggagtctcgctcttatcacccaggctggagtgcagtggtgcaatctcggctcactacaacctccgcctcccaggttcaagcagttctcccacctcagcctactcagtagctgggatttacaggcgcctgccaccatgcccggctaatttttgtgtttttagtaaagatggggtttcaccatgttggccaggctggtctcgaactcctgacctcaggtgatccacctgcctcagcctacctttttcttgtaatgtcatgactttcctctgtttcttaggagcacttctagcatcaccaatggcactttttatggatcctatggtttaaggtattgcactaaacacagtgaaaataatatgagaactgtgagattacttttactgtgatatgcaatttattggagagatgaactgctcaagcaaagataagtagcatcacacaacatattaggtgaatactcgcaagacttgagctcactgcaacagcaacaggagggagctgtgaaattattacagtagtataatatgtactacagttaattttatggttatgatttaatattgcattctttgtatttgttcacatttctcttgactgaatggcaccgtttacagtctgtgtaggtgtaagttttgataaattttaactctttataatagatttgtgtacatttttatagtactaaataataaaatagtatctaaatatgttttatgcatttatgatatagctttttcttaattttttattccagaagtcatccttcacctttttcttaatttttaaaatagttctaggcaacatggttggtccacgagttttttcaaattgttacgaatctccaaaaaaaactttcaatatattttgttgaaaacaatccatgtataagtggacccacacagttcaaacccatgttcaaaagtgaactatacttgccaaatcaaagaattaaagtaaaaatgctataattgaataggaagaaatattagcttgaacttgtggtttatttatttattttttttttttgagaccgagtttcgctcttgttgcccaggctggagtgcaatggcatgatctcggcttaccgcaacctccacctcccaggttcaagcgattctcctgcctcagcctcccaagtagctgggattacaggcttctgccaccacacccagctaattttgtatttttagtagagacggggtttctccatgttggtcaggctggtcttgaactcccgacaggtgatcctcccgcctcggccttccaaattgctgagattacagacgtgagccaccacgcccagcatggtttatttttctcctaaaaatgcattcttttttcagcactgtccactgaaaagccaaagtaataataacccagtaaaaataatatgcctagtacccacatcatggatttatttatatattttattttatttttatttttattattattatttttgagacagagtctcgctttgtcgccaggctggagtgcaatggcgcgatcttggctcactgcaacctccgcctcctgggttcaagcgattctcctgcctcagcctcctgagtagctgggactataggcgcatgccaccacgcccagcaaatttttgtatttttagtagagttagggcttcaccatgttggccaggatggtctcaatctcttgacctcttgatccgcccacctcggcttcccaaagtgctgagattacaggcatgagtcgctgcgtccagccaattttttttttttttttgagacaaggtcttactctgtcacccaggctggagtgcagtggtgcaatctcagctcactgggttcaagtgaagctactgcctcagcctctcgagtagctggaattacaggcatgtgccgccacgcccagctaatttttgtatttttagtagggacaaggttggccgggctggtcttgaactcctgacctcaagttatccacccaccttggcctcccaaagtgctgggattacaggcatgagccaccgcacctggcccacatcatggatttaaatcgttttttgcactaaaaagaaacagggctacttagagaaatggctgattccagatctggggcaagaaatggacatgacaagcctggaacatcatcttgtgactgaaagcaaggaagttatcagacttctggagtcttacaaaaatacagaagaactgacttaaaggggctcccactggcccaaaatgggacaatttgagcacaaaaatttgtaaaggcagcaactgattaaaacacattaaatatataaaaatctgtaagttcataataattaaaaaaaaaacacctcatcagtcacctttggaggttgcctagaaactaacttggtattctggaaataaattataacagctttattcataatatccaaaaactagaaatagcctaaatgtctgtcaacaggagaatggacaaactgatatattcatacaatgcaatacttacggcagtagtaaaaagaaatgaactactgatcacaacaaaatgaatgaatctcagaacatgctgaatgacagaagccttacataaaagaatacatacttacggttttgtgtctatcaagttctaatataggcaaaacaaacctatggtgaaaaaaatatcagagtagtggtttgcactgggggagatggcagcagagattgaatgggaaggggatgagggagggaggtttgtgggataatgaatttttttagggatttgggttacacaaatgtatgcagttcatcaaaactctaatggtacgcttttgtgcatttcacagtatatacattttttaccttaagcataactttattttttttttactttttatagaagttttaagagacagggtcttgctgtcacccacgcaggggtgcagtggcacaactgcagttcactgcaatcttaagctcccaggctccagtgatcctcctacctcaagttactggtcccaagttactgggaccacaggtgcacgccaccaaaactggcttttttttttttttaagtagaggcataattttaaacaaatattaaatttcaatgatatgtgtgctaaggtgtattaaaaagtaagatggatagaaggataaagagatagatatttgataaagcaaatgtaacaatatttaattgtagaatctaggtggctctttacaatataattctttcaattttctatatgtttgatagttttcataacaaaatgttgaagaaaacctccattttggcacctctaattatgggtctaggcatcaacatctgctaacatcattgagtgaaaagttgatggtgaatcttataatgatgggtcaggcagacaacacctgaacccactgctcaatcctgtcactaaaagtaggatagccaggtgctatgttcttcctgttgcaatacaatagatatatcacctatgaagtattagtgcataaaactaaaattgaatctgaatctaatcaagattctagatctaactacaaatttacaggaaatacaggagagtaaaaaacattaaataataccatgtaggtaccattagtcaagtacagattgtgggggatttcacaggaaaaattacctagtatcttaacaaatcaatggcatgaacattggaaaaaaaaaagcataaggaaggggatctgttacagagtaagagacactcacaagacatagtcatcaaatgcaatgtacagaccttggatcctgtctagaaccaaccaaccgtaataagacctttcttctttttttagtctgttctactccttcaagttattggtagagaaaagacatttttgagacaatcaaggaaaactgaatgtggactgagtattagatgatactaaagaagtattgctcattttgttggacttaataatgatattatggttatttttaagtcctgtgttagaaatactgaactattaacaggttaaattacatttatgttaaaatacttctggggaaaaaaagtaaacagttggggatagatgaagcaaaaatgaaagaatgtccttgtttttgggtttttcgtttgtttgtttttgttttatttttgcctggagacgggcaagttgcccatacatcccagcaggccaggggaggagctgaaagaatgtcagtaattgccaaagctgggtgatagatacatggaagtttattaatctattttctccacttgtaaatgttaaaaagaggcatcctcagcttcacactttcttctacatcccatttctccatttttactacagtaagactgtgaaagatatctgtatttactgtcactacatcatctcctcccattctctcctgaacctggtccaatggggatttttgcctccatcgtgccaccaaaaccactcttatcaaggtcaccagtaacttccaaattgccaaatctaatggtcagttctcagttctcattttaaatgacctttgtaacattgatgactactaatcattcctacttgaaaaagtttcttcacttgacttccggataccaaactgattttcctcctgcttcactgtctagaccttgttttctttgctagattttttcttctgacttcagatattggcgtgcaccaggactcaatcctctgactcttctctatgatttcctaagcaatttcattccttaccatggctgtaaatatcatctgtgtactgttgattcccaaatttacacctctaatcccagcttccccttaatgtcatcttataaaatctcaaactcaatacgtatgagaccaaattcttttttttttttttttcatttttctataaaatagagatggggttttgccatgttgcccaggctggtctgaaactcctgggctcaagcaatcttcccgccttggctccccaaagtgctaggattacaggtgtgagccaccgcacccagcctgaaaccaaattcttgatccaccttacaaactcctccctcagtgttccctgtttcagtaaatggcatcttcattttcactcagttgctcagaccagaaaactaattgttataattgacttgtgtctttctctcacgctcatatccagtagcaattcctgtcagctttacctttagaacataaactgaatttgactacttctcatcatctctgcttctgtcactctagtctagtccaagtcaccatcttctcttgcctgtgcaactgcagtagcctcttaattggtctcctttttccctgtttcttcacaatctcctcacacagcagccagagtgatccttttaaaacctaaaactgatgatagtactcccctgttcaaaaccttatggtgatttcccatctcgctcaacataaaacccagagttcggagagcaggccagagcccaggcccggcccagcggcgcccgccaggtagacccaggcgaggccgcgtgccggcgcgaggggagcccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttttaggagcccgtaggtcatcttggagggtcgtctcaagtattgaacaaaagacggaaggtgctgagaaaaaacagcagatggctcgagaatacagagagaaagttgatacggagctaagagatatctgcaatgatgtactgtttcttttggaaaagttcttgatccccagtgcttcacaagcagagagcaaagtcttctctttgaaaatgaaaggagattactaccattacttggcagaggttgccactggtgatgacaagaaagggattgtggatcagtcacaacaagcataccaagaagcttttgaaatcagcaaaaaggaaatgcaaccaacacatcctatcagaccaggtctggcccttaacttctctgtgttctattatgagattctgaactccccagagaaagcctgctctcttgcaaagacagcttttgatgaagccattgctgaacttgatacattaattgaagagtcatacaaagacagcatgctaataatgcaattactgagagacaacttgacattgtggacatcagatacccaaggagacgaagctgaagcaggagaaggaggggaaaattaaccggccttccaacttttgtgtgcctcattctaaaatttacacagtagaccatttgtcatccatgctgtcccacaaagttttttatttacgatttatgacaggtttatgttacttctatttgaatttctatgtttcccatgtggttttcatgtttaatattaggggagtagagccagttaacatttagggagttacctgttttcatcttgaggtggccaatatggggatgtggaatttttatacaagttataaatgtttggcatagtacttttggtacattgtggcttcacaagggccagggtaaaactgcttccctgtccaagcaaagaaaactgcctacatattggtttgtcctggtggggaataaaagggatcattggttccagtcacaggtgtagtaattgtgggtactttaaggtttggagcacttacaaggctgtggtagaaacataccccatggataccacatattaaaccatgtatatctgtggaatactcaatctcaatgtgcacacctttgactacaactgcagaagtgttcctttagacaaagttgtgacccattttactctggataagggcagaaacggttcacattccattatttgtaaagttacctgctgttagctttcattatttttgctacactcattttatttgtatctaaatgttttaggcaacctaagaacaaatgtaaaagtaaagatgcaggaaaaatgaattgcttggtattcattacttcatctgtatcaagcacagcagtaaaacaaaaacccatgtatttaactttttttttttaggttttttgcttttgtgattttttttttgatacttgcctaacatgcatgtgctgtataacaatccaagcataattgttaagaacacatgtattaaattcatgtaagtggaataaaagttttatgaatggacttttcaactactttctctacagcttttcatgtaaattagtcttttggttctgaaacttctctaaaggaaattgtacattttttgaaatttattccttattccctcttggcagctaatgggcttttaccaagtttaaacacaaaatttatcataacaacaaaaatactactaatataactactgtttccatgtcccgtgatcccctctcttcctccccaccctgaaaaaaatgagttccaatttttttgggagaggggagattgattagaaaaaaatgtaatatgttccatttaaaattttggcgtatggcattttctaacttaggaagccacaatgttcttggcccgtcatgacattgggtagcattaactataagttttgtgcttccaaatcactttttggtttttaagaatttcttgatactcttatagtctgccttcaattttgatcctttattctatttgtcaggtgcacaagattaccttccttttttagccttctgtcttgtcaccaaccattcctacttggtggccatgtacttggaaaaaggccgcatgacctttctggctccactcagtgtctaaggcaccctgcttcctttgcttgcatcccacagactatttccctcatcctatttactgcagcaaatctctccttagttgatgagattgtgtttatctccctttaaaaccctgcctatcctgaatggtttgtcattgtctgcctttaaaatccttcctctttcttcctcctctgttctctaaataatgatggggctaagttatacccaaagctcactttacaaaatatttcctcagtactttgcagaaaacaccaaacaaaaatgccattttaaaagaggtatattttttcttttagaatgtaagctcctcaagagcagggacaatgttttctgtatgttctgttgtgcctagtacactgtaaatgctcaataaatattgatgatgggaggcaaaaaaaaaaaaaaaaaaaaaaacacccagagttctcaccacagtttcaaggccctacacctttgatcatccctcagatcacatttcccaccgctctgccccttgctctcatgcctttccagacacactgggcttccttcttcttctccaaacaaccctccttattcctgtgggcctttgtattggctgttcttctcatctggaacttgcttccatgtggcttgctttttcacttcgttctggtctctgttcagatattacccattagagaggccttctctgaccccaactaaaatagcaattccctagtccccatccctataacacctccttaccagcttaattttacttcctaacaagtaatactacctggctttacattctgttaatttgcatttatggctctatttgctttcttaaattcaactctttaggccaggcacagtggctcatgcctgtaatctgggcactttgggaggccaaggtgagaggatcacttgagaccaggagttcaagaccagcctgggcaacatatcaagacccctcatctctttttaaacataaattaatttaacttaattaagttcacattttataacttgtcttaaggattcaagaatgactgaatctacacagaggagaattatataaattcccttgtaacattaacttaagcctaaacatcatcaacatactattaagggcatacagaactttggagttctgatttcagcttctactccttcctaaggtgataacagttacacagccatggccagaagaccctgttggagtctagtttgcacttttttcttctgtatcatgttcattcttttctaggcttgctcacttgctgtgtcccatactggaatcatgctaggggtattgccatcttagtctgttgtcattgttctctctttgaaccaacagaaagttctaactaacagcagtctatcagttgatttcggtagaggtttgcctgctctcccatagactcttcttgctactttgtgtcatgctgtggtttgctcactattcatttctacacttgccttccttctttctctggctctcacatacacacttgtatttcctggctcatctctgtttgtgctagactattggaaaagtctttaaacttctttggacagaaagaataacttccaaagtagaatcctgatgctcccattgggcagagtaaggattcctcccacctgtgtgtcatcatcaaacacaggtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaaccctcattgttatcacaaagcatatgatataaaggagccctggtcaagcaggataccccttggggagaggatgtctttgccctggactaggaatcaggcaagtggttttctttccccttctcctttttcacctcccacccccacagagaggaaaagcagatccagagaagacatgcccaggaagagcgttgaagtccctgggaacaaggcttaattaaaatcattaaatctgacccatccatgtagtactccttggcttaagggtggaatgaataaagcaaagaaaagaggactgggcagggtggagaaagaaagggccatggctatcccctaacaaccaggatacaatggctctgtaggtaaaatcagaggtttcaagaaacattttggaagtgtaaaatatattttttcctaaagaaatctagactgtcactcaaaggaagacaatattgcatagtaaggcaaaaaaaatgtatctgtgtttcttgaacatccatgcttccttagtaattcttagcactgtactctaaccttacaagcaaataatacctaaagaacattggatggaacaggtatgtatttggagaaatcagccagacgtgagaatatgacaaataattcaagcatccagaataatttagaagtttttaatgtgtttctctattatcatgttatctaattttatgtaaactgcattgttcatcttcaatgaatccttatcttcgggtttgttttttgtttgtttgttcgtctgtttttcttttcagccccactgtgttctccttgcctcaaaagaaaactcggcacctgttaaacttggaggctttggggtagctattcaattaggggagtctggacttgtagctggaggtaagactgctttaaaaaaaaaaaattcttcaaaacctggtcacttgcgactggtataaaactttcaagctacatattagcccaacctcagtgtttcatacctcattccaccccaccccaactcccaaaaagcatcatcagatagtttttaatttaataactctgtagtcataactagaatcttagtcccttaagaatagactcttttttctctttgtacctccagtacttaagagactgtacaagattaaaacagtgttcagagaaaataagtttgaggcatagtgccttttaaagttgaactggccaaatgaagtcaaatctaaaatgtgtagattagccacttcctggtttacactgatggctaatttttaatttcatactgtttgcctttttccatttatcaaagaatcctgctcaagccatcagcctgtatattagcaaagaataagcagatgtgaatgcaggctgattttattattagccaaagcaaaacataatttttaaattcccatgtcagaataaaaagaaaaaagttacaaattatataatcttgcacagcacatttcatataactcaattccttatagctagaacatcaagcagtaacaacatagaccatcttcagaaaaatgagccataggtcatagttgtaatttttttttttttctttcagacaatgtcttgctctgtcacccaggctggagcgcacagtggcacgatcatggcacactgcactgcacccttgaccttccaggctcaagtgatcctcccacctcaacctcccaagtagctaggatcataggcgtgtgccaccatacctagcaaactttttttatttttagtagaggcaaggtctcactacattgcccaggctggtctcaaactcctgggcctaagcagtcctcctgcctcagcctcccaaagtgctgggattacaggtgtaagccactgcacccagccaatagttgtattctttaaataattttttcaccacagtgccctctaaaattaaattacattcaaattttcttttagtttcacattcttttccagttaatcatttccaataatatgcaaaactgcaagctgagtatagtttcaaagaatgctaattttttcccctaatttaaaactttctgttagtgattggaagactgaccaaagggtcaggtagtaaagcacagtttaatcatagaatctcaggactccaaagggccttaacttctccagtcttgtaactaatgattgaattcttccataatattcccaagaaaagattgagttctggtattaaacctcagagagcaaagtagtcactacatcccaagacagttcatttcatttttggataactccttaagtattaaaaagctcatctttgcatctttctgtaacttctacccagtcatcctaatcctgacttttgaaaccactctgaacaattttcatccttccgtatgataaccgttcatctgtttgtagacaactaccatgtccccctaggtcttatccaagttaacttccctagggtgatttggccattcttcatataaactggttcaaaatctcttcagtatccacaaagtacagggcctgaactgaacactctaactacaggtagtacagtacagccgatccagtgcacagtagcattgggctatcacttttttgtgttctgggccttaaatttccctcgagttccccaaattgcattagctttttggacaactacatagcactgatggttcatactgatcttgtaatcaagtgaaaatcctaaattattttttaaacaaatgtcactgttaagctaactctctcaattctggtacttatacagatcatttctatgttaagactacgtaattataacaaataatttctgatgattatattaccaaggttaatgggatgaaatgaaatgaatttattttatatgttatatactggccatatataatgactttgtttctgttgctctggatctatatcctgttggtatttagaatgtcatgttcttcgtattttattgtacatcttgactgggggggaaaatagatgcattatgtttacctggacattttctccatattaatctttttctaaagtccatgaacctttcacctaaattgtttatttttaaagctaattttgaactcccccccaccgcccaccgctggtatgtcagtattcaaaatgtatttttctccatgcttctagaattaaaatacttcctgatggtcaaaatattgtcatttcttagcacacctttttttgtattcttgaaataactgaatgttacgttttaaaaaatagaatatgaataaattagagataaattatttctcttagaaaaagcttttctgctgtttaaggtacttttgaaattttggtaattaaggttgggcacggtggctcatgcctctaattccagcactttgggaggctgaggcgggcagattgagcccaggagttcaagaccagcctgggcaacatggcgaaaccccatttctccaaaaagatgcaaaaattagccaggcatggtgacaagagcctgtattcccagctacatgggaggatcgcttgaacccgggaggcagaggctgcagtgagctgagatcgcaccactgccctccagcctgagcaacagagcaagaccctatctcaaaaaaaaaaagaaagaaattccgtcaatcatttaattatttatcaactttaaagcagaaagccattttcctgtcagtttgaaatcccagtccctagtcctccaaatagaaaggaattcatttctttatatgttgcatatagtaaaaatcatttaaacatatttacactccccctacctgaaactcagctatttaggaaacttacttatccagaatacaactagaaacctagaaaataactacaatagcagcaaaattattcctacccttaaaaatccactcatgctcctcacaattgagcatctaaagacactctctaaggctgacttgctcccatgttttaaaaagttgtatagattcgtgttccttcataccttgcacatgctattccttctagttggagtgccttttgttattttatctatctggttaactcctactgttctggaaggctgagctaacaattatctcctctttaaagcaggcttaccttcaccatcccgagttggatagccctattccttctctctatattcccataactatctgggctacatacctccatgtagcattggatgcagggacttacatcaaagactgtgatttgtaagagtaagggggaccatggctgagggtatctaggacctagcaagcacttaggaaattgctattaaatgaaataaactggttgctagtcaggttctagttaatagcagattataaaagcaacaaattaggagaacgcagaactaaagcatagtgagagaaaagaaataaaagcctgacaaaaatatatatgatatatactgagcagacaccaaaacttggaaagcgcaacagcctttcaatatgaaagaaatcaactcttgcatacctctgaagttcctgagggtgctttctgttctacagcctaggtctttaatcagtatctacaatgacaactctgagtcatcaagaaaaggttaaattatgagcagcattctgtgtaaaagaagtcaggaaattgtagaaagccatacaaaattatttaactaaggtgggcactgtgactcacacctgtaatcccagctacttgagaggccaaggcagaaggatcgcttgagcccaggagtttgagactagcctggggaaaatagtgagactctgcaaaaaaattattaaaacaaaaaggattgtgcgcataaagattcaaatcacaatgtatttaaaaatgtagctattcagaacaattctccccctgagattctggtaggaaggttttattgtattatcaaaatatataatatttaaatatttgtccaaaatatctcaaactgccatttaatttagtttgctaatttgtttccttttcttaaaattttgtggtcaaagtcctaaaagtcaagaagaagtatcagcaaaaacaaggatttttaggaagttggtgtatattaaagattaactccagtcctttttaccttctactgatttacatgaaataaaagagccttcctctacattctttctaccatggtttttcccctatcatctgtgagcaaattattgaaccaaacaacaggcatcttcccgaagattgaacactaattctccagaattgggtagtcttcgtctagctaaatggagagaaccttctcaggatggctgggactggccatggtcgctctgattattcccaagttaaggcccccattttgagtggcttggcccaggaagtggtaggagtcaagttgagtttcaaagcatcatccaaactgtcagcaggtacctaactggtaccctggtaccaattgaatgatactggtttcccctactcctgctagctcctgtccatcagaacaaggctaattctccagtggcccctccctgtccaggctattaatgaagtatggaaggcttagttcccatccctgcagcttcttcgtgttacttgaggaagcaaaatggggcaatacagaaataaaagtatttctctagccaggtccttctagtcaatagttttcactgatctatcgtacattttaaatgaaaatattttcactactggaaccctgaacttaagcttttctattatggggggaggaagggaaaccatatgatctgcagcaaaggtacatcctgatacacaagctaagagctcttttatctttctgcatcccaactgagtttcataatcatgaacagaacttgatatattctctctagctgaaccagaagatctctaaggtcttttaaaaccacagttctgagttctagataaagtattgcacaatcttcaaactaaaaattatcttgaactcagtatgatgaaagagagagacagagggaggaagggaggtggctgggcttgcatatatctagaagagctgccaagtctagtgggcagtgccccatcccacagtgatcttcctgccgggtacaagcctttcattccacaatagaagacttcttttgggatactgagttaaagatagttatgaatgtgcaaacagctagtatcagattccttacagaaagctaatttttgatagagaaacaaaagaaaactctttaaagaagatgaaagtcaaagaggattgaatgggaggagcttcataattttgcttttgtttatgccatatatttgctctcattctcttcatatgttaatgttaggaggaagctaaaaactcctactataacaaaatattactaactattgttaattgctataattaacccataaaatcaactgaacaggatttcagagtcaaattcatatttcaaataacagttctcagcatttggtttcattggggaatttccatttggcagtcaagtcatcttttttccaccgatttttttctcatgacttcctgccccctcctctcctttcccctgcctctgcctctgcccagggtaggcctcccaactctttcctggacagctacaggctctgcctgttgactctttcacctgcctctgctctatatatttggtgactttcaaccatgtgaaaattagaaaatttaaacttcttcatgaggtaagaaccacataaatacctactacgtagcatgcagaattcaatagggagtgccagtgtacaagacagaatacctattctgggctcaatgttttcaggaagcaattagataagtaatttttttcacctatgtgaacttgattttatggagaggtggaggagtggtgagagtatatgtattggtaaactttttatttggattgttattgttctattatttttagttttcaagtgaaaatcccattttatgtaaacatttttccttaatgttgttttaaatgtaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttctttttccattgagattaatttatcctgaaaaatgtttttttgaagttactgtctgtctttgcccactaattgactgccaggtagttaccccatcagagaaaaggtctttgcttacatcattgatccagtggccttggtaggcaacataggcctcaagtaaatttctgagtcattgtcagctgagctatcaccctggtgaagaaaacatttatgaaccttctttgtgtaatttgagaaaggggcttcatttttaaagccttctgcttaatttgtaaagttaaaatggaatttcatccaggtataattttagtcattctttatcttaattttaaatttaggccagcacagctgaaaacatttgccatttacattccaggataaactgaaatgccaggatgacaactgcatttcatgatacaatatagaggcatttcagtgtggcttaaacattcctattcttctttggctattaggtgttggcagcctcatgtactatcacagacttgtgattagtaaatcattactttaactagtaaaaaattgaaaattcattactgactttatgaatagcgatatcacaaacacctaaggacttcttggaaataagtaagcttaaagttgatttcactaccccagcttttagactcctttgccctgtcccacaaggtacgactgacagtgactaggaggctgggcatgggaagcatggggatgtgtgtgtctgggtatcaggttaaggctgtttaagttggggaaattctttttcctctcattattactgaaactcatactttctattcaacctcatcactgtttcattttcagccatgactgacaacataaaaccaaaaacatgtgtatgtaacactggactctaaaactatgaggcccctaaagttttctcttcaattcctcggtaatgttagaattttatatgggacttggaaaaataaaatttaaaaagaagaaaagtaaagtggttccagagttacagtcttatccttttaagccataactgaagtttatggagatgagaatggtatatacttttgttggtttatttacctcactcaccatcagtttatgagtgcatataagtttgtcttttgttttagttagtttaagatatataccaaaactctgttaacagagaaagatgttttcagtgtagcatattctgctcctcccagagtcagctggccactggggaataaaatcaatacttaccaggtaactaaatgtctcaggaaactgcttgtaagtagtcatccctcttcaatccagggaagttgtaagttgctctcaggaatgcacagccaaattctggttgaatttagccaagtgaaatcacagatactaacgttttaaaagaaacatgattagtgatacatcagcataataataatactagcaataatgatagctaactcaggcatagcacatagcatagcatactttacataagtaaagtgcttagaatagtttaattcatttaaccctcacagcaacttgtgaggtaggtaccatataataataatcccccacctgcgtttttgagttataggcatttgctaataatagaattcttcctttgtgtttgttcagttgttaacttcctagtttccaaggcaatgtgcttcattccaacagactctggtattttatttcgtctatttttaaaacattgaatagttatttttgtttcttggtaaaaagacttagactattcacatatgtgcaaaaattaagtcatttaaaaattccctcttcctagtattatagtaagtcagatggatggtggcagctacatcataatttttttttgtacctggggtttgaagctttgaggttaataatttatttacttttttacttggctaacctcacctctcatttatcttcaggactttccttacaaaaagcctaggttttcaccaccttagtttgaagtatagatccatctctaccatctatgatgaatctcggcctttttcttttagtatactgtcatatgattctgtcagcatttatttttctatcttttattatcaaaaatttcgaacaaaaatagtagagagaatagtataatgagctcccagcttcagtaacacagacaatcttgttttatctgtattcaacatattattacattattttaaagcagatctcagctgggctcacttgagctcaggagctcaagaccagcctgggcaacatagggagacctggtctctacaaagagtacaaaaattagccaagtgtggtggcacacacttgtaatttcagctacttggaaggctgaggtggcaggattacctaagcctgggaggtcaaggctgcaatgagccatgatcacaccactgcacttcagcctgggcagcagagcaagaccctgtcttcccaaaaaaaaaaaaaaaatagatttcaaaaaaattatttcatcaccttggtggttcttttttgagacagagtcttgctctgtcacccaggctggagtgcagtggcacgatcttggctcactgcaacctccccctcccaagttcaggtgattctcgtgactcagcctcccgagtagctgggattacaggcgcatgcaccacgacacccagccaatttttgtatttttagtagagacgggggtttcaccatgttggccaagctggtctcaaactcctggcctcaagtgatccacctgcctcggcctcccaaagtgctggaattacagctgtgagccaccgcacccggccacatttcatcaccctaatggttctgagcaaaagaactattaacaaaattcttgatctctatggatattttaaagaaaagtttgatgacaccttttaaatgcagtactttttttttctttttttacctccagcagttgcaaatgtgagaccacattagaaaatactgtttcactggagtatatgctaacacttaacctcaattaacttctttgtaaagggcaaaaatatatttcccaaaccatatataagaagtgtaatgtcatatcattattacagataaccagttagtatatacacagcaagattctaagctgctatgggtttggtattcaaataagtaagattgttttatagccttattttgttcccccgtatagattcaatctccccaatttgttttagctactcttctcagctgaaggaatagaaaatcctgtgttggactgtcttgtaaaaaggacaagggagtatccttctaaacctctactcatttcagaaatcttaccacccctttcagatgatttctcaaccactttgtcaaggaaaaattattcagactttaaagagcacattcgctccaggatagggagaggaaacaagtctacccaagccctgtctaatcacttacctcatttcaaactggtcagttgaccacaatttcactaggatgaaaagtgtgggatttcatccctcccaaagtgtgggattacaggcatgagccactgtgcccggctggataatgataattaaacagccttatggcattagtcttaatgggatttgacaagcagaagtggctactatttgaaattctgcctgttggggggaaaaatgaagcacacttcaattttaagggctatccccaacataaagacacttttcactccccatcttcaagtacaaagtctcacattagtcagagctaatgctagcccttgctcaaattgtgatgattcatttatactgcagtgcaagtactgcagtttcatttggctttaaaatgttgtggagtttattcttcatctttcttccttagaaggtgatgtaggtctctgcctgttaaagccatggctttgcttgaaggtcctggcactgggtagctcacataaactcaccccatcagtaaacctgttgatattgaacaaggaatgagaccctactctgtctctgtctcctttccccacttgccttcccaaccccatgccctaaccactctgatttttttttaaatgattctgggtctcagacatatcccttttcccaggagccttctagcacttggctcacagatccacagcctttctcataagtcctgtgtcttttgaacaattcataattatttttgtttgattttaatcaatataccatgtggcttagttgtctcatctctaaaagagacaaaagtaacttcactgaggacagtattcaagcaaatctgttattctgtgggacctacggtagtagaatactttttcctaaacaccgaagttgatatgcagtgaccaaaatatcctattaaaaactttgcacagttcacaattattgctaacctcgattttttaaaacatatcttaaaaatatttctttaaaaattttaagttttattttagttctttctggatcgatgtattctagtctccctagctaaggatctaaagatagaaactggaataatgaacattctagtcttcaattattgaaaatattatcacttacataacaagaatatgggtatggaatatttactaacacaaattcttatgtagtaaagaacaacagaagaattgcatttgtccttttcttagaatgcaagcctttagaatcaaatttctgttctttgctctcagaattttattcacattgaagcaatataggaatattaaataatagtgaatgttaatgtctcatttaaggtaactatgtagttttcctttcctcctcctcagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttctgtcttaggaaaacggcaggtttttttttttttttttagacaaggtctgacaacattgcccaggctggagtacagtggcaccatctctactcactgcaacctctgctcctgggctcaatcgatcctcccactttaacctccccagtagctgggagcacaggcatgcagtaccacacctggctaatttttgtattttttgtagagatgggggtttcaccatgtcgcccaggcttgtctcaaactcctggactcgagcgatctgcccgcctcagcttcccaaagtgctgggattacaggcatgagccactgcgcccagccaaaaggcagattttaaaagttcattttatatcccatcttgccagtgagtattaaggaaaattataacttgggacagcagtgaaacagtactttttgattaaaacattatacagcccaataattccaggcaattttcattttagatgttagaaagactaacgcttggagaggttaagaatttgcgccaagttggccgggtgcggtggctcatgcctgtaatctcagcactttgggaggccaaggtgggtggatcacaaggtcaggagtttgagaccagcctggccaatatgatgaaaccccatctctactaaaagtacaaaaattagcctagcgtggtggcgggcgcctgtagccccagctactgaggaggctgaagcaggagaatagcttgaacccgggaggcagaggttgcagtgagccaagatcgtgtcactatactccagcctgggtgacagagcgagtctccgtctcccaaaaaaaaaaaaagaatttgcaccaagtcacagaagttgtcagtggtgaaaccaggattctaattcagcctaccactaccctttgattttgcactagatcctatccctttttatttgaccacattgacccaacaacttcctcccttcctgcatcatcagagttctctctctgttggatctaacatgctataggttatttgtattatgcacactcttatatagacataataccttctcctgaccctacaaccccctccaggttttgcccctattctttgcttcccttgacagcaactcctgaaaagagttgtatagactactcacattgtccagtttcccattcctttcccatgaacccagtctagtcaatatcacaatcttatttattccactaaaacagctctggtcaagtcactactgaccttcatgttgctaagtccagtgttcaaatcccagggcttcttcttggcctgtcagcaacatttgacatccatccttctgaaacactgtcttctctgggcttctggaacacctgctctcttggttgtccttctacctcctggctgctccttctcagatcctactgattcttcctcatctcccctctcccacctcttcacactggaatgccataggcctccatccttgctcctcctctttttctctgttgaagctgaaaaaactcaaactgctctcacaccacacagcaacaatcaatacagaagacttctgtgaccagaagtgtggagatttcttcccaccaacaagcaagcaatcaactctgcagcagactgcagctgggtgtcctcccaactaaattcaaacactatctacctggagatagcatcagatcccacagattgagggctcagtcccacaaccctcacctcttcagacaccagtcataagtccaggccgctgaaacttctgccaaccaactacaaattggggacaccacagcctcttcctctttggggttggttaatttgctacagcagctcacagaattcagggaaacatttacttatgtttaccggtttgttacaagagatattacaaagaatatagataaagagatgcacaggacaagttacaggagaggaggggagcagagcttccataccctccccaggcacaacaccttccaggaacctccatgtgtacagctattcaaaagctccccaaatcctgtccttttggggttttatggaggccttattactataggcatgattgattaaaccatcggccattggtgatcaacttaacctttggtacctctcccctacccagagattgaggggtggggctgaaagtcccaaccctctaatcctgcctgggtctttgtgaccccatcctgaagctgcctagaggctgccagccatcagacatctttggcgtttctaaggattttaggagttgtatgccaggaaatgagctagaggaccaaatatatatttcacagtatacctctggtcttcaaacctggattccttacattaaaaaaatataggccaatgtggtgaaaccccatctctactaaaaatataaaaattagctgggtgtggtggcaggtgcctgtaatcccagctacttgggaggctgaggcaggagaatcgcttgaacccaggaggcagaggttgcagtgagccaagatcacgccatagcactccagcctgggctacaagagcgaaactctgtctcaaacaaacaaaaaaaaaagaaatataaaagaatatataattcaaaagacactgccacattactagaatctcattcaggcattgataattagttcagtccatcatcataatgtatgaataggtctcccagcatgaggccactcaggtttgcaggctttccattgatcttgccaggttctaaaagcaggaatggtcttggtttcaccgtttcagacacctgatataattgagctaagaaacagtatcctttcttgctctgagtctctttcaaggtgttaatgtaatgtgataatggatttccctgaattcataacacatttatttattcctttactctcagctgttaattttttcctcactttattaataacctttggaagaaacattagaatcaacatcgtgctggtctagatggcagacagcaatattagtctagtaattacctcctcctcagtccactcccatgcagggagactaaggttacataggtgccaatttagtggaccgtttttaccaccaggcaatatagctgcattcacaattaacccgttttgcacaacccacccccatcaggtccttaggaattctgacacaaggtttaaaaacatagttacaatttcttgtttaggaatcatccctggttctaacactggtagttatggctctggtcctagaaccactgcatagggaggggcagggggagtttagatgatatgggaaagaaggaaagaaaaaagtatagtcattatatcagcatactcccctcttgtcaagaattgcatagtcataacagcatcctctaccaccccccttccccagatcaatcagaaaaacgaaagaatatctagtggggacactcctttagccccactcatgttgagtgtgagtacacactggtaaaggcaagtaagccagcccttcctgctttcatctccccctgttttagacaaccaatgttttcattgcccattttagtctctatcaaactattactctgagaagaatatctctgcccactgctggaacattatgggctgtaccgtgtgttctttggcctaaagaaatggtgttcagctctccaaatatgtgcaatatcttctgttctggcttttttatggtattctcatcattcacatcttccaccgggcaagcaaagcccagtccagaatcagtgtctactcctgtcaaaacccatctgtggcctcccagggttaccagcatcagcctcacttgccagcttgttcagggctttcccaccagggaaatctgccccacagccatgggcagtgtctgtctcttttgctggcagacagaacagttcttattggcattttgtgcctgaaatgatacaaaagaaacctgtctagatgcagcccatctctgcactgttgcagtacccgtttatccactcatttgatggacccaggtggccacctcgagggagcacacagggttctctgcttgtcaatgtcaatcattttccaaacccagaaagaggctcttatgatgggcatcaacatattctacttattgcacccctcaaatttccatagggccattctccatatgggcatccctttaataaataggccaggtttccactgcccttctgcctgaccatgtgaccaggccactggtgactgtccatgagtcagtaaaaaaccaaacacgggagcttttgttattgttcatttcttcagaatgcaattcaactgccaagctaatgtgatcttaccttctttgatcaagagtggcatccttccaaacaggatgctgtcgattcaccttggaactgtcatccacacaccaagcagctcttcgttggtcagttgagagctgttcacggggccctgtccaagtgtcagtagaatcccacagttcctcacacagttccagagtcagtcctaggggaaaagaggctccctgcttgaggatgtttcctccttgcacttcccggagaggatgttcctgcataaaccatttccattttattatggaactattctgggcgctgccatccccatttgaatgtttctctgacatcatgtgagaaagcatgggtatttcaggtgtcaagatcattttatgtccttcagtcattagggatagtttcagttaatgtcccatagcaaggtagtaaatgcaccgagatggaaattctctagtgcaaagtcctagtggttgtcactgggagatgctcacagactttggccataagccccagtaaacatcctgcaaagggcgagcagatggagaatttgtccctaccagcactccagcttctcaactccacactgtgtgagctcaagcaatcttactggtgcctagttagcgtgtccaattaatatttctcgaagtgcagatttacatttcttctgttttacaatactgggtaggggaagtgttctccacccagtcataattatccagttccataaaacatttaggtaaaggagacataacttatttatgtatatcctgtttaaacattccaaatctcatactcctatcaaccctcacttttaccctttcttgtttaaaaaaaaaaaaaaaaaatgttgagtccccaacagcaggttgagccaagggaccttgccccttttgtcagtctttgtattgattaacctgcctcaacattaccccaagtaactgttggtcagctttctcactgtaatctctgccttctgactttttcaatttctccaaactggggtgaatacagcaaacctgtttggaatcccttaacattgggagaacagcagaagctccctaccaacctttgatagtattatattgagatctttgttttaaccccatcgatttccactttattcatctcatttctttttatttcttttttatttttttgagacagagtcttgccctgtcacccaggctggagtgcagtggcgcaatctcagctcactgcaacctccgcctcccaggttcaagccattctcctgcctcagcttcccgagtagctgcgattacaggtgcccgccaccatgcctggctaatttttttgtatttttattagagagggggtttcaccatgtttgccaggatgctctcaaactcctgagctcaggtgatccacccgcctcggcctcccaaagtgctgggattacagatgtgagccacagcatccggccctattcttcccatttcttattagccctctaaagattccaccctgctgggatgagtcccatgattctcctctttcttttttctcttagtttcaccccatcactgttttcttcattcaccttatttattaataaccatttaaactttccaccttcctgggatgagtcctgtgactctcctctctgcctttccccagtcttttgttaattacgctcatgttttcattggtgcccatacaaaagaggctccctcagccatagcatttactacagccagagtaatggatgtattcagtgagtgaatatctcagtcatcataaagccagtcccacatggcctgcataggaaccaaatgagccgcttcacctggggtactccacttggcattgataggtagagttggacagtctctaccttctcagggtgtacagaccttacagtggcttttattccattcactaggctgactgttccctcaggaataactccctgtgtgtctggatcacattatacccattgttgattgttcagtagtgagctgtgggtcctgcatcaacccaaacatgcctgtccactctgcagcatttaaaaccaaagaaagtgccctaaattagttattctcacaatccattttagtaaaggattttcagtaaactgatgataccaatctatgaaatgagacaatttcttcacactgtaccctctggtttcagtagtttcttggttttgcccttccctcacatcaactaccttcgtggtaaccacaggtcgtagaggtactgtcatccctgtataatttttcctttgggggtcagcttgaaggctagtggcctgggctcagatagactgaaatctgagcttggtctagcatcaaggcctcatccagcatttgtttcatttctgttcagctattacagacaaccaccaccaagggagtgaatatttcatctttttcttactagtttgcatatccttatgcatccagtgaaccaactccctgagttggatccatctctaaattccactggtaacttttacctttagcaattgattgcgacacagttgcagctccaaaccatggaagaccacgataatgaaccaggaatcaaaggttcctcatctcccaccctttcattctttctcttcccaaaccacatatttctgtgagccagggccgttctagcaaaccctacttcactgacactaactgaaggtggaaaaactcagaactgttttcctctgctctcgcaccacacaacaacaacaatcaacacacaagacttctttcaccaaatgtgtggggatttctccccattaagaagcaagtaatcagccctgctgctgggtattctctaattcaattctgacactatagtatcacatcccacagtttgagggcttggtccccaaggcctccccttcccaccctttcagacaccagtcacaagtccaggcctccagaatgtcagactgactggctacaaatcagagatcctacacctgctctttgggttccattaatttgttagatcagctcacagaagtcagggaaacacttttaccattgtgttataaagaaaattacaaaggatacagatgaagagatgcattgatggaggtataggggtgaagtgggaagcttccatgccctctgtggatgcaccaccctccaggaacctccatgtgtgcagctatccggaaactccctgaaccctgtccttttgggtttctatggaggcttcattaccattgaccattggaggtcaactcaaccttcagcccctctcccctccctggaggttgggggtggggccaaaagtcccaaccctctcatccctccttggtctttcctgtgaccacccctcatcctgcaactgcctaggggctgccagccatcagtcagtcattggcatacaaagatagcccttacgccattctaaggattttaggaattgtattccaggaaacggagctgtagaccaaatatatatttcaaaatatcacgtccatctacactccggcccttggagagctcatctagttttgatggctttaaatgctatctgtacaacaatgactcctgaatccaggcctctccccctaggtattctttcttaattctgtatacagtttggctccctgacacttgactcatgtcaccccttcctactctccctgcttactccattcccatcatatcagcctccttgctgttcttcagactgcaggcacatttcacctcagcacctttatatgacccttccctagaatactcttccctcagatatcatggcttgttccctcaccatcttcaggtctttgcttaggtatcagcttcttagtaagaccttccctgaccaccctatttaaaatgtgggggaaggaatgccaccagtattccctatcccccttcccctcccttatctttctccatagcatctgtcaccctaagacatacctatatgttacttatatgtttattgtctgtctaggtcataaaatataagctgcataagtctagggatttttggctcttggttcacttctgtctagcacctagaatgtatctggcatgcagtaggtgctcaatgaatattaatgatttaatcaatgaatgaatgttcgttgtattataccatgctacttcctcagattatgcaaaacaataaaatattttaaaagtagattaataatgtatcttaaggtgatgacatggaatagtattacaggacaattttgagatttcagtggatcttgattctccttaagaatattacttctcagcctgggcaacatagggaaatcccgtctctacaaaaataaaaattaaaaaattagccaagcgtggtggtgcgcacctgcagtcccagtgactcaggagcctgaggtgggaggactgctacttcaaaaatatgcattcacctctctgatactcagtgctagttattcctgatttcccctagaaaagagtagtgaacaatttttagatactttctttgttttgttttgttttttatttgtttgttttgccctcccagatatataatgaacactttagaggtaattcctatttctcctttacttttctcactttctccataacggggatcttttgttcattcaaagctggtttaaatgccaaataacaatgaaaatggcaggcattttagtcatttttcaaatctcttagaaggtggtttaacattataccatacctacttacagtgctttcaaagcttatcttggctaatagcatatttatttttggaaacctttgttcctgccaatgattatagttctcgttctaagtaatttgagcttaatacataataaatttctagcacaagaaagacaaaaaatgtcagtaacttaaatgaaaaagtttaagacggctctttgagctgagtatcgcatgccatgtctaaacaacagtttaacttcactacttatgtcatctgaagatggaaaaactcaattagaatgttatccagctggtaagagcaggcttatgttatatttcagtatttgtccatgtgtatttataaatcattactgtggatgtaagaggtatttttttagaatggttgaaatttaaatatgaaaaacacctggataccttgcaaattgaagaaataaaatgatactggttgcagtggcttgagcctatagttgtctcagctacttgagaggctgagtaagtaattactgagtaattactctaagtaattagagtaaggtgggaggattacttgagcccaggagtgaaaggctgcagtgagctacgaccatgccactgtactccaacctgggagacagagcaaaaccctgtctccacaaaaagaaaaaaaaaaacaaataagatgaagaaaaactttgtaatgaaggctacccaaagtcataataccattgctttgtgtcaaaaacaaaaaaaaacaaaaaaaaaccacaaaaaccaggcatgatgccatgcacctatagtcccagctatataattttttaaagttcacagccactgcaaaacatgccaaattgtaaagaccatcgatgctaggaagaaactgcatcaactaacgagcaaaataaccagctaacatcataatgacaggatcaaattcacacataacaatattaaccttaaatgtaaatgggctaaatgctccaattaaaaaacacagactggcaaattggataaagagtcaagacccatcagtgtgctgtattcaggagacacatctcacatgcagagacacacataggctcaaaataaagggatggaggaagatctaccaagcaaatggaaaacaaaaaaaaagcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacctagattcaaaaagcaggtccttagagacctaaaaagagacttagactcccacacaataataatgggagactttaacaccccactgtcaatatcagacagatcaacgagagaaaaagttaacaaggatatccaggaattgaactcagctctgcaccaagcagacctaatagacatctacagaactctccaccccaaatcaacagaatacacattcttctcagcaccacattgcacattccaaaattgaccacacagttggaagtaaagcactcctcagcaaatgtaaaagaacagaaattataacaaactgtctctcagaccagtgcaatcaaactagaactcaggatgaagaaactcactcaaaactgctcaactacatggaaactgaacatcctgctcctgaatgactactgggtacataacaaaatgaaggcagaaataaagatgttctttgaagccaatgagaacaaagacacaacatactagaatctctgggacacatttaaagcagggtgtagtgggaaatttatagcactaaatgcccacaagagaaagcaagaaagatctaaaattgacaccctaacatcacaattgaaagagaactagagaaacaagagcaaacacaattcaaaagctagcagaaggcaagaaataactaagatcagagcagaactgaaggaaatagagacacaaaaaacccttcaaaaaaataaatgaatccaggagctggttttttgaaaagatcaacaaaattgatacaccgctagcaagactaataagaaaagagagaagaatcaaatagacgcaataaaaaatgataaaggggatatcaccaccaatcccacagaaatacaaactaccatcagagaatactataaacacctctactcaaataaactagaaaatctagaagaaatggataaattcctggacacatacaccctcccaagactaaaccaggaagaagttgaatccctgaatagaccaataacaggctctgaaattgaggcaataattaatagcctaccaagcaaaaaagtccaggaccagatggattcacagcccaattctaccagaggtacaaggaggagctggtaccattccttctgaaactattccaatcaatagaaaaagagggaatcctccctaactcattttatgaggtcagcatcatcctgataccaaagcctggcagagacacaacaaaaaaaaggagaattttagaccaatatctatcgggggacttgccccgataatcacgtaggttcttttctatttttcttaagcgtcggccggcatgataaataaagggacagagtacaaaagagagaaattttaaagctgggcatccaggggagacgtcacacgttggtaggatctgtgatgcctttcgagccacaaaaactagcaagtttttattagggattttcaaaaggggagggagtatgcgaataggtgtgggtgacagacatcaagtacttaacagggtaatagaatattacaaggcaagtggaggcagggcgagatcacaggaccacaggactgaggcgaaattaaaattgctaatgaagtttcaggcactattgtcattgataacatcttatcaggagacagggttttgagatcaactggtctgactaaaatctattaggcgggaatttcctcttcctaataagcctgggagtgctatgggagactggagtctatcttacctctgcaatcttgaccataagagacaggtacgcctcggggtgggcgggggccagttcaaagacttactcctaggtgcgcattctctttctcagggacgttccatgctgagaaaaagaattcagcgatatttctcccatttgcttttgaaagaagagaaatatggctctgttctgcctggctctccagcagtcagagtttaaggttatctctcgtattccttgaacaattgctgttatcctgttcttttttcaaggtgcctacatttcatgttgctcaaacacacatgctgtacaatttgtgcagttaatgcaattattacagggtcctaaggtgacatagccttaggctgacaggattaagagattaaagacaggcataggaaatcacaagggtattgattggggaagtgataagtgtctatgaaatctttacaatttatgtttagagattgcagtaaagacaggcataagaaattacaaaagtattaatttggggaactaataaatgtctataaactcttcacaatccacgtttttctgccatggtttcagccggtccttctgtttggggtctctgacttcctgcaacatctctccctttctttttatataaatgtgccatggcgatgaaggcttgttcgttctctcgattttgacgcaggattctttgactggtccagcacactaaaaacaaaccgattaaacagagaaacttaattctaaaatttactacagtggagcccccaataggcttaatctaagtcgtggggtttaatctataaagattttctgccacctgatctaacgcctcagctccaggcagaatggataagtgagcttgagaggcttcaaaaatttgtttctttaattatgtctaatgataaattatcttctttacctagaaggtgtcctttgactttttcctatgaattatcagtctcattataggaatacggggtgatgcagaaatccgaagtattccaatcgcactgcatttgcaatgcgatgttcgagactcactacttgatctctaagccaaataacagactgtcttaaatcattaatttgatttgccaatttttgatcgatgccttgttgagaattccacatttgggtggaattggcttgccaatcattaacaaaatgagccctttgaatagattggtgtaatgccattctagcagtggtggccattgcagtgacagtaattaggcctatgataacagcaattaaagtgaaaacaaatctcttagatctttttttagaattcgctgtagcacttcattaattaaatgtattgagggggaggatacctaaggtctaggtaaagttaccggaacctagattccttcttgagctcgaaccaacattacacttttcctggagtcaaaatgggagttaatacaagtgtatagatgacaattgatgcatcggacggtttgattattcgtctaaattttgatatttcctactaacagtgtgtaaggaggcttaacacaactctgtatgggaatagtcaggttggaggtaagtaaagcagaatgtctgggtctacgttgatactgagagagtgggatggtaatgggaacaacagtcgaaatagttttcttttcctatactggcagtccagacatggcaatagccaatttttaaagttctgggtgttctgggctcagaatggggagtatcatacgaggcctgggggtgggtaatgcctttatcttcctattttaagagaaagaatgagctgatcctcgtatgcacagtagaatgatgattctcattctcctgataagaagtaaaataagtagcctccaggcattcctttccaccagaggagcaattgttttttaaatagccttttggtgcctagtctattactagaccatatgagtcattttttagtattactgcatgtgagttaacacagtcttcctaaattaaagttttagatgggccctcaaaatttttagggcatggttttcctgcaggtttatattgaaagtatggggtatctcctattactcctcctttcatttgttttaaaggagaaagggagagaccagagactaaatgtcctgttttatctgtagctgatgtttccggaagataagcagcctagacttgagttcgtagatggatgcaactaggtgcatgtccgaggcacagaggggggtatttataacctatggtaacattaaatgcagtgccttcttctcctggttgagcagggcaacggtcatctgtggctctaggcatccacacactatcgttagtgtagatttctgcaggagcatctatctaggtgagaggtcgaataagtggaggaaaaggcacataagcctaataagaataattatgtgtagcaggtaaatcagtgtgagaggaaactggtgagacagaaagtataaggaggagaatcattaaataaaacctagtgtaagcgagattgagtgctgaaggaggaagagaagaacagagggatgttattttcaggctaatagaaatggtgagatttttaggtttgtaaggagaaaaagaaaagtaatcaggagaagtgggattagttagatgggtctccattgccttcagggaggattgatttacacctattgtgatttgatgtgcctgtttctgaggaatcagcacagatctcatcatatctgaaggcagtctctgacacagacgtcttttctctgtggttttgattgtcagtattcacctgaagcttgagtcttctggtgggtacttagacaggggattgatgatctcctggtgaaacacaagcatatcctcttcctcatgttataattgtgccaggttcctaggtattggtttgggagtttttccataacactggcttgccttcgtttaaggaaaattttttgcctgtataatggcattcggctgcagttagagtattatctttaggaacatttaaaaaatttaaagtaaacaatgccaaatgtaattgggagtggggagttgttaaatcatgttttggttgttcagactgttgggacaattgggtttttaaagtgcgattgtaagggattctagtagtaggatctgtgatgcctttcaagccacaaaaactagcaagtttttattaaggattttcaaaagaggaaggagtgtgcgaataggtgtaggtgacagacatcaagtacttaacagggtaatagaatattacaaggcaagtggaggcaaggcgagatcacaggaccacaggactgaggcgaatttaaaattgctaatgaagtttcaggcactattgtcattgataacatcttatcaggagacaaggttttgagatcaactggtctgactaaaatttattaggcaagaatttcctcttcctaatgagcctaagagcctataggagactagagtctatcttacctctgcaatcttgaccataagagacaagtacgcctcaagggggccagttcaaagacttactcctaggtgcgcattctctttctcaaggacgttccatgctgagaaaaagaattcagcgatatttctcccatttgcttttgaaagaagagaaatatggctctgttctgcctggctcaccagcagtcagagtttaaggttatctctcgtattccttgaacaattgctgttatcctgttctttttttgaggtgcctacatttcatattgctcaaacacacatgctgtacaatttgtgcagttaatgcaattattacaaggtcctaaggtgacatacatctttctcggctgacaggattaagagattaaagtaaagacaggcataggaaatcacaaaggtattgattaaagaagtgataagtgtctatgaaatctttacaatttatgtttaaagattgcagtaaagacaggcataagaaattacaaaagtattaatttgaggaactaataaatgtctataaaatcttcataatccacgttcttctgccatagtttcagccagtccttctgtttaaggtctctgacttcctgcaacaaatatccctgatgaacatcaatgcaaaaatcctcaataaaatactggtaaaccgaatacagcagcacatcaaaaagcttatccaccacgatcaagtcagcttcatccctgggatgcaaggctggttcaacatatgcaaatcaataaacataatccatcatataaacagaaccaacaacaaaaaccacatgattacctcaatagatgcagaaaaggcctttgacaaaattcaacagcgcttcatgctaaaaactctcaataaactaggtattgatggaacttatctcaaaatagtaagagctatttatgacaaacccacagccaatatcatactgaatgggcaaaaactggaagcattccctttgaaaactggcacaagacaggaatgccctctctcaccactcctattcaacatagtgttggaagttctggccagggcaatcaggcaagagaaagaaataaaaggtattcgattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaatagagagccaaatcatgagtgaactcccattcacaattgcttcaaagagaataaaatacctaggaatccaacttacaaaggatgtgaaggacctcttcaaggagagctacaaaccactgctcaatgaaataaatgaggacacaaacaaatggaagaatattccatgcttatggataggaagaatcaatatcatgaaaatggccatactgcccaaagtaatttatagattcaatgccatccccatcaagctaccaatgactttcttcacagaattggaaaaactactttaaagttcacatggacccaaaaaagagcccgcattgccaagacaatcaatcctaagcaaaaagaacaaagctggaggcatcacactacctgacttcaaactatactacaaggctacagtaaccaaaacagcatggtactggtaccaaaacagcatggtactcgtaccaaaacagagatatagaccaatggaacagaacagagccctcagaaataataccacacaactacaaccatctgatctttgacaaacctgagaaaaacaagcaatggggaaaggattccctatttaataaatggtgctgggaaaactgggtagccatatgtagaaagctgaaactggatcccttccttacaccttatacaaaaattaattcaagatggattaaagacttaaatgttagacctaaaaccataaaaaccctagaagaaagcctagacagtaccattcaggacataggcatgggcaaggacttcatgactaaaacaccaaaagtaatggcaacaaaatccaaaattgacaaatgggatctaattaagctaaagagcttctgcacagcaaaataaactactgtcagagtgaacaggcaacctacagaatgggagaaaatttttacaatctacccatctgacaaagggctaatatccagaatctacaaagaacttaaacaaatttacaagaaaaaaatcaaacaaccccatcaaaaagtgggtgaaggatatgaacagacacttctcaaaagaagacatttatgcagccaacagacacctgaaaaaatgctcatcatcactggccatcagagaaatgcaaatcaaaaccataatgagataccatctcacaccagttagaatggcaatcattaaaaagtcaggaaacaacaggtgctggagaggatgtggagaaataggaaaacttttacactgttggtgggactgtaaactagttcaaccattgtggaagacagtatggcaattcctcaaggatctagaaccagaaataccatttgacccagccgtcccattactgggtatataaccaaaggattataaatcatgctgctataaagacacatgcacacgtctgtttattacagcactattcacaatagcaaagacttggaaccaacccaaatgtccatcattgatagactggattaagaaaatgtggcgcatatacaccatggaatactatgcaaccttaaaaaagggtgagttcatgtcctttgcagggacatggatgaagctggaaaccatcattctcagcaaactatcagaaggacagaaaaccaaacaccacatgttctcactcataggtgggatttgaacaatgagaacacttggacacagggtggggaacatcacacactggggcctgtcgtcgggtcgggggaggggagagggatagcattaggagatatacctaatgtaaatgacgagttaatgggtgcagcacaccaacatggcacatgtatactataagtaacaaacctgcacgttgtgcacatgtaccctagaacttaaagtataataaaaaaaactataacatgaaaaaaataaataaaagtaaagttttttaattaaaaaaaagataggaattatttctttgataaaaccaccaaaaaaaagttctattcacttatttcacatcaaaaaagaatttgagtgttagaccaagtaatatgttaatgtcttatgactgttaaatgatacctatttaacacctttatctctctgaattaatgatacttggtgtgaatatttattccaacaaaagtaggccatctaagattatattttcctcacagatggttgagctcttctcacaccctctatagccttaatatatagactgtaaagtatactgtcattttaaaaaaagtgaaaaggatatttatatcaggctaatcaatttgaattttgggtaatgaacacaccaattacccgtgttttccaaatctcatgtgcacaagggactatgaatcatgtacttcattaaagtgcaaggcacattactattgaattttttctgaattcatattacattattattattagtgtcaggagatactatttaattcagaaaaaacagcctggacaacatggtgaaactccgtctctactaaaaatacaaaaattagccgggcgtgatagcgcatgcctgtaatcccagctacttgggaggctgaggcacgagaatagcttgaactgagaatgtggaggttgcagtgagccaagatcatgctactgcactccagcctgggcaacaagagtgagtctctgtctcaaaaaaaaaaaaaaaaaaaaaaaaagacgagataccttaacagacttttttttaaatcttgtgattttactagcttagaaaataattgatatcataattgaagcataattttatttaaaaaaatacattttgactctgtcctcacctctctttccacatcaccttagtgaatggtgagcagaaaaggtgtttgctaaaaatagagttcacagtcagatatgtagtaaacttaaacatatttgcaatatgtaaagaattctcaaaactcaataataagaaaacatacaaacaacccaattcaaaatgagaaaagatttgaacagatacttcaacaaagaagataatacagatggcagataagcacaggaaaagatgttcatcattagtcattaggggaatgcaaattaatgccacaatgagatacctgtaaacatgttttacagtggctaaaatcaaaaagactgaccataccaattgttgacaaagatatagaacaatggaggccaggtgcggtggctcacacctgtaatcccagcactttgagaggccaagacaggcagatcacaaggtcaggagatcgagaccagcctggccaatatggtgaaaccccatctctactaaatatgtaaaaattagccaggcgtggtggcaggcgcctgtagtcccagctactcaggaggctgaggcagaagaatcgcttgaacccaggaggcagaagttgcagtgagccgagatcatgccactgccctccagcctaggcgacagagcaagactccatttcaaaaaaaaaaagaacaatggaaactcataacactgttagtaggaacgtaaaatggtataaccactttggaaaacagtttggcagtttcttaaaagttaaacatactcctatcatatagcccaggcattctactccttagtatttacctaagaaaaatgaaacacatcttcatacaaagacattaatattcatagcaactttatgtgtaatagccaaaaaatggaaacaactcagggtccatcagcaggtgaaaggataaattatgatacatgcatacaatggaataccactcagtgttaaaaaggaatgaactattgatacatgcaacaacatggatagattcaaaatcattatgctatatgaaagaagctggacaataatgagcacatactatatgattcaatttatataaaagtctagaaaatgcaaactaagtgacagaaagtagatcagtggctgactggggatggggatgggggctacaaaagggcatgaagatacttttgagcatgatggatgtgttcattatcttgatcatggtaatggttttatggttgtaaatatatgtcaaaacttatcaaattgtacattttaaatgtgcagcttattgtatgtaattatacctcagaaaagctttttggagaaaacaaaaaaatatatattcagagtctatctctctttcaccctttttattatttccagctggtttcatccaccatcatctttcacctggattactgtaaaagcctcctaactagtcttcccgctttttttttttttttaaaccctcatctccttccaatctattctcggcaaaactactaatgtttatttacagttcagggttgaaggctgggcgtggtggctcgcgcctgtaatccgagcactttgggaggccaaggcaggcagatcacgaggccaagagatcaagaccatcctgcccaacatggtgaaaccccgtctctactaaaaatacaaaaattagctgggcgtggtggtgcacacctgtagtcccagctactcgggaggctgaggcaggagatttgcttgaacctgagaggcagaggttgcagtgagccgagattgcgccactgcattccagcctggcgacagagtgagactccatctcaaaaaaaaaaaaaaaaagttgagggttgaaaatttacctattagttctgtaattgctctggcttggatatcttgtactgtgttgaataaaagtgagggaaaacaagaaaaattacctattgaatacagtgttcactatttgaatgatgggcacactagaagccaaacctcactgttatgcaatataaccatatagcaaacctgcatatgtaaccccagaatctataaaaataaagtcagatcatgtcactctagctcaagaccctccactggcttcctctcctactcagaataaaagccaaaggcccgcatggcctaccccagccttgtcatctctctgatctgacccgctattctccttgaccccttcacatcacttcacacacattggtctcctggctacttcttgaaaattccaaacatactccctccattgggcctttgcattggttattttctctgcctagaccactccctcacctcttctaaatgtcactttctccattgggcctactctgaccacccaatttgtttttgtttttgttttttagaaatggggtcatgctctgttgcccaggctggagtgcagttgcagtcatggctcactgcagccctgacctcatgggttgaagcaatcctcagcctcccaagtagctgggattacaggtgcatgccaccacgcctggctaattttttaattttttcatagagacaggttcttgctagatcttgaactcctagcctcaagtgatcctcccatctcagcctcccaaagtgctgggattacaggtatgagccaccacacccagccaaccaccctattttaaatatcaaggtacccaatccctcttacctgctttacttttttgccttattccatagtacttttgacatactctacaatttaccttttttgtgttttctcatcttcttgcactagaatatgatctacatgagggctggaatctttgttggttttcctcatgtatgccaaatgcataggacaatgcctggcatataatcagctcttgaaatatttatgaaattaatgagtgcttatagcatatgaatcctcaagatacattggcaaattagagtaggaccaaagtggggagaagagtaagaagaggtttaaaatacacatgagggaccaggcacagtggctcacacctgtaatcccagcactttgggaggccaaggtgggaggaccccgtgtgagtccaggagttcaagaccagcctgggcaacatggcaaaaccccatctctacaaaaaatacaaaacttagccaggcatggtggcacttgcctgtagtcccagctactcaggaggctgaggtgggaggattgcctgagccagggaggtcgaggctgtggtgagccaggatctcaccactgcactccagcctgggcgacagaatgagaccctgtctctaaaaatatataaataaataatgggggattcatttatttttgagacagggtcttaacgctgtcacctaagctgcagtacaatggtgagatcctagctcaccacagcctcaacctcccaggctccaacaatcttcctgcctcagcctcccaaagtgctgggattacaggtgtgagccaccacacctggcttgcagtgagctatgatcagcccactacactctagcctgggcaacagaggaagaccctgtctcaaaaaaaaaaaaaaaaaaaaaaaaaaaaaaaagcgtgtcctaattagaagagtctgtaattgttatagtccatgacaacgtagaatgctgaatcagttgtggaattgatttttcaaatgcttgttttacctggcaaatcatgtcaaaggtaacctgaggccaggcagagtggcttacacctgtaaatcccagcactctgggaggccgaggcggaaggatcgcttgagctcaggagtttgagaccaacctgggcaacatagcaatactccttctctattaaaaaaaataaaattagccaggctggtgcacttatatcccagctactcaggaggctgaggtgggaggatcactttgagcccaggggtttgaggctgcagtgaggtatgattgtgccactgcacgccaacctgggcgacagagtgaaaccctgtctcaaaaaaaaaaaagtaacaatgcctttataataattacgatttgttattttagccacatagccatatatatgaaatttacgtgacctattatttcagccctttattgctgaaaatgaaatattattttattactatcagtttaaccttaatatccctcatttcagattgcttaccagtatcatggaataaaatctccaatctaaaattcaatctgagttttatatttaagaattttagctttattatttgttttagattaagcttctgcacttttttaaacggttatatatgttcattatctttcatcttacataggagcgggatcgttacgcctacaagattcatcttccagaaacagtagagcagctgaggaaattcaatgcaaggaggaaactaaaggtaaattaaacaaatcagcaaaaaagccaaacagatatagttaatgatcatgtttttattctattttggtgcccataaatatgtactaatgctggccattgtttttgttgtagctaaattctcatttccaaaaattaccaccacttcaataagattttggctttttaaattatttaaggtagtatatcagtatgagtctgaacaataaattataatagaagattagttgtattttagatttgtcttaaatttatagcagagatatattattatccattattattgaatatgaatctagaccatgttttttcaaacttaaatattttgacaaatgtatgtttagttcaatggaaataactttgaattagaattggaattaggggccgggtgtggtggcttatgcctgtaatcccagcactttgggaggccgaggcgggcggattgcctgaggtcaggagttcaagaccagcctggctaacatggtgaaaccccgtctctactaaaaatacaaaaattagctgggcctggtggcaggcgcctataatcccagctactcgggaggctgaggcaggagaattgcttgaacttgggaggtggaggttgcagtgagctgagatcacaccattgcactccagcttaggcaacaagagcaagacttcatctcaaaaaaaaaaaaaaaaaaaaaaaagaattggaactaggattgaacaactatcagaaagcagtaaataaaatcttacactaccttgatctactagaaaatattttcagctcagatcacttttctcaccttctttattcttcctaggtgtctttctccctcttactactctccctatcctccacctcaccaaaaaaaaaaaaaaaaaagaagaagaagaaaagaaaactggtaatcaccccatatggggagtccatttgactttaaaaggttctgaaaaagaccagacataaagtaatggaatcttttcagcactgagagaaaatgctgagagaccatcccccacccaaccctccagagtaacaaagggaaattgattatcttaacttcttagaattaatttatgtttgacttacttttgatactgaaaaatgttaactgttctctaagtggttgattagatagtagtcttccttagtcacatgactcctgccaactataaaacttttcttcttaagtattttcagatatgccataaattctaataataccattttatttttcaacccctgaaattagtgaattattatgtataactctagacttataaaaacatttatatgaattttgaggaaactattaggctacaatattatcctatagacctgaaacttttaacatggtacccactggccacatgcagctatttaaatttaaattaattaaaattaaataaaattaaaaggtcagtttcccagtcacactagcacatttcaagtgctcagtaaccacagttggctagtggctactatattagacagcacagatgtagcttgggacatttccatcattacagaaggatctattcaaccatgctactatagaacaagggaaatattaacatatcattgttggtgttgattattcccattttagcctttcttctcactgattttgcagtcaagggttcaaagtgactcttctctatttgctttaaaaatccttggccaaaataattattaatgataagccattattgagatggtagccaaagaagtttcccaaaacttttattctttttgccttgatatccacctaaacctgtgtagcctacaaataaaaaactcttttattattcaaagtgaaatttggtcaactgtttttgaagttagtttcctccccaaagaaactattattacacttttttgtcaacttttctataagtcattctaaacctaattgctttggcctcatgtgacattacgctgtatggggttgaacctttcattgcccaaatacaaacatttcaccagagagcttgggcttgccccatcacaagaaacacatgctgtacttctcccggggccacagaatcagacttgggcctaaaatagccaaagtggtgactaagattcatttggacagggccaagctgtcaaaacagagaggggtcatgtggatttaccacatccccttgcagggctatttaaagttttaagacccaccaaacaacctagaactaggaacatcagcagggtcattagtgaatgtgtttggcttctgataaggctgtattcttttgagtagttcagccaccttgttaaaacatgttacacctaccatcctcaaggaactaattcccattctgcctcttcagtggacttctagaacagagattgcaacttccttggctttcagagtccaccacacactttattttcacacaactaggtgctcatcctacccagacactattcttaacctcctcagtggtgggtgacagtttaatttgtaatgactcccttggaagtgattaaaagggagttcacagaaagcggtagaaaattacttttgtggccaggcacagtgtttcacacctgtaatcctagtacatttggaggccaaggcgggcaaatcgcttgagctcaggagttcaagaccagcctgggcaacatggtgaaaccccgtctctacaaaatatacaaaaattaaccaagtgtggtggctgtgcatgcctgtaatcccagctattgggggcctgaggcaagaggatcacttgagcctgggaggcggaggttgcagtgagccaagatcacgccactgcactccagcctgggtgacaaagtgagaccttgtctcaaaaaaaaaaagagaaaaaagaaagaaagaaaattactttggtaacttagtcatgatggaatgatggaaaatgtattttccccattttggttaccacatgtttcatgtgtcgagttttttcctcctaattcatactaagctctggaattgtaatacttcattaaaaaaaaataaaaaaaaagaatcctctagataacaatactttctttaataaactacatcgttctgagcacagaactgaatatgaggacattttctcaaactgaatattaggatacatgagacagactgcatgatctccaggctgtgtggaaaatctgtgctctgtggtctggggcttttgagggggcacacctgtactctaaccctggctgtcatctactgaaggaggtactgaggaaagtggtaactgttgttatctgaggatgtctatccagagaagagactcaggagggaatgtattctgaagtcatccctattgcttcttcaattatttctacccctagaaagcaaattccccacagtgaagtgtgttgaagaaattctatacaaatagaagcaatattctatgtttgggtaagtttattgcagtccatttaagaaatggtgagtcgagtccacgtgattcagttaagaggataaaatcatttatttcctatatatacagaaagcaaggatttctaataactttctacagtttttctttattattattattatttttttttttttttttgagagagtcttactccatcacccaggcttagagtgcagtggcgcaatctcggctcactgcagcctccgcctcccaggttcaagtgattatcctgcctcagcctcccaagtagctgggactacaggcaccaccacatccagctaatttttgtatttttagtagagacgggatttcaccatgttggccaggctggctttgtactcctgacctcaagtgatccgcccgcctcggcctcccaaagtgctgggattacaggcataagccaccgcgcccagcctttattaattttgcaaattgcaaaagtattctctgacttactgattggtcacttgtgttcctgaactgtgcataactacgaaaggtttgtttaggagtgccattttctaatactgtataaagctgtactatccagtacagtagtaaatagccatatgtaactgtttacatttcaattttaataaattaatattaaataaaaagtaaaatttggttgctctgttgcgctagcacctttcaaatgctcaataccacgtgtgactgatggctactgtattagacagcacaggtttagaaaatttccttcatcacagatagttctattgtatggtattgctatagagtcttggtaactgcagagtaatgcttatacataagcagcactttttgataggtcaaccaggaagctataatagatattttttggcaattttctttctgttagttcaacaaaaactaacttaaagatttatcaaagacctttgtaccgtaatgaaacccagcatttacatacagtcctctctgtagtaagggtttgtacaaaggcagtaaattgagatagcagtcgttgtgggcttcagctaatcagagcattaaatctggtatccaaaaggtaacctttgagcctgagcaacataaggagaccccggctctacaaaaataaaaaatttgccgggtgtggttgcacacgcctgtggtcccagctacttggaaggctgaggtgggaggatcacttgagcctgggaggtcaaggctgcagtgagctgtgatcacaccactgcactccagcctgagtgacagagtaagactctgtctcaaaaataagcggggtggggaccttaattctaaaaactgaaaacttattctggtatgagcagttccgcaaatattctggtatgaacagttccacaaataataagtgaagtgattttgatcttacatattgattttacaaatcaattaatttgtgattttttttaagaaatacatatataggccaggcacggtggctcacgcctataatcccagcactttgagaggctgaggcgggcggatcacctgaggtcaggagttcgagaccagcctgaccaacatggagaaacgccatctctactaaaaaaaatacaaaattagctgggcatggtggcacatgtttgtaatcccagctactcgggaggctgaggcaggagaattgcttgaacctgggaggcggaggttgcagtgagccaaggttgcaccattgcactccagcctgggcaacaagagcgaaattctatctcaaaacaaaaaaagaaaagaaatacatatatagatatatgttgttttttcttttttaattgagacagggtctcactctgttgcccaggctggtctcaaactcctggactgaagcaatcctcccaccttggcctcccaaagtgctgggattacaagtgtgagccaccatgtcccaccagtttatgattctgaaatgtagaatatattacttcctgttgggcaatagattttgaaaattatgtacatttaagaccatctctataaaatacttttacatagacccaaaagaatttctaagatatctattctgtgcaattactcttaaatataactatatctagtacacttacaagtctcatttttcattttctctagagaaaatactgcagcctcttttagtcatatatcctgactgaaaattatgaaattaaaggttttagacctatgtttaggttatgtttgagtattatatatgtataggctatgctgactaaactgaatgataactctggttttggctatatggagacatatcaaaagttctgatttaattaatcatctcacctaattatcatctaggacctaattattaagtataatcaacccaaattctttaacatctctaccttgaaatgattttcttgacttttggtcatctctgttcagcctcaacctctccaaattctccaccctttttagggcttttgagttcagtcgtctgaattctaataggatgattatctttcaaatttctttgtcacactcctattggtatgttctggtgatacactttctcccctcagtatatttccctgttcactcaggaatatgactatatattaccttgttatttaggtacaaagccaattattctatatctgatacttgtatattttgtatttagatgttttaaaatgtaccctcctgccatgactgtgtattgccttgttatttaggtacaaaaccaattattttatatccaatacttgtgtattttgtatttaaggtttaaaaatgtacccttctgccattgtgcctatcaaacttcatgatgcgtgtttctgagctcaggaaataccaaaaagggagtattcggtttttggtttttgtcttcaagtcagcaatacatctttgttcagctcttgtgttcctcaataactttgttccctccttaagtgcattcagtagttaaacttagcagaaatctgacctaaccattttcttgttttccacttccttaaatgccacacagaatcatctagccagaagcataccattttgatgtttgacatattgacatttcaagaaaactataattatgattaagaattatttctagttcttaactacaaattaaaaacttgtggtgctctttttctctgaatttataatctgccttctcctttctaggttaatttgcttgatagaaaattacaactttaatattatttatcttaacagattgtgaatagtctaattaactcaaaagtattatgtttcgcccttaaaagatactaaattataccttctaaattaaagcaggtagaaaacttctttgtcaagggtttaataaaccagaaagtttgaagaactacttgtataaaatctgattttttaattgttgtattacattattgctatcgatgagcaatattacattattagcaatcagtagcaataatgtaatacaggggttggcaaactatgacctgggggtcaaatccaacccactgcctattcttgtatataaagttttattagaacatagcaaagtacattaatttgcatattgtccatggctgctttcacactacagtggtagaactgagtagttgcaaaagagatcatatgacctttagagcctaaaatacttactgtctgattatttacagaaaaaaaattgctgacccctagtatagtagaaatccttgaactggggagagtagtcattgaatgtcaattatgtctactcttcattatgtctctaagttgacagagaccttaacaggttgctaagcctctctggacctcagttttctcgtctgcaaaatgagtcccttagaatgaataatctctaaggttgattctcaaactaataaaattatatgaatccgtgacctatttcagaatgatgttgctgttttacataatggcttgcattgaatatttaaaccatctatagtcactgggttcagacaactaaatattaggtggggcaccatggcttacacctgtaatcccagcactttgggaggctgaggccgtaagagtgcttgagccccagagtttgagactagcctgagcaatatagtgagactcagtttctattatttaaaaaaaaaacaaactacgtaaacaaaactgctagtcataagacagataaatttaaagcatactactattgtttcaaaagcatttgcatctcagggctcttttagatactgttttcctagtagtataggtatttattacagatctttgacaatagtagcaagaacaggccttgaagcgtataactaacatcttaagaaatacagttgtacttcatttggaaataaaaataaagcatctctaaaagcctagtttccgtgtgtgggaaacgtgatttgatatataaaaattccattcccacccagcttttaggaaacatgtataatacgtaaagtaaaataagtttttataaaaagaagaactcaacattcactactgttttttcaacatggtaactataattctgcataagaacctttcatgcgtaactttagactttcagaaatctcaaaagttacctggaatgttaacatcaatatcacttctctctttttgcccttccctttctacagtaagtaaactttgtggaaatatattttattaatgttttctggccaggcgcagtggctcacaccagtaatcccagcactttgggaggccgaggtgggtggatcacttgagcgcaggagttcaggaccagcctgggcaacatggtgaaaccccatctctacaaaaaaatacaaaagttagccaggcatggtggcacacgcctgtagtcccagctacttgggagactgagatgggaggatcacttgagcctgagaggttgagactgcaaagagccgagattgtgccattgcactccagcctgggcaacagagcgagaccctgtctcaaaaaaataataataatgttctcatattagcagatacctaaacacaaacaagttttatctttccagaaaaattcaagagttaatatttaaaatttagacttagactacttaggtgatttgataaactaactaaatgagtgattctacatagaccagcaaaaggctgtgctcatgttctagatctttattagtagagttagtaatgatatgcacttacagaatgctttacaatttgcaaagcactttcattaatacattatgacttttgccaatcctgtaagataagtccattttaatattctttttttttcttttttgagacggagtttcacttttgttgcccaggctggagtgcaatggcacgatctcggctcaccgcaacctctgcctcccgggttcaagcaattctcctgcctcagcctcccaagtagctgaaattacaggcatgcgccaccatgccgggctaattttctgtatttttagtagagacggggtttctccgtgttggtcaggctgatctcaaactcccgacctcaggtgttccacccgcctcggcctcccaaagtgctgggattgcaggcgtgagccaccgcgtccagcccgttttcatattcttactttacagataagaaagcctagagaggttaaatgatttactcccaaataccacatgttctcccttataagtgggaactaagctatgggtacacagaggcatgcagagtagtataatggacactagagactcagaataggggagggtggaggggcaagggatagaaaatcacctgttgggtacactgtacactactcagaagacagattcactaaaagcccacacttcactactgtaccatttatccatgtaaccaaaaaccacttgtacccctaaagctgtttaaataaaaaataaaataaatatgatttactgaagcagtaactcccaacatttttccactctacagtcctaagggatgtcatgcactcaaatggcagtgatttccaactaggaataaggggaggctatgcatatagcttaaaagagtcatatgtagttgattctgttgtgtggcctgatggagaattactatacaaaagtaagacattgtcattgttaaaacaaaaagagggaaaaaagattttaaaaagaaaaatgacacataatcctaccacccagagataattaataacattctggtgtatatgcagtcttttatatccatattaacttttttacccaaaaatgagattataatatacattgattttaaacctttttcatgtaattaatcacagacatcttttcattccactaaacacccttctacaacatcattttataataactgcagaatattccatcctgtgttacatgtttgaattcaagatgtaagtggtttcatatacttctacaattcccgattagtgttattctggtatatgcatatgtaatttatttcaaggaatctgaaataatttaaaaactacctctcttctagccatcatctcctatatatttgacttaatggataatccttaagataaataatttgttaaataacttatttatatttgtgtatttgttttaataatctattttttcatctctttgttttagggtgcagtactagccgctgtgtcaagtcacaaattcaactcattctatggggatccccctgaagagttaccagatttctccgaagaccctacctcctcaggtaattggataattcacttattcacctgtgtgggtcatttggcatttacatccattctctcccattgtgaataaacttttcctgtgcatttagttaaatcctccaacggattctaaggaagtttgtcagcaaccaaatcctgtctacatgtgtcttgttccttttcattttaataccaaagttgctttctcctgtggctccaaaaccaacacttcatttttttttcttttcacctcagtaatacttcttcccctttccacactctagacccagcattgcactccatccaatccaacatcctagtcagtcttttgggatctttctgattaccttctctctcaacaaaaacttctaatataagcttttccccaggtcagtcgtattagatcagactgtgggcagcactgctttgaatggaatctttcagtgtagagctgtcttgtgagttatctcctgaaacagttaccaagttcttctttctgtataaaaatctataacacggccaggcatggtggctcatgcctgtaatcccagcactttgggaggccaaggcaggcagatcacctcaggtcaggagttcgagaccagcctggccaacatggcaaaaccccatctctgcaaaaacacaaaaatacaaaaaaaaaaaaaaaaaaaaaaaaaagccaggcgtgctggcctgcgcctgtagtcccagctacttgggaggctgaggcaggagaatcacttgacccgggaggcggaggttgcagtgatccgagatcatgccactgcactccagcctgggcgataatgcgagactccatctcaaaaaaagaaaaaaaaaatctgtaacacatgcatacaagtatccaaaggggaagaacacagaagagttatttgttttgatgaactgtatataagtacccctgaaacaacctgccagtgttcacaaaatcattttataagccagtgcagtggtgtgcatgtgtagtcatagctactcaggaggctgaggcacccggctcagggggatcacctgagctcaggagtttgaggatgcagtgagctgtgatcacaccactgctctccaacctggacaacaaaatgagacctcgcctcttaaaaattaagagataaaaggccaggcacagtggctcacgcctgtaatcccagcactttgggaggccgaggcgggcagatgatgaggtcaggagatcaagaccatcctggctaacacggtgaaaacctgtctctactagaaatacacaaaaattagccgggcgtggtggtgggcacctgtagtcccagctactcgggtggctgaggcaggagactggcgtgaacccggcaggcagagcttgcagtgagccgagatcacgccactgcactccagcctgggcgacagagtgagactccgtctcaaaaaaaaaaaaaaaaaaaaattaagagataaaaaaataaaaaaccaaaaccattttataaaatgctcagatttccatcttaccagtgtaatattctcaagaatcatttactaaaaacccatagggtccatttatatgtatatgtaaatgcgtgtgtgtgtgtgttctaaatttttatttatgcattttttatttacttaactcctgaatcatgtgtcctctggcctcagctttttttctttctttcattagagccactccatatttgtcatctttgatttttgtactcttggactagcttcatcaatattcatatattaccactgggactgaggccctgggcccttcctaaagcctgaggtttctgtcccacagttagtaatataggaagaattaatgtgctaatgcttctttcctgttggtaccatgagcatctgtcagtatttatgcttctcctctcctctgtttatacatgtgtgtgcacctacacattcacatacacacacacacaatttcttaccaattagtatgtgcttgtaccttgtgcaaaatgacaagatcttgaggtgatggataccccatttaccatgatgtgatcattatgcccatatcaaaatgtctcctgtaccccataaatgtatactatgtacccacaaaaatttagaacttttttaaaatgacaagatcaactttcccattccagcagttatacagttcctcattttgacctttaccaattaggatgtgaatcttcctcttttgagtgaaggtgatttccaaaaacattcagaaatgggaatcttagagaagagactgaggagaaagccttgccatttttctcttgtgctgacttggtcattatccagagcccttcccacatgaaaggcagggatctagttgtgtttataggtgtggtccccagtgcttcttattgtttcacgtctgtcttttcttccactccattttgttccctccacctgtaacttcttttgttagctgaaacctctgtcttctctcctcacactcagattacagtggaccctatttaaggggagtggatccagtaatggtttgtattgtcatactgtggctgtatgatataatcacatgcttataatatatttaggataaatctctttgagattttaggtcaagatctctactaccattttcatctttagaaatggagctaaaggctgggcatggtggctcatgcctgtaatcccaacagtttcagaagccaaggcaggaggattgcttgagcctaagagtttgtgaccagcctgggcaacatagggagaccctctactttgtaagaagtcaaaatattagccaagcgtggtagcacacacctgtggtcccagctactagggaggctgaggcaggaggatcacttgagcccaagaggtcaaggctgcagtaagccgtgagtgcatcactgtactcaaaactggatgacagaacaaaactctgtctcaaaaaaaagaaaaggggccaggcacagtggctcatgcctgtaatcccagcactttgggaggccgaggtgggtggatcacttgaggtcaggagtttgagaccagcctggccaacatggtgaaacccccatctctactaaaaatacaaaaattagccaggcatgatggccacgcgcctgtaatccacctgaggcaagagaattgcttgaacccaggacacggaggttgcaatgagccgagatcgtgccactgcactccagcctgggtgacagagcaagactccatctcaaaaacaaaaggaaaggaaaataaaaagagtaatactctatgcatttaggaaaatatgaatatttaaaataacagtttaaaaacttgtcatctaataagaagtcaaacatgtttaggtatattgtttacgatgtaaaacaatttttctataaatgataattttctattttgattattgaaattcatacattatgcatttactagaattcatttaatcttatgatgaactgtgtattgcttgaagtggggctgggcacggtggatcactcctgtaatcccagtactttgggaggtggaagtgggtggatcacttgaggtcaggagttcgagaccagcctggccaaaatggcgaaaccccgtctctactaaaaatacaaaaattagctgggcgtgatggcatgtgcctgtagtcctagctaccaggagggtagggagccagggctgaggtaggaggatcacttgagcccaggaggcagagtttgcaatgagctgagattgcaccactgtactccagcctgggtggtagagtgagaccccatctcaaaaaaaaaaaaaaaaaatcaatgttgaaatattcttttctcatatttcaaatcaagtaattcagaatcagaacccaacgtttgatgtctgaaatcccaaacagttccagtgattgtactcatggaacatgagggctcactttggggtcagctgggggaccatgcttctggtggctcatgtagtgggccgaactgtggcttgataacctgcttgttctaaaatcatactgtttgttgtttgtccatatgctgccttcctcctaggacttctagcagcagaaagtaggtatccctttgttttcctttaaggtgtatcttttatgcaaaagtgtttggctttgcatggttcgtaatcagcttgactttttccttggctgtttgtgtgtagttgtttaagtattaattttaacactgcctggtcataaaattaaaacttggatatattgatttttgaggcattgttgcacaaacaatattaagttctcacttctttcataagaggaaaaaagacagtgttaaaatttcaacggcatttaatacttcacatctgaatttcacatacgaatacattaattctggggaaagagtaacatttattttagagtttgctttcaagaaaactttcagggtaagtgaatttttctttgacaattacatcacctgtaagtggtctttattgcttcctgttactgagtccattttcagtttatttggacctgtgaaataaattctgaaatcatatctcttaacaacttttaccatcagatagaacatttataaggaataatgtaatagctagattttaattacaaaggggcataatttgagtttgggagaaaattaaaatgtaagaaatgtacacacagttgagtacatgtaaaactgaggcaatctgaataagatgggtggattgtatcaatgtcagtattctggttatgataatatactatcgttttgtaaaatgttaccaatgggggaactgagcaaagaatacaagggatctctctgtattatttcttacaagtgcatgtgaatctacaattatctcaataaaaattctaattaaaaaaataaacctttacctcaaagataaatgagaaagcctgggtactaatgattgaattcattttcacattttcttacattagttatctgtagctcaaattgcagctgatttaatataaatcttatagtatattagttacctattgttgggtaatgaattaccttaaaacagcagttgtcatctcacagttcctgtgggtcaggaatctgggcgtggcttagctgtgtgcctctggctcaagatctctcatgagattgtggtccagtgctgctatctcaccggaaggcacaactgcaggaggaatcctcttccaagctcactcacatggttgttgccaggcttcggttccttactggctgtggtcctcttcacagggctggctgttcacagcatggcagctcacttcccagcacgaaagataaaagaggggggcaaaagtgagagacagtgcccaagactgaagacacagtctttacagcctaatctcatagtgacgtcttatcacttctgcactattctgttcattagaaatgagtcagtaagtccagcctgcactccaggggaggggactgattacacaaggctggaaataccaggagaccaggttactggggcccatcttagaggctgcccaccacgtacaaattaataactattaaaatgtaagattcttcccgtctagatttagcgctcctcttttttttttttttaaatcagccaacctgtcatgttatttgagaatgggcatcttggatgtatcagtagtgattttccttagttgtaaagctttacacgagtgggtacttaatagcagaatgttattaaagtactttgaaaaatctgtgctcgaagatgtttctatatggaagcataaactattttaataatcataatggcattagagattataacatctatacgctgacagaatacatatgcagagtttacttcctttaataaatttcaaggtatctgtaccataatccacatatggagaatctaaagcatgtatcaccatatgtaagttctcataacttgagttggatatggcacagatgcttatgtccaaaatacagtttccattacaggattcattattgcttataacttgattgataacaaagaatttgctttgtgcagtgggaataaaaagtgttgaacagggtgtggtgatagagggaagagattggctgcaaagggacaagagagaacttttttgaagtgatgacagtgtacacttaaatggcgacttttaacttaaaacagtataccttagtaagcagattttttttaaaaagtattgtgcttgcaaggaggggctttgattgagtaggtgataatgtgtgtgtgtagtaatacaatgtattaattgatcgctaatataatagaaaaggtattgattactcttagaagaagctaggctaggttcagattctagatttgctcagtgatgctgagtttcatagctatacattgtaaattaagaaatacacacacattgagaatttaatgtgttattttgtgaaaatctgagaagcaggaatgggatttaatgatctcaactgtcatccatctgaaaaacctaacttgtgattttaaataagatggcatactgccttccactattcccttttaaaaacaggaaatgtccctgcttttatctttatgaagttttatttatgaataaagtttgtactatttaaaaaaaaaagaaatacacaaatctttattgaaacaattacagtgaaaacttgggtatatcaaaactcattgaatggtacacttaagatttgtgtatttcattctatgtaaattttacctcagagagaaaaataagcattgcaatctttgctgaagtctttaagggtgaagtgtactaatgctggccactgccatttaatttgaaatgaatgaaaaatacgtgaactgatggatagatgggtagacatgtgataaagcaaatacagcaaactgtcaacatatgtaggatctaggtggtgggcacgattctttcaaactttctgtatgtttgaagcttttcgtagtaaaatgtaaggggaaaaacttttaagacatactcagcctactttaacactgagaactttttagtctaaacatttgactgtttatttttctgtcctccttttggtttatttttacttggtcaacctttttatgagacttccactctcgtaatgagattattctagactcaaagcttttattgaccttaaaagcatatttctctttaaagaaatagaaacattttttaaacagttgacatatttatgctttttttgactattatttcataatagtagcagaaaacttttgaaaaacttgtttgtactggtgagattatttgaaaaagtagaagtattcaaagttaaaatgtgcaggccagtcatggtggctcatgccttgccagcactttgagaggctggggtgggaggattgcttgaggccaggagattgagatcagcctgcacaacatagtgagatcccatctctatttaaaaaaaaaaaaagtatgattataaacctgatttttagatacaaactttattgccaaatgaattatgaaaacaaaatactattctgaaggcagggcattatagtatctaataagttcatgaatgtggaagtttggaccaagggctaggaaaaaaccttatatggtaaatcaaattgagattaaagagagaacagaaattaggcatcacgcctgtaatcccagcactttgggaggccaaggcgggtggatcacgaggtcaggagtttgagaccatcctggctaacacggtgaaaccccctctctactaaaaatacaaaaaaaaaattagccaggtgtggtggcgggtgcccgtagtcccagctactcgggaggctgaggcaggagaatggcatgaacccaggaggcggagcttgcagtgagccgagatcacaccaccgccctccagcctgggcgacagagtgagactctgtctcaaaaaaaaaaaaaaaaaaagaaattggacatcacctcattaccaaatgcaaatcattctgatgcattgctgaggataaaacatgattttgtgggtgggggacagtctattatggaaggaacactgaattaggagtgagacctgggttctaggatttgatcttctgcttattgcctgtggcccttggaaaggttatttaaccctactgagcctctggtttttcaaatataaaaacacttgctgaccaagcatggtggctcaatgcctataatcccagcactttgggaggctgaggcgggaggattgcttgagcccaggaatttgagaatagcctgggcaacagagagagacccccaactctacaaaaaactttttaaaaaattagccaggcatggtagcgtgcctgtagtcccacctgtttggaaggctgaggtggaaggattgctcaagcccagaaggtcgaggctgcagtgagccaggatcacgccactacactccagcctaggcaacagagcaagatcctgtctcaaaacaaaaaaaacacttgcctgcagagacagggttattgtggaatcacataaggtagtaagtataaaagcactttggaaattataagctgttaatacaaatataagtattaaaataatttcaaatgtggctttaaggaaacagtactataaaagaaattgttttctgtggttaagtctttctcatactttgttttcaattcttcagaatttactcagaaaaaaatcattttaatcaggccattttatgaagtgtcttggtacaaaggactctgcaaagtacaccccagaatacagaggtaaataggatacctacagtcctgccgttaaatcaactgccctctgaggtgaacttgtgtactttttattgattgattttgttttcaagatagttacaagtttattcagaggttttataggaaaaacagcctttttagtctttgagaaaaatagttattttatatgtgacagtattgatcttcaaaatgaaaactagtaacatcttaattagcatgtgctgcatgtgttatattaataatcactactgcctcggggtttaaaatctaaaacaaatagcaatggagaagcccgagaagtgtctttgtgtctatttatatcttataatgaattgaaacaccatgggatttttagatggttggtactgaactacagatatcaattatacacacatctatccaaccaagaatgtgttctgtggttctgtttgtcatacccaaagaaagaaataacggaactagaacaggtgttaatggaaggtgttaaaataatcaagggtgaagacagattttgaggttaagccaaaaatatgtatttattccatttgaaaagatgaaggagaaatggaataaaaactctaatttttctacctaattacagaaacttaaaaataggggcacttttcagagcttgaaatagacaacttgagtacaactagggaagtgcttcttttcatgattgagaacccatcaagttaatcatatttgggtacaagataagactataaatcagttcagaagaggtgacagatccaaggaggtttaatagacctgttggaattgtggctcttgcctactttaaatgcctgctaacagatgcctttgtgctttccagcaaagtatctgctggtcctgtcaacacagctttgatcctgtgtgggggtggtgaattcctgctcatccacctctctgcggctccccaactcctccctaggcagcctgtgtgtcagtttgtttttacctcttctataccgtttacttcagggtataatatgcctacttcacacaccagtctgagagccccttcctcagggccggtgatcatatctctgatttctctgaagcccttgcctagtacctagcaaaaagcaggaatattcaataaagattttggggccaggcgctgtggctcacgccagtaatcccaacactttgggaggcctaggcaggcggatcactcgaggtcaggagttcaagaccagcctggccaacatggtgaaaccccgtctctactaaaaacacaaaaaattagctgggtgtggtggtgtgtgcctgtaatcccagctacttggaaggctgaagcaggagaattgcttgaacccaggaggcggaggttgcagtgagctgaaatcatgccactgtatgccagcctgggcaactgagtgaaactctgtctcaggaaaaaaaaaaaaaaaagattttggttattgtctgacccaatagggcattgttcaagttcttttccaacctccatattcatgcataaaccacacaacttcttgttgaaggtttcctgtatgtttcctagcatagcctattagtgtagtaagttaggcaaaacatagactttgaagccaaacaaacccaggattgagtcctggctccaccatttactagttatgcccttccatgaaccttctgaagctcagttccctatctagaaggtgggataatatatctgccttactgtgttgtcctgaggatgttcctggaacataataaacactcaagaattgggagctgctgttagtgtttccttaagtacttaattcagtgcatactttgtagatattataaaatgaataaaataaagagctgccttaaggaccttacagctaagggaaaaaaagagtgaacaagcacgcacataagtaactcatggagtgcgctggtggtacaggaatggcatggagcacttgggaagttcacagaccaacaaatgatacatccctggtctggtacagccaaaattgcttcctggtcttgagactgaccatcttagtattcacttgataaaaggttgtttttgctttaatcttatattattaataaactgctacataaactgtatatcagcatgagcaatgctggtaaaaggccgagcacagtggctcaggcctgtagtcccggcactttgggaggctgaggcaggcggatcacttgagcccaggagttcgagaccagcctggccgacatggtgaaaccccgtctctactaaaaatacaaaaattagctgggcgtggtaacctgtagtcccagctgcttgggtggctgaggcacgagaatcgcttgaacccaggaggcagaggttgcagtgagctgagatcatgccgttgtactccagtctgggtgacagagtgagactctgtctcaaaaaaaaagaaaaaaaaaactcagtaagatttcagtaagataactgagtgaagatgataattaggtttctgtggtatcagctgaattttttaatatacaaaaaaggcacttgattagtatttttgttattgtggtttcataagtccagaagtttagaactggctttagtaacttgataaacctagcatcatttaattctgttgttgatgacatgctggggtcaggggttcagtgggacatttgggactaatttcttcacatcatctcttgctttccaaggctttcagtaaaggatgaagagaaaattggcttttaactaatttccagattttttgatggaggggggggcactctgaacaaagtaaatcctgagaagatcaggtagaaggaagtggattgggttaatacctctttaggaataacagaggagatgaggactgatttctgccatttatctcttttatcccacttaatatccacttaatgttttcagtgaaaggataccaatagcctggcaggcataattcaaaatttaatattatccagccgggcatggtggctcacacctgtaatcccagcactttgggagctcaaggcagaaggatcgctttagctcaggagtccaagaccagcctgggcaacatgacaaaaccccatctctataaaaaatacaaaacttagatgggtgtagtggtcccagctactctgggggctgaggtgggaggatcacttgagcacaggaggtcgaggttgcagtgagccgagattgtgccactgcactccaacctgggcaacagagcaagaccctgcctcagaaaaaaaaattatccaggccaggcgcagtggctcacgcctgtaatcccagcactttgggaggccaaggcgggcagatcacgaggttaggagtttgagaccaacctgaccaacatggtgaaaccccgtctctactaaaaatacaaaattagctgggcgtgttggcacgcacctgtaatccccgctactcaggatgctgaggcaggagaatcgcttgaacctgggaggcagaggttacagtgagccaagatcatgccactacactccagcctgggcaacagaacgagactctatctcaaaaaaaaaaaaaaaaattatccatagttccttcaacagacgaatggtcaaacaaactggtacatccacacaacaacctggatgaagccccagataattatgctaagtgaaaaaatgcagtcccaaaaggttacatactgtatgatttcatttattctttttattttattttattttattttttaatttttagagggactcctccttgcagaccagggctaccccataggcagtatgcccagaataggagcctcatttattatcaaaatgacaaaattgtagaaatggagaacagatgagtagttgccacaggttaggaggggatagggtaggaggggaatgagcatggctataaaaaggcagtatgagggatccttgtggtaatggaatgttttatagctcgactgtatcaatgtcaatatccaggttgtgatattgtactacagttttgcaagatgttactattggaggaaactgggtaaagggcacatgagacctttatgttattttcttttacaactgcatgtgaatctacaattatctcaaaataaaaagtcaaattttaaaaaatagctacagtaatttccacgtggacagccacacagtatgtggcttaagacccaaatctttaacataattaaatagagctacaaaaatcagtagcttatatagcattttgttttgttttgctattgtagaaaaacttggaaagtatggataagaacagaatgaaatagaaataggacagtaaagataacaactgtaacacttttgctgtgtttcattctgttttttgtttttccggagtttgcatatatgttttgtttggttttttatcgtaactgggaatatacagtttatttagttttgcattctgctttcttgaattcttttttttttttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaagaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcctgttctcaatgagctgttgggtacacctcccagacggggtggtggccgggcagaggggctcctcacttcccagtaggggcggccgggcagaggcgcccctcacctcccagacggggcagctggccaggcggggggctgacccccccacctccctcccggacggggcggctggccaggcagaggggctcctcacttcccagtaggggcggccaggcagaggcgcccctcacctcccggatggggcggctggccgggcggggggctgacccccccacctccctcccggacggggcggctggccaggcagaggggctcctcacttcccagtaggggcggccaggcagaggcgcccctcagcttccagacggggcggctggccgggcggggggttgacccccccccacctccctcccggacggggtggctggccgggcggggagctgacccccccacctccctcccggacggggcggctggccgggcgggggtctgacccccccacctccctcccggacggggcggctggccgggcagaggggctcctcacttcccagtaggggcggctgggcagaggcgcccctcacctcccggacggggcggctggccgggcggggggctgacccccacctccttcccggacggggtggctgccgggcggagacgctcctcacttcccagatggggtggctgccgggcggaggggctcctcacttctcagacggggcggctgccgggcggaggggctcctcacttctcagacggggcggttgccgggcggagggtctcctcacttctcagacggggcggctgggcagagacgctcctcacctcccagacggggcggcggggcagaggcgctccccacatctcagacgatgggcggccaggcagagacgctcctcacttcctagatgggatggcggcggggcagagatgctcctcactttccagactgggcaagccaggcagaggggctcctcacgtcccagacgatgggcagccaggcagagacgctcctcacttcccagacggggtggcggccgggcagaggctgcactctcggcactttgggaggccaaggcaggcggctgggaggtggaggttgtagcgagccgagatcacgccactgcactccagcctgggcaccattgagcactgagtgaaccagactccatctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctaaggcaggagaatcaggcagggaggttgcagtgagccgagttggcagcagtacagtccagcttcggctcggcatcagagggagaccgtggaaagagagggagagggagaccgtggggagagggagagggagagagagagggagagggagagagagagggagagggagagagagagggagagggagagagagagggagagggagagggagagggagagctgctttcttgaattctatatcatgaagatttctctgtgtctttgaaattcttcaaaaacaattttcatttggctacatattccattatatggatattctataacctacgtaatcatcctctattagatttattttccattttgtatgataatatcattatatataaatcttccatttttttccttaaggtgggtttttgtaaatggaattactaaatcgaagtgcatgaacatttttaaggctttttgatatatgttaccagattgctttctggaaaagtggtactgatatatattctcaccaataattgcatgagaatggataaggtctaagtcaggaagaattagaaacagagttctggagcataaagatttttatctttatcaaaaatataatttctcaaccacagcactactgacattttgggccagataattctttgttgtgggggctgtcctgggtattgtaggatgtttagcagcatccctgacctctacccactagatagcaatagctgccctcccgctgtagttgtaacaaccaaaaatatctctaaacattgggaaatgtccacctgggtaacaaaattgcccctggttgagaaccactgatccaaagacttaaatgtgcaatgagacacttattcttagagtttctctactgtgtactaatgttctgaagcttagctccttggagctctttttttgtggagtatatatgtgtattctgcatattgcctgcaatgtaaaagaggctgatcttttttttaaggctgtgtaaatggctttgttactcctcattgtgtatctttccctactgacatctgcctggtttcctggttatgagaagaaacttaaagtgatggcacttccatttgctttgccctacaaaaatgatttgccttgaaatttaatatggtatttggaagtgtcagtcagcgtccctatactttgtctttatcttctgagtaagaagggtaagagtaaaacagaatgagaatgactttggatctcttgagtctgtatgtaaaggaaaaaaaaaggagtggactgggatttttgttaactaaagttcaagtcttaaaaactaagaagcctattttaagcagcaggagttcccagttgaaggtctgttccctgtatctacagctggctttaccttcagttcttgatggaatgcacctgggtaaaaggccaacctcgtttctataatatttcagaacatcttggagtcctgaaacccatactctcttcctgacataaaacttgctgtgtccagatcttctagtgcttaggttatacttgataaatttcattaattcaaagaagataagctgcagtttcctctgaaaaatgaagagcacacaaatacattaataagaacatgaactctctgaaaatactgtgtccttaaattatatgaaactcatttaagtctatccttcagtaaagacactagcctttgaagttctgatatgaattcattgttcttaagtgtaagatttaggtttaaaaagttagtttgacattgactttctatactggctgtttcttttctgtttgtcccccttaggagcagtctcacaggtgctggacagcctggaagagattcatgcgcttacagactgcagtgaaaaggacctagattttctacacagtgttttccaggatcagcatcttcacacactactagatgtaagtctgtctttttattattcttcttttttggtgaattgaatattggccgggcacggtggctcatgcctgtagtccaagcactttgggaggcagaggcgggcgtatcaggaggtcaggagactgagaccatcctggccaacatggtgaaacgtggtctctactaaaaatacaaaaattagccaggtgtggtggcgcatgcctgtagtcccagttaggactgagctgaggaggcggaggcacaagaatcacttgaacccgggaggcggaggctgcactgagccaagatcacaccactgcactccagcctgggtgacaaagcaagactctgtctcaaaaaaaaaaaaaaagaaattgaatatttagcatacctttttactttacatgaattctcagatgtctatcataacaattcttttcagttgccttaagcctatgagaaatgtgggaaatcatccatcaaaaattcatgattgaaatacagtatatggccgggcaccgtggctcatgcctgtaatcccagcactttgggaggccaaggcgggtggatcacctgaggtcaggagttcgagaccagcctgaccaacatggggaaaccccatctctactaaaaatacaaaattagccagttgtggtggtgcatgcctgtaatcctggctactcgggaggctgaggcaggagaatcgcttgaacccaggaggcagaggttgcagtgagccgagatcgctccattgcactccagcctgggcaacaagagcgaaactccatctcaaaaacaaagaaaaaagaaatacagtatatgtacagtacaaatgcaacagagcctagcaggctacaatgggaaaaaatttatatatctttatatttataaattatatgtacataatgcatgcaagtggtatgtgagttttaaaaaagagtagagtacaatcctactttactgaattatcttgtatttctgttaaaagaatccattgaggttagctgtgattactttttattgctttgcacattactttaaaacattatacctccagcatgagtataggagagagaaaagcaaatgagatactttgcaataggctgtattcccacacacatttcatatttaacattgttttgttccatagattcaatgtcttctccttaaaacataagcatatactccatctttaaatattacaggctccactgacagcagactgggatacaaaggaaaaaacagaagctgaccattttcatttcagtcacattttaagtaaaatacctttcttagagaacttggttcacttcagcaatgaaaactcttgggtggtttcgatggtatttgaacatgttagtctttttacaagaaaaatcttcccttaatgagagaatcatacttgctttggggtgcctagaactgtttggtgctgaataattcaccatatgatgtaaatgaagctaaagcaaaatttcccagaatgtgttctacagagcatggctctgggaggttgctatgggtgttgccatggtgggagggggaagtagatcttaaatttattggttaaattatttattgactaaataagtttgggaaatgctacattctttagtctttttatacagatccacaatgggtgttggtatattgatagctctgagatgatctaaagcaaagaaacctttttaactttctttatcagcatttctcaaactaatttgggcacagaacttttattcacaatcctgttgagttctgttttgatgaggaccagtttgggaaaagctcagctaagagtgtttgttgcattatgcttcagctttacactaaatgcagccgtaggtatctaacagttgcttctttccccaaatgtggtcagttcaaattaattatcagattttcatggctagtttggcctttgtatatagtgtacatattaattagggctgactaactgttataacatgtgattctaaaatttgagtggcttaacagaatagaagtttacttcttgctcacttcacagtccaatgcaggtagatgagggaggtcttttccacaccgtcattcagagacccaggcctcttccactaggtcacactgctatttcccagggtcttggaatcttctactgtatcctttgtacctagccagcaaatgagagaagagagaacatggagaatcttgcagggtcaagcttggaaatgggtttatctcacattctttggcaactgctagtcacgtgctcacctggatgtgagagctgaggaacgtagtttagaaatgtgctcaggaagataaggaattgggtcttctctttagtgtaatttatcttaagtagtatctattcactgtcattgctgcagaaagttttcacaattgtgtatttcccactgaagtttataccctttactagaactagttagtgcaatatttagaaaaggctacagcagtgtgtggagattttgtttattttattgtggtcagtgcttaggtcattgccaggtagatttactgaccttcttttgaatcaaggactttttgtaacaaagactttttgtaatttaaacactgagagaagcccaaattggtttcaaagttgtattttttcttactgatatagcaaggtatctgagcacatcaagcttgagattgcaggggagaagcaggaacattactggcttacacaaggaaaggggcagctattcagacacgaataactgctgcactgtttggtataaattgtcacaatttcagaagagattcttagatgttagtgagaaaaacatacttaactttcctttgcatttgtttacattataaagaagtatctgccttattggcatctgccctgtcagtgcaggtcaatttgaaagaggagctgttggactgaaaatgaaccatgcctattaaaaaggtgcagtataagaccaggagtagtggctcacacctgtaatcccagcactttgggaggtcattgtgggaggatcacttgagcccaggagctcaagaccagcctgggcaacaaagcaagaccccatctctacaaaaaatttaaaaagcagctgggcatggtggtgtatgcctgtggtcccagctactccagaggctgaggctgaaggatcacctgagcccaggaattcaagggtgcagtgagccatgatcacactactgcactccaacctgggcaacaaagtgagactctatctctaaaaaaaaaaaaaaggtgcagtatcttctgaattttgtaaacaggtgccatacatgagctccagtcaaattaatgactatgaggccgagccctggacaatatttgcatgcatgtggttctgaatctccaaactgagctatttctaaatgaaagtttaggccaggtacggtgactcacgcctgtaatcccagcactttgggaggccaaggcgggcggattacctgaggtcaggagttcgagaccagcctgaccaacatggtgaaacccatctctactaaaaatacaaaaatgtggtgggcacccataatcccaggtacttaggaggctgaggcaggagaatcacttgaacccaggaggtggagattgcagtgagccgagatcgtgccactgcactctagcctggtcaacagagcgagactccgtctcaaaaatgaatgaatgaatgaatgaatgaatgaatgaatgaaagcttaatcatcatgaatgaaataaaccatcattagaatgtgccctcataccctacatcccataaataaggcttattaagctcatttcacagctaacaggctacattttaataatataatcaatgaagaattcaagtgactgccatatagagaaatctaatcatttaaaaaattttaatatttaaatgtttgtggtatacattaaggaagaaaaatggctatgacgaactcttgaggagcagctgttaaaatgttggattttcagtctgggtgcagtggctcacttctataatctcagcactttgggaggccgaggcgggaggatcacttgaggtcaggtgtttgagaccagcctggccaacatggtaaaaccctgtctttactaaaaatacaaaaattagctaggcatggtggcgcatgcctgtagtcccagctacttgggaggctgaggcaggaggatcacttgaacgcaggaggtggacgtagcagtgagctaagatcacaccactgcacggtagcctgggagacagagcaaaactctgtcaaaaaaaattgggcctttcatttttctttcttcccatgttccacataccatggttgatttggaattgttttattttgcagaatcaaaacgaattcttctgcctttttttgtttgttgtttgttttttgtttaagacagggctctcccaggctggctcactgtagccttgaccttctgagctcaagcaccctcctacctcaaccacccaagtatctggaccacaggtgcaccaccacactcagcccttttttttttttgaagagacaggtctcaccatgtttgcccaggctaccaggctagtctcaaactcttgggctcaagcagttctcctgcctcggcctcccaaagtgctgagattacaggcatgagtcattgccccagcatgaattcctttttaaggattccaagtagggacacccagggggcatagttttatggaccatgaattaattaaggctaattaatcccactgagccattttaggaaatatctttaccatttttatgttatttctgttaactcaataacattctaaatagctaggtatgaagccataattttaaggctgacaaaaagaaacaggattaagttcctaagaaaaactaaagattatctatgacttctttattttttctagtcatgttcttaaaataataacaagctcaaaatttgaagaagcattattagaatttgtttacaggaaacaaaactgccaaactgaaacatttacattaaaatggagaagtactgtgattctactgaaagggaaatgctttctgaaaacctttgaatttgagtaaaacacatttagtttaatctgtagttagaaactgatacagaaaactctaaatatttgctatccaagtggttccagcctggcacacatatgcagcttctcattttgtgggaagaaatacagaggcatgaggaactgcttggtccagcttgttgcagtatgcctgtatttaaaaattaaaagcactggtgctaagatgatcttcgtatgaaatgtatagatcaattagtaaagtacaatttgacattagtttgctaggactgccataacaaagtaccacaagttgtgtggcttaaaacaacagaaattgattgtctcatagttctggaggctggaaagtcctaaatcaaggcattggcaggggcatgctccctccaaaggatccagggaagaatccttccttgtcttttccagtttctggtggttgcctgcaatccttgtcattccttgacttgtagatgcatcattccagtctctttttccgtcatcacatgtcattctctgtgcgtgtgtgtctgtgtatttacatggccttcttagaaggacaccagtcattggacaccctaatctagtatgacatcatcttaattaattacatctataaagacacttatttccaaataaggtcacattctgaggttctgggtaaacataaattttgagtgagggacaatattcaccccagtacagcatggaaaactgatttaaccctgaattaattcttcacgtgtgagtgcaaattacacaaatctaatataaaataatgaaatgttaccctgtcatccattaattatgctttattgggaattggtgttaaagtgttatttatgtcttgtaatgatattttgaatcagttatggattggaatttgtatgtgatacattggaaggtcagtgggtgggtgagtttttgatggactgaaaagccatgttttttggattaaaaacattttacaaatattatttggtagtagttttcagtcttctcagtttctagtataaattttcctattaaaataataaatgtttagtttgtaaatcaccagtgttacaaaacattgttaaatgacacatctctctgccaaactttgacaactaagttttaaacattaactggccatctgtcatacctctgaacagctgttagcatttgttacgcactgctgtttccatagtaaatgcccccacctaattaagattatttttgtaagaagtcttaaaattgtggtttctgaaaatataatgggtgattagattaatatagcaatttattgatgaatttttaaaattgcagtagcaattaatttaggagtctttataatattaatttataagtagacttttataatagacttagtaacttttaaatattgcattagcaattaactgatacttggaatctttcatattttgtatggccaacatctttattataattttttaccgtttagggagagttagcatttttccatctggcctggagttagccatggaaaactacaattcttgatttactatttcgcttttttgagatgacattaaattagtagccatatttagaagagcttatttttagaactcagaagtttcctaaaggaaaaagatggaacttctacaataatctggagataatgtttttgagcaatttggggtctgagaagtaagttaaatacaatgttaggtttggatatttaaagagattgccaatcaggaaatgccaaagctaagtttcccaagaatttgtagtccagccaatttgcatttaaatgtctagaataataaagcctatctgaggaccttcagaggatgagctactagtaatttctcagggccccatccagtcttaagagtcagctttggcaattatgaaaccagctgcacagtgggcccctgcccagtggtggtggtctttgtgcttcttgcctcctggggctgtagactgaagcgcattgctgttccctttgaatttgagtgtctctccactgttttctaactggaggggcaaaacctcccatatctgtttctctccatgtattgaagtagtattgtcagtgtaaaagtacggcatgaaacaaaatacctgaaagctagaaataccatatgtcgtgaatattctcaaagtatttttccttctttcttaatgtaaataaatgtcaataaacttagcaaaaaaaaaaaaaaaaagccgctaagcatatggttctttgttaagcagcaatagaaaactgatagaaccaggaacaagatgaggattgtccactccccacttctattcaccattgtcccagagactctggccagtgcagctaagacaagaaaaagaaattcagggcatgaagattggaaaggaagaagtaatatcatcctttcccagagttgttatcttgcatgtagaaaatactaaggaatccacaaaaaatctaatagcattataggcaagcttagcaaggtcacaagataccagattaatatacacacattatctaaatttctatatgtgagcaaaaaataacccaaaaataaaattaaagaaatattcacaatattataaaaagaataaaataggaataaattgaacaaaaaaaatgtaggatttgtatactgaaaactaaaaaatgctatgaaagaaagatctaaataaatgagcagagatatactgttggattggaggacttaatattgttaagatggcgcttttctccacattgatctatagattcagtgcagtccctatcaacatcccagtaggatttctttgtagaagtcaacaaggtgatcctaaaatttatataaaaatgccaaaacaattttgaaaaagaaaaaaattggataactgatttcaaaacttactataaggctacaataatcaaaatagtatggtgttggcataaggatagatatacagatcactgaaacaaaaaagagtccagaaataaaccctcacctttatggtcaatttattttcaacaagattgccaatgcaattacatggaaagggggatagtctttttttttcaaatggtcctggagcagttggagatccatatgcaagaaatgaacttagaccctgtctcataccatacacaaaagaaaattgcctcaaaatggatcatagattcactttaagagcttaaaactataaaacttttaaaagaatataggaataaatcttcattaccttgggttaggcaaagagttcttagatgtgacacaagggaatttggggggattacggaaatgttcttaagctggattgagatggtggttgtacaactatataaatttactatcatcccactagatttcacagggccattacactaaattaaaatttagctttgtggctaagaatttaccactgattcaaaaatactaaatatggttttttctcccaagaactgttttattaaccagcgtgtagttgtgccttatggaagaagtccaaattgtgttttttgtttgaaaatgttatgaattacataactttatagattttcaatatggaagacaccttagagcaacttattttagttcattccttctacattcaagtacatatttgccatttccaaaaattcacagctttttgatacttttttaacatcaattttttggtcttttttgttgtggcaagatatatataacataaaatttgccacttgcaccatgtttaagtgtacagttcaatgacattaagtatattcacattgttatacaaccatcatcactatccatctccagaactctttcatctttcccaactaaatgtctgtacccattaaatactgactcccattcacccctctccttagcccctggcaaccacccttctactttctgtccctatgaatttgactactctaggtaccacgtatataagtgaaattatccagtatttgcccttttgtgtctggcttatttcatttagcatgatatcttcaaggttcatccatgttgtagcatgtgttagaattttcttcctttttaaggctgaataatattccatcgtgtgtgtatagtacattttgtttgtctactcatccaatattgatgttttgtggttgataattatgtactaggaaaaaccaaattctcagaataaggctgtctaatcgtagggaattctgcctcgttccatctccacacaattactctttctaggatgcaagttaaatcttatgctatacatcttcgtgaaggaatgtgtgatttccactgaaagtattaatgactacggaagtccctccaattcccttatttgttcagataaattacttcttaaagcagggtttagaatttactctagaataccaagaataatgaatcagcttgtcaccagtatcagtgttacccactgagtgccattctctttttatgacaccatgatcaactttaccaaaaggcaaaggaatttgcagaaagccttctaagtacaataagcactgattcttctttatgctatgctcaaggaaaggaggggtttccccctagaaaggaatgtgatatgctcagttaaagaatgttcgatggagtggcttgcagcattcataatccaagaacatagctgttttcttctctttgtggcccttcaaacatgatctcataaaactcttctgccagactgcctttgtgctattctctttaaatttttcatgacagaaattcatttttgctacagctacaccaagtacaaatgcttggtgtttacctatgcaaaataaaaaaggtagcaaaagccaaaaataattaaataaaatattatctgacacacctaatgtaacataaatgttaccttttaaagcagcacattaataattgtatgttcatttaatgtaaatatcatttaactcttgtagttgcttaagaagagccaagctaggaaatgtgattttaacactttaaaaaaatagaaaggaaattaatatcatagtgaaaatttctcatagttgggcaagctcttgtatctgatactaaaaagtaccgtatttcagaagattttattaaaacaagataaaatctgcctatattatatcatgtaactggtttttttcctcatgctttcttttgctcaagaataggcattatgatttgtgttttacagggcttaattttagagttatttgaccacttgaaaaaggcatagagaacagtcaagctaggtcatctgaggccagtgtttgagtttctcagaaatagctgccaactgaccagaaatctgccacactggcctatgttgttaggccaccaaaggcacagtcttcttggattgaactaggaggtcaagcaagtcttaatttcttgaattcaaaaataaatccctgtaagtgcgatgttctaataggattagaacaaaagcagccctgtatacagacaaataaaacctaaacaaaacaagggcctccttagaggttcttttgctgtcaggatccaaaggatttttgcagctttttcaggaaatcttgtactggcccagatgtactgattttttaattgccttttttgctgacagaagaaaactttaataatggatttagagcagcgtattactaggccagctgcactccttcttgcaccttcaagtaaggatatattccccatcatgattttactaaaacttgatttaagttagcatttcactgctaagctattaaactaaagctttcccggaacacctaactcaagagcatccaggaacattcttcttggccattaaatacagtaagcagttgtccattacatgtccatcttcaacttgagttatgtagtacaaactgggccatggtattgggagcagccctgaaccttagtccagggaaaatctaaattccagggtggaactcttgctccttgatttcagtcactagatttaggaatttacacactttttaagatgagaaacaaatttagtgtaagatttgtaaaattttcaaaatgaatgaaatgaaatcttcaaatgaattcccttcaaatgaatggagtttgctatctccatgcagatagtcatctgtatgactattatttgagtgctttcaactatttaaaataaattgatttttagcaattttgtagaatataaaatttcaagaaaaacaatttttggtgcaggtaggataggcattctttgcacgtcaaaaaagaaaaatggcctgagtgattttgatttctttttgtaacttgtaatatcccaatgatacagaattgtgtttagatttgtaagaaggacaggttatagaagttcttccagccgggtgccatggctcacgcctgtaatcctaacacgttgggaggccgaggtgggtggatcacctgaggtcaggagttcaagaccagcctgtccaacatggtgaatccccgtctctactaaaaataaaataaaatacaaaaattagccgggagtggtggtgcgtgcctgtaatcccatctactcaggaggctaaggcaggagaattgcttgaacccaggaggcggaggttgcagtaagccaagatcgtgccattgcactccatcctaggcaacacagcaagaccccgtctcaaaaaaaagaaaaaagaaaaaaacttcttcctagtgtttaattgtagctccttaagtttttgaaaatgccattttaaattttgcaatgtttctttcacacttacgttgcccatcatgcaatctttaggccactgctaaatacactgctcttctccaagcttgaactacatgatgtttaatgatgccaaggatctttgaaaggactctgtgtgtgtgtgtgtgtgtgtgtgtgtgtcagggcctcagtctgtcactccggctggagtgcggtcatgcaatcatagcacattgcaacttcgaccttccaggctcaggcaatcctcccacctcagcccttcaagtagctgggattacaggagtgcgccaccacacctggctaatttttgtattttttgtagagacgaggtttccacatgtggcccaggctggtctcaaacacctagcctcaagcagtctgcccaccttggcctcccaaggtgctgggatgacagatgcaagccactgcacctggcctcaacaagtttatatgtaaacttgagcaagaaaaatagatttttagatcttacaaagttttctgtgatctccaacttcagaaaatcagttccagtacagtaattgaatatcagttctctgtgtttcagtattaaatcagctttccctaatattttgctcaatttcaaatgtatatgagaaaatacctgttatgtattgatggctgatctgctcagttcactgaaaagatgtgacattgaaactttgttcctatttacccacgtaattcacagaaactgaagaaagttcttaataagatagtcagtgtttccagaacaagttatttcaatggtcattattgctacacagtgtaattccgtgcacactgttattatctgttttattaggatcatcacagacacattcattaaatattttgcagctaaatatttgattcttgcaaactttcattcttttccagcaggaaacttcttcagtatctataaagtaagtgataagatgatggttgctaatgaacatcaatgttctttgcaaccctacaagcctatgcctacagtatagttgcaaaagttatcaacttgtctgaaacagtatacattctggtccttagatttggttttctctgtgcaaaaaaagttagtgggacatacaactcagtgataattattttatagcttcttaccatgcattccattttaaatgttgatcttgataaatactgcacataaactatgagcaaaacacaggtttctatttgataactaagaaatcagaagataatgtgatataatgagtatgataaaaaatgaaacttgatttagtgctttgaatgtaaataaaaggtgacatattaactgattttatcatctttatgtttgaaagtacaatctcaggagatttgaatttaatatcactaccaagtttattctgcttcatttgaaaacccatgtcaaatgtagaatgtgttctctttatggaactgtggcgacacttcctaagacagaaagatgaatgaagcgtgtcggtgtaggtatgtgtggtcatatctgactcagtaccagagatttgcagagagcaggcctatctgtgagacaatatgagacagtctgtttcccttgcagctgttcacatttccttgttttgccctggtgttgtgtgtacatgttttttgttttttgttttttttaataaaaagtgctgaatttgggtaatgataatttcattagaaaaagagagtaaacagtaacagattcattcttgttttccctctagggataatttattaacattcttccttctctcttcctcccccttcacacctcagctttacaaatacacctgataccttcaaatttcaggaaagcaaatagcaaaaggaaatacattttgtcattccaatataacttgaatttaagcttctagagcagggattcacaaactatggccctcaggccaaatccagctggccacctgtttttgtaaataaagttttattggaacacagccatgctcattcatttatggattattaacagccgccctcatacaacacaacagggtttagtggctgtgacagagatcatatggcctgcaaagcctaaaatatttcctatcttgccaggataggattaggatcctgatattctttttttttttttttttgagacagagtctcactctgttgcccaggctggagtgcagtggtgtgatctcggctcaccttaacctccacctctcgggttcaagcgatcctcctgcctcagctaccttagtagctgggactacaggcatgcaccaccacacccagctcatttttgtatttttagtagagatggggtttcatcatgttggccaggctagtctcgaactcctcacctcaggtgagaatcctgacattctttaacatggcaaggcttgtaattgagtagctaatagttttcaaatcatattgagtgtatttttccctgcagcctataaatagaattttttacagcttttttcccaagtatttgccaaagatatctccctggcacaaggcattgtgtattactgaattctagtaacaagctgaggagatctggatgagagaaaggacagcatatcagcagggcagggtcaggtccctgctactctggctgtatgaccctgaccatgacagttcacctgactggaactcagcttttgactttttaaaatggaggagttgaatcatgttgacatctaagatctcctcttttttttatttttatttttttggtaccccaaacagagtctcattctgtcacccaggctggagtgcagtggcacaatcacagctcactcatcctgggctcagggaaccctcctacctccccatcttgagtagctgggactacaggcaatcaccaccacacccagcaaatttttttatttttttgtagagacagagtctcactatcttgccgaggttggtcttgaattcctgggcttaagtgatcttcctacctcgtatggcctccccaagtgctgggattacaggcatgaaccaccacacccagccctaaggtctcttttaccttgaaagttgtataaagtaagtcagacttaaaagatacaaaagaaagaattaaatatagtcaaaacacatttcttaattttgagggaaagtttttaactgcacatgcaggatcgaagagaaataatatctggttcctaaagaaacaagctgaaataaatattcctggtgtgtttattttatgttactctgaattttttttaaatctatttacaatttctatgtactagtccaaatataatacttattttttctagaggaagcatttcttaaacactactatgtactcagcctcacgctaggggctattacctaatgtcagagaacccgagtctggtcgtgggaaagaaaaagaaccacttaaacagcatgttctataatgtacctcagacattcagttccctcttggctgttgatgcccttggtgtggcagacaccccagtgttggctctgtcctgagttgcagacgtgtggtttctgcatcgtcagtatactcagcacctggtctcagaaacgttctcgtcccctgcccccaggggttaccacatagctttttacttctgagtcctcttgtcctcctgggcagggctgtatccagatggctccagccaggctaccttctgcagtgtctccttgactcatgggaaacacacacatgcttaactcaacatacactacaagcatggcctgccccaggcggcctccagtcatgaaagaggcaggcaccagtctctttttgcttaggaccccaaatgctacatgtcaagctgccccaaggactctctctcacacagagatcctttctagtgtaccaaggtgggcctataagttgctacaattcagcaagcatccctccagagaatgagatagtgagctcttctggctggcacctccagtgtctaatgcgtggttcttttggggcatctaccatccttcactttgtatgagggagggtgcaatcccctctcctttcctcccgaacaagaaggagaagggaataatcaaatacttgctcttcttagtcctgtgactcctacaaatcccagacttctgcctctataggcagaatgaggggtcctggggtgaatatggaagggccattttgactgcctttcagcaagcccaggagaagtggtctagcagctttatagcaggttcagtgccatttacttcctcttggccttagctttgggctttagctgaaagtccaagactactggtaaggtcccaagtaacattttatatattctttatatatgatagaatggggggtgggtaaagggtaagaaagacaagctgcagtcttcctttgttctcaaaacccagctacctttcatttgccccagaccttgacaaaactctacctagatttgaaatttgagtcctgcatatctttgcaggcagcatataatatgcagatgacccatgagaatgagaaatccaaaagcactatgtttctaactactgtttttaaacacttcaatgttacatcgcattcgaacttttttccattgatgactttttatttacctgctttgccatatttctcaaatgctttgtatatgctatggatatcactaaagtattttgagtctctaagacaaaaatgtagaaattggtgggggaaatgaaggttgacatattatgcatatacatcaagatactttccaacttcgggttgcccactgagatcattgccagttgttattgctggggaccaaactacttactctctggtctccaaagggttgaatccttcatacatttctgggcctttggttatacagatttttggaatttgtgagctctttgaagacagaaactcatctttttcatctctgtatccctagtacatagaaccccacattttagtacctagtaagacttcaataaatattgagtggatgggtatgtggatgaaccaacaaagggtcacttctctctgacagtgacaaaatgagcccattcctcactccctcctgcttcagttcttacttgcccttttggttgatgagccagcagccgagattcacagtgtattctttgccacatggacaccatcctctctatcctgtggctgccttgagaggtgcagtttctaggacttgagagctgcagtttttagaagaagcagagcccaatgcccccacctcaggtagaagccccaccttttaattccttcccattgtatctgcctttcatattaagcatcccacctccccctcatcctgccactacttccactgaactttaggtgagttgaatttaatttaagtgattgaactggatcagaccagaccaaaggcgtggaaaaaaatttggtctgagtattttccttggagcagtgcctcaaaagagattccaggcacttgtgtgccacctatgaagttgtatggatagaacagcggttctcacttgaccactctgtgcctcatttttctcatcttaaagtgagaatagtaggggtaaccaactgcgtaggattgtttgaggttaagtgaatgagtatatgttaagagcttagactagtaactatcatctagtaagtgctcaataaaagtaatattgttgctattagtagtagtactattagtactctcaaaagttagcactggacataagattttcaaatacctaaggagtttattaaagcacagatttctggacctccttcttaaattctgatgttgtaggtctggaggggggtccaggaatctatgttccataagtactacatctgattcggccacacgttcttaagaaattacagatataagacctaaggaactgtatatgacatagtaagaccaggtcaaaaattatctccaatttggggagttgtgggattattttttctttgtgagaaaaattgatgtgcatttattaaatgtttaaatagaaacgaaccataatcatagttgaaaatgttggaaataatagtccttgatcaagaaaaaggcaaaacttacagtttatcatggaattagacattataaagtgatggtgctatcaacttgtaaagcctcaaattaaatttgctttttttctcaaacaggtttgagattttttttttttttttttcgagacaaagtcttgctctgtcacccaggctagagtgcagtgatgcgatcatagctcactgcagccttgaccttctgagtagctgggaatacaggcatatgccaccatgcctggctaatttttgtatttcttttgcagagacagggttttgccatgctgcccaggctgttctccaactcctgggctcaagcaatctgcctgcctcagcgtcccaaagtgctggaattacaggtgtgagccactgcacccagccgggtttgagattttataaaaatatttttatgtattcacttagattatttaaactttgcttgataatattatgacacgtcagggggtgactaaatgtgtttttaaagtgttatgtatttttttaattgtgataggaacacttaacatgagctctaccctctcaacaaatcttaaagtgcacaatacagtattgttggctgggcacggtggctcacgcctgtaattccagcgctttgggaggccgaggcgggcggatcacaaggttaggaattagagaccagcctggccaacatggtgaaaccccgtctctacttaaaatacaaaaaaattagctgggcgtggtggcacgcgcctgtgatcccagctactcaggaggctgaggcaggagaatcgctcgaaccgaggaggcagaggctgcagtgagccgagattgagccactggactccagcctgggagacaaagcgagactccgcctcaaaaaaaaaacaaagtgcacaatacagtattgttaatgatagacacaatgttgtacagcagatcactagaacttattcatcttgcaaatgtaatgtagtgtgtgtgtatatgtgtgttttatggtttcttagtttttttggttttgcattttgtttgggtttgggtggtggttttttgttgttttactattttttattgcatgcatgcagtgcaattcatttctataggctagtctggaaacctaatcactatttataacattatttttctgggaaaatatgatcccagttacaacattgacatttctttagagatagaaagcattcagaagatggagactgcccacatatattttacagggatttgggcaaacttttgtggacgagccacaaatcaccatttccctaaaatgttaatataatgttttaaatagagcagcattttactagtctacttatactatttatttaatctctgatttagtagtgctttcttaattaatacatcatttaaaaaattgtccctgctctatcttcacattgcttttgttaggcatttttatgtatgatgtggcccaaatatttataagtcataaaaatttatcttgcattagtataagcaaatctgactataatctgaagaatgtttatagtcagtatttgacttctcaactagcattggtgtacagagtaggtgaagaaaaaaaaaagaataaaaccgaccacgaaaatccccacctgttttagagaagttaggaaataaaagtgttcacaacagccgaggtcatctttaacttttcacttttcaaagcagactgttgactatgaaacactttatttgaggtagaaattaatattttaattgtatttctaaaataattaaatgtatgttcttcagaaagctgaactttggatcatttaggtttgtggaattttagaaatatatttagtttctttcttttttttttttttttttttttttggagacggaatctcgctctgtcgcccaggctggagtgcaatggtgtgatctcggcccactgcaaccttcacctctcaggttcaagcaattctcctgcctcagcctcccgagtagttggggttacaggcgcccaccactatgcccggcaaattttttttgtatttttagtagagacggggttttgccatgttggtcaggctgttcttgaactcctgacctcaggtgatccgcccaccttggcctcccaaagttctggcattataggcatgagccatcgctcccagcgtatatttgctttcttttcagtgtcttctccactctgaattggcagagtcaaaagaaaaaaagtttatgtccttgacttcctgctgaaggataccagcactgattctgttaatgaacagccctagtaaaacaaccataagcctttgtgagaacattccttcctagaaggagttgggtttgccctttcccaagatttaggtttctgtgaaaattcttccagacgtgccttggccagaaagcattctttcattttactccgtgtagacgtgccttggccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtaagtgatatattttatagaagtatttggcatcatcatatttgccacctttattgaagacatttctgttgcacattaagaggcagtttccctggagtcacaatttgactcattatattcagatttagtatttctaagtttattactgaacatacagaaaagaaaaaagatctctgcagcaatattgcctagatttctagttctggttctgcgatgtaaacttgaatacattaccatcaattttacttctctttttctgttttttaaaaaagcaagttattttacaacacttggtggaaatagacatgctataaaaatttgagttgctttttgaaggtggtaatgtttgaaagttaattaaatttctgtagcaattaaatatactgagttcaaagaagtcatttttgtaaattgtcaaggtatgtggctatatctgtcacaaacttttaaaaacctatttatgatagaaatacaacattgcagaaagtttggaaaataaaaatagatccataatctcatcaccctaacacagtagtttccatttttatatatcgttttctagtcactctccatttgcatataaatttttttatagttgtaatcaaaatgtgtcttttttaacctaccgttatataataagcatatttccatgtttctacttgatctttacaaatataacttctaatgactgcaatatttttctttgctgttattaaagtataacatattagcaattctcccattgttagacacatgggtttttttttttttcattttttgatcatgtcagtctttgtgcaaataaacatttttcttttagaaaaattatttcttataaagtgaaattactatgtgaaagactatgaaggacataatcccttccctaccagattttagacagaaagtctgtactggaagatggtgtacgttcactgagaaatgagacccatgcagtggaggctgcccggcctgcccacttggtcaggactagcttggaggggttgtctctgacttcaccaccaagggctcatagaagggaattaagatatcgctgatagaggcatgaatcaccaccctgtcttcacaatacgcagatagaagcagagagactctggggacaattctttggctcaactggacagtgaaaacctgctggtttccccctaaccctgcttaggtggaaataccacacctctgtatttaaaaataaactaggagaggagcaaggacccagagagagtatgtggttttgtcctctcatttcactaatagagaaactcggagcataaaatacaccaaggataattggtttatcatcttgaaacaatatgaattaacagcataaccagcactctaatgaacagggtattcggataagaaagctctgtcatttttgcttgtttgtttgttcttccctgaggcagtagttgagtagcacagaacattctagttatgatgctaaaatctaaggctcgggccatgtgacctcacaacatccccctcctgccccagtaggaagcttttgtatggttttcacaggttgaggtgagagtcctcctggatggatggtggtatgatcctgccatccagttgtgccaaagcaatcctttattggcttaatggttggaattcagttgagtgtaatgcaaacctctgaatccagccatatgcagttagaatagcagcaggtgtttactcagaaaaagaacagaggctttttcatgggttcatgtcccataaataacttacacaggtaaactccatcctggtggtaaaggagaactttttaaaacaattttatttgaaaacaatcaattttacctgtgcagaaaaatgttaatgactaattagtgaagaaaatttgagtggaaagagaaaataaggctttaaaaaattgttctcttaggctccctggcatttaaccctaagagccattagcagaggcatgactttctctgtgtgggcagatgactatggggaaaaacattgatccggcaggcatttttgcattttctacattacttaaagaaaaattacttgtgtattcttaattaagtagtctaattaattagttctgttcttgaaatcgtttctatttgtgcctgtgtcattttgacatttctaaagggaattggcagtgctgttaatataaaagaaaacttcttattaactttttgtccatattgatttttatggtgagtttggaaaaggatattcagagatactcttccgttaagtttcataaatctgtaataaatatatgttgcagccttgtcattttgctttatatttttcaataaccttttaggttatagttgacagacttttagaacaatttgcttcatttttattaccatcaatactgttcttctatgtattaataacatttgaataaaatgaaaagtttttcaaaataattgttttgcctgccataaaaatccactcataatttttaacttaaaagaatttaacattttgtaaatcttgtgtcatgtttgtattattgtatatcttgtttattttttaggtattggaagaaatttcatgttaccctgagaataacgacgcaaaggaactaaagcgtattttaacacaacctcatttcatggtaagtaataattaaacttccatagaactgaaacctcactttcaaaagaagtttttaaactaccctcataaaatgtagccagcttcatctcatgcatttttatccatatcatatgagactattaagattacaataccaggtaataccaaatattttaagactgttttgtttactttgtgtcacaactgtaaagatactcttggtgaagtggcttttcagggactgtactcatcagacaagggattttctttcttatggggtagtcctttagtcactggaactgtttatgttacttaaaccacaaagaactaaaattagagacagttttcaataataaggaatcgtctgaatctaggtgatatattggaagaattacatctcttttgacaatgcaaaactgctgcactttcttggttcatttctactatatggaaaatggggataacacctgtatttagccaaatataaagctaaatagctaaacaaagctcaaagctcaaaatagataagatactttgctgtggaaaaaggtccatgcttatctacctaactgcaatacaaaaacacaattacagatggaaattcatgttgaatataccattttaaaagcattagccacatcagtttatgtgaaaaatatgtgaaaagtggaaaatttacctcactgccctttgggagaaaatctgacttaaaagccttgttcttataactactattacagatgatactttgaatttttatttatttatttacttttgagatggagtctcaccctgtcacccagggtggagtgcagtggcgcgatctcagctcactgcaatctccgccttccaggttcaagcaattctcctgcctaagcctcccgagtagctgggattgcaggcgtgcaccacgacacctggataatttttgtatttttagtagagacgaggtttcactatgttggccaggctggtctagaactcctgaccttacctcctgcctcagcctctcaaagtgctgggattacaggcatgagccaccatgcctggccacaggtgacacttttaaaataatagtaacagtataatatgtgtatcaaagcaattacctgtgagttattatatatatgctgttttatgatagtgtttctttttttctttttcttttttttttttttttgagacggagtttcgcactgtcgcccaggctggagtgcagtggcgcaatctcggctcactgcaagctcagcctcccgggctcacgccattctcctgcctcagcctcctgagcagctaggactacaggtgcccgccaccacgcctggctaatttttttgtatttttagtagagacggggtttcactgtgttaaccaggatagtcttgatctcctgacctcgtgatctgcccgcctcagcctcccaaagtgctgggattacaggcgtaagccaccgtgcctggccctttatgatagtgtttctaaacttttaaccaagttattgaaataaagtttttttcctaaaagtaactacctggaaagaagcaattaccatattcatccttcctaactctcccacccaagcattaaaggctgaattcaagtataatccttgagagtatttgactttattctatggtaacagcactgtccagtgaaatacaattaggatacaggttctaatgcctgtagatgagtgcatttttacaacctaggtgtataaacacagaacttcgttcaaatctcacctcttttatcaaggtatcttgtaacctctctacccttctcttgaactttctcttctctaactcttttccacttgtttgtattcacctgcataacattctaatgcttgctggcctgccagagcaggtctcttcccagtgaatgagccagggcaatttttctttgtccttccatatcccagcccagttttgttgttctcattgagcttatctcatttagtcattgtgattatctctatttcacagagcaggagaataaagaaactatatgctttattaataatcctcaaatgtgatgaatcacaaatatctgcagttaaattaccgttaatattaccttgttcactgtttcatgcatatgtgctgtgtttccccagattataattcattcccttttagacagcatgtcttctatagcaggggtctccaacccctgggccactgaccagtacccatccgtggcctgttaggaaccaggccacacaacaggaggtgagcagcaggccagccagcattaccacctgtgtccccctcctgtcagatcagcctaggcattaggtcctcataggagtgggaaccctattgtgaactgcgcatgcgagggatctaggttgcatactccttatgagaatctaatgcctgataatctgaggtggaacggtttcatcccaaaactattccccgacctctatcccccacccccacccaccctgccatccgtggaaaaattgtcttccacaaaatgggtccctggtgccaaaaaggttggggaccactgttctatattataaaagtggttaaagatgtgaattcagatgacctggggttgaactccatccttgccaccgtaactttatgaactctgactctgagtcaacctcgtggagtcagaataagaattaagtagctgatatatctactgtgcgtagcacaatgcttgacatatgcttagtgcctaatagatgttatctgatacctattattagttgctccatagtatctatcatgtatagggcacatagtaagttatcagtaaaacattgaatagattaggaacctgcccgtttgcagataggttaggctctccttggctgactgctctgtgcagtgttccatagctagaaacagatatataataaattttggaccaggcacagtggctcacgcctgtaatcccagcattttggaaggccaaggcaggaggattgcttgaacccaggagtcaaagaccagcaacattgggagaccccatctctacaaaaaattaaaaataaactagccagacatggtggcacatgcctgtagtcccagctacttaggaggctgaggtgggaggatcacatgagcctgggaggtcaaggctgaagtgagccatgatggcaccactgcacttcagcctgggcaacagagcgagaccctgtctcaaaaagtaaaaaatgccaggaactgtggctcacgcttataatcccagcactttgggaggctgaggaatgagagtcatttgaggtcaggagttcaagaccagcctggccaacatggtgaaaccccatctctactaaaaatacaaaaaaaaaaaaaaaatagcctggcgtggtagcacacacctgtagtcccagctacttgagaggctgaggcacaagaatcacctgaacccaggagacagaggtttcagtgaggcgagatcacgcctctgcactccagcctgggtgagagtgagactctgtctcaaaaaaaaaataaaaaatgaatttggacagacatgtctttctataaattgctaagtaaactcagctcaattcagagaatgatatagggccgtatgagaccaatagatctttcagatttgaagtaagctaaataaattaacatatacccaaataggagccttttttttcatcaaaatcattacggctcatatagcccattgtatgacagcttatctgtcttctaagtctcgatatgttttgcttttctgaagtcagagagaagttaatatgtgcattgctattagtaaacattttcagaaataataagtaatttttataatttattgaatacctagctaggtgcttaaaagacattttcattcatttatcaaataagtaaatgcctactgtatgccaggcacactatgccaggcactaaggacctagtaatgaataagacaaacaagatccctgccctcatggaacttccactctagtggaggtggggtgggaggacaggtaggagaggtagaggtagacaatgagcaagtaagctaacaagataatttcatatggcaataataactatgaagaaatgaaaggataatggtgcagagattatagtaaagtgggagctgctttagataggggaaagcccctctgaggagtagacatttgggctgagactcctttgaggaagagcaaatgcaaaggcccagagacaggaaagagctttgtagattcaaggagcagaagtcctttgtggctgagatacagttaacaagggagagagtggtacttcctgtaccaagagaggtcagcagaggccagaccaatttatttatttttttaatatataaaataaggccaggcatggtggctcacgcctgtaatcccagcattctgggaggccaaggtggacggatcacgaggtcaggagttcgagaccagcctggccaacatggtgaaacctgtctctactaaaaacacaaaaattagccaggcatggtggtgggcgcctgtagtcccagctactcaggaggctgaggcaggagaatctcttgaacgcaggaggcagaggttgcagtgagttgggatcgcaccactgcactccagcctgggagacagagcgagactccatctaaaaataaaataaaaaatataaataaataaaagccttccaggccattgtaaggagtctgcagttttctcctgattgcagtaggatgacactaagtgatggcacgcaggaaaatatctaatctgtgccttgctggagctgatgtgtagagaacggactgtaggggggataagagtttagggagaccaattggaaggctgttgtgagaggttgtagaggcttggagaaaggtgaggatggtagaacatgggcagatggggtttctgtgttggagatggttacatacaagaggacttgctgatggttgggatgtaagctggtgtaattaaacccatttcacaattccgagaggaaattgtgccctaacaaggtaaagagacttgcttaaggtcactcaccaatcagtggcctcaatgaggttcaagccagatcctgctagcgccaaagcctatgctcctaaaagtcagttgatttataatgctaatcagatttctaataaatttaagttgagctcattggtcattcctaaataagcttttgtgtagataatatcttatgtgggaaatataattctgagatatatatatatatatatactatattaaataagcttttaaatgctggggctttctatcttataagcgtttttaaaatcatggcttcaaaatcttggtatttttaaagaaatattaatagctaaggggaaatatgttaatacttacaatttttttattatgccaaggtttgggagttattcttggcatatttataatttcacacttatttgctcagtcatccgaatttttctttgctttctgattattataacatgaggatttaacattgaattacccaacactgaaaatccagatacttgtagatatttacagtaactaaaggaagaggaaataagggtaaatttaaacgactttaaaattctgtgttttttttttttaagagacggggtcttgctctattgcctagataggagtgcagtgacaccttcttagctcactgtagccttcaactcctgggcaaagcaatccttctgcctcagcctcccaagtagctgggactacaggcatgcaccaccatgcctgtctacttttttttattttttgtagagacgggggtctcactttgttgcccagactggtcttgaactcctgagctcaaacagtcctctttccttggcatcccaaagtgctgggattacaagcatgagctaccacacctggcctaaaatctgtatctttagaggtcatcataaaagaatattatctcactgattacttttttagttattccatttgaaaggctgactttttaaaaagaatatttcctttgcttattgcagctgtaaaatatgaaacattaaatagtcagattttttccactctagtctgatgttgttagttgtcttatacatatccttactatagtacaaaaagtgaaagtgtttttttcctattacacgattgttacgtagttaaaactgacagctatttcagcttagtgacaactgctcactcatacgtcttaacatatttgaagaaaaatgttcaaattttggtttccctattttttattttatatactcttttaagcttttaaaaagatagtctgtaagtggccccctttttctgtttggatatgaattagagctttaggttaagtttcgttttgtggtagcaatcatttacagtgccaaattgtggttaatatcgagtatgaccttatttggtgacatcatttaagcatttttcttttagagtccagtttgagtattattttatgattgtgggcttaatccttccttgtaaataatgcattaaatacaaatgtttgcttatataatttaaaagaatgagtagaggcctgtaatcccagcactttgggaggccggggtgagtgaattgcatgagctcaggagttcaagatcagcctgggcaacatgatgaaaccccgtgtctacaaaaaatacaagaatgatctgggtgtggtggcacatgcctgtggtcccagctacttgggaggctgaggtagaaggttcacttgagcccaagaggtcaaggctgcagtgatatgacgaacataattttagcaaatgaaatgttccagtttttatgttactgatttttgctttttgccctaaatcttggtttcttatgtgaccacaattaaatcagaaaaagagggatttgcccacataggacagcctctatacttgggctcaggagtaccagtacaaggtgcagttagggcactggtgaggaagccaaggtccccagggccatcatggagcactactttcaagctatatattgcttagtgccccttggtgctcctcacccaaatcccagtttagaccagccttctgagattgtgaaaatatctgccatttccattagaaactcaactgtgtataatgctcaaagcatattctttactggtaacaaatcagcattatcttctttatgattttaccagattgttaccttttttttttgcctcgtatgcatgcctttaaaattaaatagccaagtcatgacttttttaagccttttaataaaataacttaatttcagatgctatgagttattatttttaaagcaattttaactgcatttcattatctgcagatattaccgcacagatcccaaattaaaatagaaccaaatttatagttagcacataagaaaatataatctttgtataaagctccagacattttgatagctgtagattctctttgaaatagaaatgttcaaatatttatgcttaatagaaagggtttattatgatggcacaaaaagtgtggtgagtagaaggacattcttttttagggaaacaagggacattttattgttgaagttcaccaagctgacaaatagagatgtcagttcaaagaaatcactttctctttgttaataggctttgcaaaaagaagtcataataataattctcaacttattttttatttaaacaagtgctccaaaaaatataatgaacaaaaaaatttaacatatttagagtttgagttccatatcatacgtgatattttggaagattacgtttttaaggtacatctgtgtgtatttttttctttttctaaatcatatgctataaattattttcatcctttgggttatataaaagcgtcattgtaaatgccattgatgaaagatacttgctcaatactccaattattgcactatttctttttaaatttgtttcaattctaagccccagcacaaatttgccaactctatttatagatgattcttttagctaaattacttgaaattgtaccgtctaccttcatttgaacaagttagttgataacacctctgacccagataatcatcaaacacatctcttcattgattcactcatttattcacttacgttttaaaaaatctatttatcatgattgtcacaaaaaaattgagatagttggatgtcgatattacacactttatgttctctttagatgaatgatacctttgagaggaaaagaatgagatatgtttatagaataaatttgtcagccccatgtctacaaagaaaacatttaaaaattagccaggtgtggtggcatgcacctgtggtcccagctacacagaaggctgcaaaggaaggatcgcttgagcccaggagatgaagcctgcagtgagctgagatctcaccactgcactgcaccctgggtgacagagtgagaccctgtctcaaaataaataaataaataaaataaatttctgctgaaatagtaatgttattaataatttttttcttcataaaacactaggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatggtaagtaggaagagaaagttttcaatactctcataagatcccagcatgagttatatcaactaacttcaacctatgctactaggagttggggagggaaggaagacatggatagttttaaagaaatcagtttccagatcttcagttcccccctgcccttcttttctagaattgttctgcctgaaactgtcttaggcattccggttctctttctcacctctcctttcacaattgcccttcaaccaaaaaaaggggaacatactgtaacattcctccagggtgtaaaaacctctggggcagcaaagaaagggacaatttgaaatattggtattggtattgagaaagtgaatgtctagtaacattgtaaaaatcatccttttataaatcttatagttttcagatcttttgccttcaacaaaattagaggaagattaattcagggggcattcaaagaattgagtaacactgctgaaataaatttcttccactcccagctacctacttaatatgaatcaatttactcagtgcttgggagtagagctggaagagaattgatgctgaaccttgcctccattctcatagaattctcgtagactgagaagatcaaggaaaggctccttgatgttaactgaacagagcaaggggagtgaggggaagcaggggaatactattcagcaaaccaaatagcacatgtgtaaacctggtagtaaaaaggctcttatcatagtttcccaatggaaagaaggcaccatggctgaactgcagacagcaaggtgagtggctggaacagaatcatacaagtgttggaagacatgttaaggattatgttcattatcttaaaaacaatgggaggctattgaagactttcaagcagggggataatattagatttttgttttagaaatatcactctagagaatgtatgagaggggtcaagagtggatgtacagaaaccagttaagaggctgttattgcagcagtgcagggcagatatgatggaactctgaacttgagggatggatgtcaagatggaaagaagtgaacacatttaagaaataatgaaagagtaggtaatatcagtaagccttaacaatggattgacagtagaactgagggagaagcaaagatcaagcacagcccttaagctttagtcttctaaaactgaatggacgttgagacagggaacattggataagttccaagttggaggagaaaccatatctttagaagaggaaaaaaattcaaatttatgcattcatatctttttcctcagaacatagaaaagggatattaggatatagaaaaacaaattacctacttctgaaagttgccttttagattaagggaaaagttatagcagtgactctatgaccatgatttttggagagccctcagcttagacatttctggtcctaatcctcatttagtaatctttgccagttatacaatattatcttgcagcacatggggggcatgcagatcacctcaccccttctggtactatccaggcaactctttggcttaagagcataggctacagcaggttttgggtgtcttgggcaaatcacttcatgtcagtggacctcagttggctcatctctaaaagcatagttgactaaatgaatgatccccaagatcccacctagctctgaaagtctaatattccattcattcattttatatattcattcatttattcaccaaatatttttgaagtccctactaagtgcaaatcactcttattagatgccagtgatctattgtcagataagacactgccccttactagagctcacgttccacagggctggctacattaaacaagtaaatttgtagcttagcacggtttacttaacaagcccagttatgacagagctggagaggagagaaagctgtgttggagaggcaggaaggtgtgatgttcagccaggcaaagcaggcaagaaggtagaagggaccacaagaaggaggcctcagagtgtcttgggatcattaagttctcaagcagtccagtgacagctgcttgattgtttgtgtgaagactcactacatagaaacatagactgaattggcccggtgcagtggctcacacctgtaatcccagcactttgggaggacgaggcgggtggatcacgaggtcaggagttcgagaccagcgtggccaatatggtgaaaccccatctctactaaaaatacaaaaattagccaggtgtggtggtgggtgcctgtaatcctagctactcaggaggctgaggcagaagaatcgcttgaacccgggaggcggaggttgcagtgagccgagatcgcgccactgcactccagcctgggcagcagagtgagactccgtttcaaaaaaaaaagaaaagaaaagaaaagaaaaaagaaacatagactgaataaaagcataaaactacatccctgagttactttttcagaaagcgtaaaatggtcttgagtctcccctaaaagtctccttccaaaagcttttctgtcttcgatgatcctagtgaagatgtatatttcttctccttttgatgggtttccatgaaaacaggaattattttatgtgaaatataaaatatatattttcaataatagagtgtcaatctctaatgcatttaatacaactttatttgctttcttagttgtcttattcaaagcattatgttactgtgcaggatattcctatatgatctgttttgtttttcagaccctctgcaatgtgtccattcctcaagggtgacatactcctgttacacacctctgttttcccatttgtagcatcatactcataatttttttttttattgattggaattcccatagttgcaagtgacaaaaatcaagcttgaactagcttacaaaatagaggaaaggcttatataaacagggaaaggccaggagtataactttcctaatatctcccctcaagctggtaggttcaggagtaggcacctaacccaagctatgccaatgccttccctagaatttgtgaacttgggaacagagagaaagtgaatcagttcctctctacagagaaatgtttgggacctacagaataataaatgttaactacagttggtttgaggtgaacttctcctggccatgggagaccctttttgtctcatttgctactgtacctagcagagtgcctgcctcatagtaaattcacgttaatgttagttgaatgaatacatacatctattagtttcaagggtggaagctgtattgtactatcatttcccttatgaaattagatttgacttacacactaatttacagcatttttccaggaacacttttcttagtaaccatacaagctgattgaatgtacaagttggaaatgaaacttgaatattacaattgaatcttaggactggaaatattttgataaaccagtttttcacattgctcacctaccacttctgaaaactgcaaaataggaacaatgcaaagttatagtttgtggagtggtacaaattaagtttagagtataaagtctcagatatttttatcaagctttctgacagtgttattctctagtgaaaaataaaagacacagtccctacccttaactgtctcaaattcaaggccactttccagcaagggagcctgttaaaaagtacagatttccgggctccattcgaggcctcctgagcttaaatctaaagagtgggtttaagagtcagcattatttaaaatttccctgtgtgattcttaggattaaccagatctagtgcaaaaaatatgtttatgaatgcttgttttttttaatagtggataatcagaaaacaaaaagtaatccactctgtagaatagtattctggcattaaatgtgactatagaactttcatttctgtccaagatagagtaactgggaccagatttatcctctcatttgaaacaacccaacatataaaaaacaaaatatcatgaaagaacagttttcaagacattagacatcaggcaactaaggacagtgatctcttgtgagacaggaaacaaggtgacccatatgaatgccccaccatgctgccttgagagagtttccaggccacagcacagggaggggaactaaggcagagtaggcagactccctaaattgaggggacagagctgagagtctggggtgaccaaagcaactagagttcataggacagagtactgaagaggagagagctgcacacagacagaacctcagatctgcagaggatctccctcaagtattcagcagagtatcgatcagtgcatgtctaataggaaattccccaacactgagaaactccccaacactctccactttggatggaaaaaaaaaccatccaaaaggattggaaggaacagcgcctgcactacctgttcccaccagtcagactagaaaaatttctaattcatggctcattgtgtagagcgctcagggaagtcttatctctgtaatgagaagtaattagccccaaactgacaactgctccagacctgcctaatggatcatgaacgcaagacccaaaggatcaaactatgtccgagtaactgatctaagtctcagaacaaaacataagaatatttttaggaatacaaaaacatcaactatgcaacaaattcacaatgtctgacatctaatcaaagattactaggcatgtaaaaagaccagaaagtgtgacctataatatggagaataatcaatcaaaaatgacatagaactgacagataatagaattagcaggaaaatacactatgggattaatggcagattagacatttcagaagagattagtgaacttgaagacagagcaataaaaactatcaaaaatgaaacacagcaagaaaaagaatttttaaagatgaaaagagcatcactgagccgtgggacaacttcagtcagcctaatacatggttaattggagttcatgaagaagagaggaaaagaaagaagaaatgtttgaagaaataacgcctgaaaacattccaaacttgatgaaaactataaacccacagatccaaacaccatggcaaaccccaagcacaagaaacatgaagaaaacaataccaagctacatcataatcaaactgcttagaacctatgacaaagagaaaatctgagaaacagaccaaaaaaaaacaaaaaaaaaaagaaagaaattgggagacagaggtaggagaattgcttgaccctggtaggtggaggttggagtgagccaagacatcatgccaccgcactccagcctgggtgacagagcgagactccatctcaaaaaaaaaaaaaaaaagaaaaaagaaattttacacacagaggaacaaacataaggatgacatcaatgtcttatcggaagcagtacaaacaagaacagtgtcataaagtactaaaaacaaacatttctcaacttagaattctaaaccaagcagaagtatctttcaagaacaagaaggcaaaataaaaatgtcttcagacataccaaaactgaaagaattcagcagacccacactataagacccacagtatatttaggacattcttcaggcagaaggaaaacgataacagattgaaatctgaatctacaaaaagggaataaagagcactggaaatgatagctatatgggtaaatctataagttctttttcttattacttcaatctcttataattggcaatttaaacaaaaataacaatgtgttttagagtttatagtatatggaaaaataaaatgtatgacaacagtagcacaaaggtcaggaagaaagacatagaagtactatatactattgtaaggctcttatatgatgtaggggggataagggttatatgtgaagtggtataatatcacttgaaggtacactgacaagttaaagatagatgctataaaccctaatgcaaccactaaaacaacaaaatgaagagttgtgagagaaaacacaggagagaaaacagaataaaaaataatacaaagaaaggcagaaaaagataacagaacaggtggaacaaatagaagtcaaatagcaagaatatatatttataccagactgtatcaatcatcatgttctgcttgtaaaacatgcacttcatacacaaagaatagtttcaaagtaaaaaggtagaagccaggtttggtggtgcatgcctgtagttccagctacttgggaggctgaggcaggaggatcacttgagcccaggagttcgaggatgcagtgggctatgattgcaccactgtgctccgcctgggtgacagtgtgagacttcatctcttaaaaaaaaaaaaaaaagtaagaagatagaaaaagatatactgtgataacattaatcaaaaggtagctggagtagctttattgatatcaaaatatattctcagaccacactgggattaaattagacatgaataacagagagagataaatcgccaagtacttgaaaattaaataacacaattctaagtaacccatgaattaaagaggaaatcaaaagggaaattaagaagtattttgtaatgaattaaaatgaaccacagtatgtcagaatttgcaggatgccactaaagcagtacttagggagaaatatgtaccattaaacacctatattagaaaagaagaaacatctcaaatcaatgacttcagcttataccttaaaagtaactaggacaaaatggagtaaattaaacccaaaatgagtagaagagaagaaataataaagatcaaagtagaaattaatgaaatagaaagcagaaagcaatagagtatcaataaaacagaaaatactttttctttggaaagatcagactgatcaggaaaaatggctatacaatcacggggaaaaaaaacatgaattaccaacatcaggcatgagagaaggggcatcactacagagtctacagatataaaaaggatgataaagaaataaacagatttatgccaataaattcaacaacttagataaaatggaaaaattccctgggagacagaaactactaaagcttatttaagaaggaataaactgaattgccctatactatctgaaaattgaatttgtagttaaaaactattcctcaaagaaaactccaggtcaagatggcttcactggtaaattctgtcaaacatacaatggagaaataataccaattctatacaaactcttttcaaaacattgaaaaaaaaggaatttttcccagctcatcctagaaagccagcattgccctgataccaaaaccagttaagacattacaaagaaagaaaactatagactagtattcctcatgaatgtagatgtaaaaattctaaacaaagtcttagcaaagcaaatccaacaatatatgaaaaggttaatatgttctcacttcagcagcacatatactaaaatataaacagtacagaaaatattatcatggcctctgtataaggatgacatacaaatgcatgaagtgttccagatctttaaaatatatatatgttatgatcaaatggtgattaacccaggaatacagctttacttataatagcccaaaccaggaaacaattcagtgggtgagtggataaactgatatgtccatacaatggaataccactcagcaagaacaaagaacaaactactgatacatgcaacatcatggtggaatctcaaaataattatgctgagtgaaaaaaacaacaaaaaagagttcatactgtatgatttcatttatgtacagtgcaaacaaatctgtagtcagcaaaagttgactgtatcagcctttggtcgacaactatattatcagctttttgattgtcacattagtagttgcttagggatgtggtggggagggtatggagggatgggagaatattaccaacgagcatgaggaaacttttgggaatgatagatatatcactatcctgattgtggccatagtttcatacatatgtcaaacttatcaaattgtacactttaaatatgtgtatgtcaattatatatcaatgaaaactgtttttaaaaataataggcaacattaaaaatggagcaacagggaaaataatcataattagaagatttaaaagcactatcggccaggcatggtgactcacacctgtaatgccagcactttgggaggccaaagcaggtggatcacttgaggtcggcagtttgaaaacagcctggccaacatagtgaaccatctctttccttaccctcgtctctactaaaaatacaaaaattagcttggcatggtggcaggcacctttaatcccagctactcaggaggctgaagcaggagaatcacttgaaccctggaggtggaggtagcagtaagctgtgattgtgccactgcactccagcctgggtgacagagtctcaaaaaaaaaaaaaaaaaaaagaaaaaagaaaagaaaagaaaatagtgtgttaaaagcattatataaaatatatgtatatagcaatcaaaaaatcaaaaatagtatttttgtcatggagcaattttgtgtgcgtggcatactggatggtcttctccattttccatattttctttaattttttttaactggtaattaaaattatctaccgcaaaatcacaaatattaagagaagcactgtcatagtaattctacttttgctgaactttttattttttttttaacagggaatcactttaaaaatgaatgaactaaatcattgtattgttgcaagaattatgcatgggggcatgattcacaggcaaggtaagtttcatatatatttctttctttgccttccttaattttttttccctgtagcctagtgaagaaaatgtttttgtttgttttgtttttgagatggggtctctcactatgttgcccagactggtcttgagctcctaagtgcaagcaatcctcccgtctcagctttccacaggtgcatgccatcacacccagctaagaaagtataaaggatacatataaagaatcttttaaaatcatctttgattttaatcattattggcctccattgtttcttattcatctgcacaggctccagcatgtagataatgaagggagaatatattagagttctgttagccagagcatctctgtattagattactacttacggggaccacgggagataaagcaaataattacactgggcctcacgatgtaggagagacatctgttctagagtaaaagatatatgtaaataaataaccatttaagaagtgttctctcattcatttaggaattagatatgctatttataaattaggacatcatagagttaaataatacaaaaattaaatggtaagagatgtcaaatcgatgattaaattattaatacctgccatggtgagtgcagtcattctgtggagagaattcactaagaactggaatagacaaagaatgatgtgggggttttttttgagacaaggtctggctcagtcacccaggctgtgcaatggcacaatcttggctcactgcaacctctcctcccgggctcaagcaatcctcccacctcagcctcctgagtagctgggaccacaggtgcacaccaccatgcctggctaacttttgatatttttgtagagatgggcttttaccatgttgcccaggctggtctccaattcttgaacccaagcaatctgcctgcctcctcccaaagtgctgggattataggcatgagctaccttgcccagctcgaagaatgattttttaagaaggtgcatcttcagttaactctcaaggatgggcagggtttggatatgtggatttaggctttttctttgaaaggattgagttatatgcactagtatttagaggatgttccaaaaatgattcttctggcagactctctgtctttgagatagggttatttttgtacttaacacctctttccttacccccagagagcgagaagtaacactctaagcattttagtgccttattctcctcttgagaataagaggagatcactgtgtacacaacatgatgtctggcatcattgctgctttcagaggaatccttgtaggcgtagagggtgtacagcactcccacaggaggatatttggttttagattccagtatgtgttttttgtttgctatttttaataatttttatatgttcagtaaagccacaacatcattctttcttttttttttcttttcttttttgttttttattatactttaacttctagggtacatgtgcacaatgtgcaggtttgatacataggtatacatgtgccatgttggtttgctgcacccatcaactcatcatttacattaggtatttctcctaatgctatccctcccccagccccccaccccctgacaggccccagtgtgtgatgttccccgccctgtgtccaagtgatctcattgttcagttcccacctatgagtgagaacatacggtgtttggttttctgtccttgtgatagtttgctgagaatgatggtttccagcttcatccatgtccctgcaaaggacatgaactcatccttttttatggctgcatagtattccctggtgtatatgtgccacattttcttaatccagtctatcaatgatggacatttgggttggtcccaagtctttgctattgtaaatagtgctgcaataaacatacgtgtgcatgtgtctttatagtagcatgatttataatcctttaggtatatactcagtaatgacatggctgggtcaaatggtaattctagttctagatccttgaggaatcgccacactgtcttccacagtggttgaactagtttacagtcccaccaacagtgtaaaagtgttcctatttctccacatcctctccagcacctgttgtttcctgacattttaatgattgccattctaactggtgtgagatggtatctcattgtggttttgatttgcatttctctgatgaccagtgatgatgagcattttttcaggtgtctgttggctgcatggatatcttcttttgagaaatatctgttcaaatcctttgctcactttttgatggggttctttgtttttttcttgtaaatttgtttgagttctttgtagattctggatattagccctttgtcagatgggtagattgcaaaaattctctcccattctgtaggttgcctgttcactctgatggtagtttcttttgccatgcagaagctctttagtttaattagatcccattagtctattttggcttttgttgccattgcttttggtgttttagtcatgaagtccttgcccatgcctatgtcctgaatggtattgcctaggttttcttccagggtttttatggttttaggtctaacatttaagtctttaatccatcttgaattagtttttgtataaggtgtaaggaagggatccagtttcagctttctacatatggctacccagttttcccagcaccatttattaaatagagaatcctttccccatttcatgtttttgtcaggtttgtcaaagatcagatggttgtagatgtgtggcattatttctgaggcctctgttctgttccatttgtctatatctctgttttggtacgagtaccatgctgttttggttactgtagcctcatagtatagtttgaagtcaggtagtgtgatgcctccagctttgttctttttgcttaggattgtcttggcaatgcgggctcttttttgggtccatgtgaactttaaagtagttttttttccaattctgtgaagaaagtcattggtagttttatggggatggcattgaatctataaattactttgggcagtatagccattttcatgatattgattcttcctatccatgagcatggaatattcttccatttgtttgtgtcctcatttatttcgttgagcaatggtttgtagttctccttgaagaggtccttcacatcccttgtaagttggattcttaggtattttattctctttgtagcaattgtgaatgggagttcactcatgatttggctctctatttgtctgttattggtgtataggaatgcttgtgatttttgcacattgattttgtatcctgagactttgctgaagttgcttatcagcttaaggagattttgggctgagacaatggggttttctaaatatatagtcatgtcatctgcaaacagggacagtttgacttcctcatttcctaatcaaataccttttatttctttctcttgcctgattgccctggccagaacttccaacactatgttgaataggagtggtgagagacggcatccttgtcttgtgccagttttcaaagggaatgcttccagtttttgcccattcagtatgatattggctgtgggtttgtcataaatagctcttattattttgagatacgttccatcaatacctagcttattctgagtttttagcatgaagggccattgaattttgttgaaggccttttctgcatctgttgagataatcatgtggtttttgtcgttggttctgtttatatgatggattacgtttattgatttgcgtatgttaaccagccttgcatcccagggatgaagctgacttgatcgtgttggataagttttttgatgagctgctggattcgacgttccagtattttatggaggattttcgtatcaatgttcatcaggggtattggtctaaaattctgtttttttgttgtgtctctgccaggctttggtatcaggatgatgttggcctcataaaatgagttagaaaggattccctcttttctgttgattggaatagtttcagaaggaatggtaccagctcctctttgtacctccggtagaattcggctgtgaatccgtctggtcctggactttttttggttggtaggctattaattattgcctcaatttcacggcctgttattggtctattcagagattcaacttcttcctggtttagtcttgggagaatgtaggtgtccaggaattcatccattttttctagattttctagtttatttgcatagaggtgtttatagtattctctgatggtagtttgtatttctgtgggatcggtggtgatatcccgtttatcatttttaattgcatctatttgattcttctctcttttcttctttattagtcttgctagcggtctatcaatttttttggtcttttcagaaaaaccggctcctggattcattgatattttgaagggttttttgtgtctctatctccttcagttctgctctgatcttagttatttcatgccttccgctagcttttgaatttgtttgctcttgcttctctagttcttttaatcgtgatgctagggtgtcgattttagatctttcttgctttctcttgtgggcatttagtgctataaatttccctctacacactgctttaaatgtgtcccagagattctggtacgttgtgtctttgttctcattggtttcaaagaacatctttatttcagccttcatttcgttatttacccagtagtcaatcaggagcaagttgttcagtttccatgtagttgagcggttttgaatgagtttcttaatcctgagttctaatttgattgctctgtggtctgagagacagtttgttgtgatttttgttcttttacatttgctgaggagtgctttacttccaattatgtggtcaattttagaataagtgcagtgtggtgctgagaagaatatatattctgttgattttgggtggagggttctgtagatgtctattaggtccacttgttgcagagctgagttcaggtcctggatgtccttgttaaccttctgtctcattgatctgtctaatattgacagcaggaaacatcattatttctttaacttctctttgttatattactgcactggctaggaccggcagtctttcaaggagtggtatagtagacatcccgtcctattcttgtttttaaacggaatctaaagttagccgggcatggtggcgctcacctatagtcccagctactcaggaagctgaggtgggaggattgcttgagcccaggagttcgaggctgtagtgagctatgatcacgccactgtactcacctgggtgtcggagagagaccttgtctctagaaaaaaatgtttttttaaaaaggaacctttccaatatttcttcattaagaataatgtagatttttagtacatgccttttattagggctaaagaagttcctttatattcttagttgctgagcattttaattgtgaatgggttttgaatttaatcaaatgctctttcagaatctgctgagatgatcatttgtttttttccttttatctgttaatgtggtgaatgtcttttaaagatttcctaatgataaactacccttgcatttctcagataaactcagcttagtcattacatattatcttttttatgtactgcccgactgtctgctaatgttttgtttataagatctcagtatgtgcatttatgagtgagactggcccgtagttaattttcctctcttgtatttctctgattttagtttcaaagttatatctacttcacacaatgacttggagagtattccctcttcagttctccgagagattttatataatattggaatgatttgtgtcttgaaagtttggcaggacttgcctgtaaagtatcacagcctagtgttttggtttttagttttaagaaagttttgtttttgttttttaacaactgcttcaatttctttaacattaaaaggccatccaggctttctatttcttgagtgagttttggtaaattacattttcctaaaaaaaaataagttttaaaatattgcagagagcttcttcatagtattctctcatctttttattctctgccatctttgtcattatgcccctgttcatttctaatattgtttatttgtgcctactctttttttcttgatcaaccttgccagaggtttgttcagaaacccactctgggtttggttcattctcttcattatatgtttattttctgtttcattgttttatgacctaatttttattatctcctttttttttaactttctattggttttggctaactttacaaatttgacacatagttcatttatttccagtcttttttttttttttttttttttttgagacagggtcttgctccatcggccaggctggaatgcagtagcataatcatagctcactgcaacctcgaactcctgggctcaagtaatcctcctgtctcagactcctgagttaggactacaggcaaccacactcagctaatttttttaatactttgtagagatagagtcttgctttattgcccaggttggtctcaaactcctggcctctagtgatcttctcgcctcactcagcctccgaaaacactgaggttatagacatgagccaccatgcccagccttcttttcttttctttttttttttttttttttttttttgagatggagtctcgctctgtcgcccaggctggagtgcaatggtgcaacctctgcttccgggttcaagcgattctcctgcctcagcctcccaagtagcggggattacaggtgcccaccaccacgcacagctaatttttatattttagtagagacggggtttcaccatattggccaggctggtctcaaactcctgacctcatgagctgcccacctcagcctcccaaagtgctgggattacaagtggaagccaccatgcctggcccagccttcttttctaatatgtgcctttaagactaaactctccctctaagtactgtcttaatgtatcccaccagttttgacatgacgcatttttataactcagttctaagtatttttatatttctattatgatatttttcattgacctatattatttataattgtctgttacttttcacacttaacaggattttctgtatatctttttgtaatttacttctaacttaattacattgtggtcagagaatgtagtctgtatgacaccatttctttgaggtttgttgagacttgctttatggcatagcactttaatcgtttttataaatggcccacgtgtacttaagatgaatgtttattctttaattgttgcatgcagaggtatctttttgtaatgaagccaggtcagtgtgtacatttctgcacaatttataaataaggaagcaacattgtaaataacactctaagcattggttcttggtcatttctttctagctgaagtattacaagatgctgaaatgccaaccaaaagattaaattatctttaacagaatttgctgttgtgtagatattatcatgtcacaactcttggaaaattgacaaccttcgtatcatatctggtagataacgatagcagccaacactgtcatggtgcttggtatgtgccaagaacagttctaagccttctgcatttattaaatttgtttagttcttaaaacaatcctatgagatgggtactattttcatctccattttacaaatgtgaaaactgaggtatggagagtttcagtaatttacccaagatcttaaagctagtaagcaaggaagctggaatttgaacccaggcagtctggatccagaagccatacttttaaaccactatacataccacctctctcagaaaaatagatttctgcagccatccatcaaaactgtgccttccacaagtagatatatctgttttgatgaggttactacatgagttaaataattctgctgcaaccaaacttgtacctgcctctgaaatattggccctcaatattcaacttagtttttaaaaattacattgatgcctctggattttgttactatgaaagcatatatcatttcatgtttataatgttatataatttcttaggtacacttcatgttggtgatgaaattcgagaaatcaatggcatcagtgtggctaaccaaacagtggaacaactgcaaaaaatgcttgtaagtaaatgaaagtttttcctttcctaaaattgacttttactttgttagcttgtttttaaatatacaaataaggagtattcttctgtaatcagagaatttctggtaccatatttatgtggacttgaacttatataacattcataaaactgacaactagaaaaatgttgaaatacaatagagtttacaaacattttgcctgtctttagcagtgtgggctttaacactctccttttatcctttatctcctgtttcttaccaagcagatgattaaagaaaaccttttcagtgtttgtacatgtgaactagtttctcactgacctcaactctcctgacatcagcagtgtcagaaacctctttcctgttgagctgagtcatagccagctgtcgtggatttctctacagcatagaagggaggaaagccacggtagaccaggccatttttgaccatacatatccaaaatctgtattcaaattaggctttggattttttaaaaaggcaaaatgacagcctttgcctatgttcattgtcatagcaagcagacagaggtgtttggggcctctgatcccttttcccactgcagtgtagtagcacccaggttatgaatacctattaagtatgaaataagcttcacagactcaccaaacatttttttttcttttttttgagacggagttttgctcttgttgcccaggctggagtgcaatggcgtgatctcagctcactgcaacctctgccccccgagttcaagggattctcctgcctcagcctcccaagtagctgggattacaggcatgcgctaccacaccctgctaatgtttgcatttttagtagagacggggtttctccatgttggccaggctggtctcgaactcccgacctcaggtgatccaccagccttggcctcccaaagtaccgggatgacaggtgtgagccaccactcccagcccaaaatttttttttaaaaaaaagccaaaattaataagcaaaaagtggctgggtgcggtggctcatgcctgtaatcccagcactttgggaggccaaggtgggtgaatcacctgaagtcgggagtttgagaccagcctggccaacatggtgaaaccccgtctctactaaaaatacaaacattagcaaggcatggtggcgcgtgcctataatcccagctacccgggaggctgaggcaggagaatcactggaacctggaaggcagagtttgcagtgagccgagatggtgccactgcactgcagcctggatgacagagcgagactctgtctcaaaaaaataaataaataaaaaatttttaaaagtaaaaagcatattctatggggtacaccattataatgtggcatactcaatgtaatttttatgtaattacctagtctattgtctaattcaatgtatattcacttttgaaaggcatgtcacttagaaagttttgtattcacatctataaaaaggtgaccattgaagatctgtgagaccattgctgtatgagcaaaaggcaattggctgctgggcttttcccaggaacttactctactgttaactcgagcagtccctgcttcatgactacatttcattttccggctatgtgctctcagatggcttgtgctaattgcccccatgtgttttgagtggcttcttacatggttttgtgaacaattgtttgtaagaaaacttttctttctttcccaccaccccccctccagagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaa

SEQ ID NO: 5661 - DNA, 3119 bp, human; identical to SEQ ID NO: 3364

SEQ ID NO: 5662 - DNA, 3411 bp, human; identical to SEQ ID NO: 3365

SEQ ID NO: 5663 - DNA, 153737 bp, human; identical to SEQ ID NO: 3369

SEQ ID NO: 5664 - DNA, 63391 bp, human; identical to SEQ ID NO: 3368

SEQ ID NO: 5665 - DNA, 115667 bp, human
ggtggcgacggcgcccagcccgccagaagaacgcgcggcgggcagacggctgggagccgctccggtagggcgagcgcggccggcggtgggtgggaggagaggttgggggaggaaggaaagggaagaggcggagcgtgggagcgcacagtgtcaggaatacaatagtgctccgcgccgcctcagccgccgccgccgcccaaccgcctgcccagcgctgaggcctgacgggccgggcggacgagggccgagggcgggagctgaggcgcggggggcggccccggcggggggcgggggcgaggaggggattaaggggcaggtgcgagggagggaagagaagaaagcgagcggttaggggggcggttaccactccgaccggactcacccggcacattgccgggccgcggcgtggagccgggcaggagccgcgagccagctgcgcgaaggtaggcgccgcggaggccggacccggcgcgggcgaggttgggggcgtcgcaccggctgggcggcgggagcggcggcctccgggagtggaagcgggcggcgcggagcgcacagtcccggcccggcctcgccgcgctccgggtcgctccggttccacatcgtggtcgcctccggcgtccccggcgccttggggccgagagcgtgtgtgggctgaggtaaagtgcctggtggcccctctgcccgcccgggtagtgcctggtggcccgggcggggggcgggggcggacgcgcgagctcggctgcagctcccggctacaccgggcaggaattgagcgccataactgttgcggctctttcctccggtgccccctcctggcgccccctcctccgttcctgccctttgcctggcttcggggctgacggggccagacccgtggcgggaggacctgctctgtcggccgccaggggtcggatgctccagggagcgagggcgcgccctggctgtttagctgttggggggcggaaagaaccgagtgcctggagaggggagaacgggtggtgctgggtgcggcgaggcaccccgggaagcccgggtgcccacccggcgggagcgggagcgcgggcgcccggcgggctggcgaactttccctcccactggcggcattgttcgaactgcgggtccgtggccgccgagcgtcgggcggtccgggggtgggaaaatcgtgagggctttgctagtcttccggggaaattttcccaccgctgggcacggcaaagttaacttttctccagctttcgagttcgttttattccctccgccccgggggccgtagtttgtttttttgttttgttttgttttgttttttgtttgtttgttgttttttttaatagccttcaatctttttctcccgcttttcacagcagagccagtgcttcggtggagtctagctttaaattgcacagggcagcctgagtttgttatttgtgaggagggggtggcgggatctggagtgagtgaccacaatggtggtatgtggaggcatgtttcaaagtttttatcgctgtgcggccctgggacatatgtggctactagggatttggcaagaaacttgtttggccgcttctccgactttgagttgcaaggaaatccgtggcctcagatgtgcgcgagttgtttgtgtgtgtgtgccgtgaggtgcgtttatctatgaagctgaggatgagattcccccctcccgccgtctgattgtgtaagaagtcaaaaccgtgttgaaggtgattccagtggtggcctggagggaaaggcgacctcattccctgtgttcagtctgataaagtgaactgctgctctctaaacttgggaagtaatgaaaaataatttaggtaaaaactggttgcacaacgtctttgcttagtttaagcaacccacaatccactttcccagaccagttctcctgttaaatactttccctttagccacttcttgtcagcctaggctgggagggggaaagagtagggctgagagaggagtcggtctgaacaaagcattgtgtttttatttagtttaatacttccaaaacatctgtagacaatgggagtatgggtcccggccttcgtaccctttgagtagtgtggttctcatgcttttgtagcatcatgtgattactcttcggatacgtaaaaatagattttttttcttttttgtttaacctaagagtattctacctccataacatatcattttctctttcgtttaaagtgagctctgagcttaaatacttgaactgtaaaaggataataccctctcttcaaggattacctgagaccgttgagaagtgtttcagtgcccagcgtgtattcaactttcaatcgatgttagccaccatctttgccaccttttctccagttgtgctcttctttatgcttttgtttgctagagaatagcttttaacccaatattgttgccttgctttctgtccagtcaattctggaatactcaggggtgcaagtctggctctagaattcacactttctctctcccctcttctctgagtcatgttgcttgccctcggcaatgcgatgtgaatctggtcataggtagaaaaaagtagagaaaggcttcccactcctccctgaagtgttgtgacccaccttcaggcccgtaggggagattcccaggagcaggacaggtgatggtgcagggctggcatcatagctaagaagtatggattggtgaaagttaaagaagaaagggtgttgaagacttgtaggtttagtattgtcctctcctttaataatgcttgtcttttccctctcttgtgttccaccaaccataacaacccattttttcccctaacctacacaaagccatatcttctttctgcccactgctttgaggtctggctggaactaggcaagtattttggaagaggtgggggaggtaggaggcatcaggtgctggtaaagacatggcattagggagggctcttacaagccttgatcagagttacagagagccagtccaaaaatgaagctgagcattatcaggggacataatgcacctacctccttgtggagcttacacaaaataggagctgagaagacagaggtaatatgctgtcttacattaagaaaatctctcattgaggtatgatttactatgatcttgacttgtcccacaatataggtgagaagtgagtgttaggtgacacctgtctggcactctcctaacatggggacactttaatggctcacaagtttctgttgttccagttacagtggctgggaaagctgaaacattctggtttgtatggtggggaggatctagggtgaatgggtaaaagtgatgaacaaataaacgggtactagcaagtaagtggtcattacaaaccaaataactaccactttgagttttctgatttctggaatctttatgactccctcatggttatttttgccttgttcctgtaggtctttccatagataataacaacaaaattcttaccattagaactgcctctgtgcttttcttgggagaaagtaaaaaaaaaaaaagggtcctgggaaaaacttgcccgatttcatagctaggcttgtgaaaaggaaggtgataagtcagaagacagccgactgaataaaggacctggtgtgaggaaatagtactggggctttgaccaataggaaacacctatgagttcatcaatgcttttcaagcagcaaataatttaatctttgccaaaacccaggaactatggctgtgccctgctacccaaggagctccttttcccttggtattggctgatgggcaaggaaacccaagcctagaatgtgtttttttgttttgttttgttttgttttgttttgagacacatgacaagaatatatgataccagcatggccaatacactagactttgtgtgttggaatcttctgggacacattcttttttaaattttaaaaacttattttgataattacaaactgttataagaatagtacaaagaactcactatattcccaattagtaacggtttgctctcatttgctttatcacttgctcttttagttctctttccaaaccatttgttagtaatcactgaaatttattatttgttgtttctttcaagccatttgttagtaatcactgagagattggtacttatcaagggcatcctgtcctgaacagtggctcagttgcagccactgggtatagcagaacagtggtggtgaggcagggtccagaggtagagcaaagtctacctacagctgtgaagcacacagtttgtaaaccgtgtagaatctctagggctagatatagaaatcattatcgattgtaaaagtggttaagataaactccacttttctcaccattcttgtcaagtttgttcttaactatgccaaactttaatactgttaatgaaaattcactccactccccaactttgcaacaataatatattctccaagattttcatttaattcattcagcaaacatgtattaaataccttctgtttgctaggggtataagaggtgaaagatacccccttaacagctcaacttccagtggaaaggaattaagtcatcttctcacagtcaggaggaagagtgctctgctgaaggggttcacagggagtgatgggagcaccatcctggttaaggatctgagaagtagatctctgggagtcatttgggatgggtgtaactatgaagatctgtcttctctgaggcctgctcttagatgacaaggttcatgagttagagaagcctttggtgtcatatacccagcacaggctgtgaggtcaggccaacttggattcaaatcctaactctaccacttgctcttggccagttatttaacttctctgtgcctcaatttctttgtcaaaccatatctctgagggtggtagtgagaattgatcaatgctctgtaaacattcatttcatcttactctacaaaaatgcaatgtatggggaaattgcctgaaaagtaataggtattaaggtgggatccaagctggtgggggcgggtgggggtggctcggtgtgtttctattttttcaacaaataaatatctaattgcactaagagctatgatggacattaccatataggataataacaataacagcagcaatgatttcttaaacatttcctgtgtcccgagtactgtgctaagtgcttaactaacagaggatctctctctctgaggtgtgagactcagaaaggtgaagcaaaggtaacttgcccaaggtcacgcagcaagtataaggtagaatgtccctgtgagggagaccagcatggtgccctgagccttgagaatgagcaggaataagcaaggtaagggttagagagaagggattgccaggcaggggtagcagcaggtgttgtgagggcactgaggtggaagagagatgtggaaaggatccacagaggtttggctaggacttggggtaagagagatgaggtgggcagggaaagattgacagggccttacgggacctcattaaagagcttgtgttttattccaagtacaatgagaggtgtttctttctctctctctctctctctctaatgggaggtctgtctctctctctctctctctctcactctctctcatcctctctctctctctctctctcatcctctctctctctctctctctctctctcatcctctctctctctcatcctctctcatcctctctcatccagggaagcatatagtgaggcctaaacaaaaatggtttaagaaagtcatttccccttcagtgtcccaccttgcaatccaatagaggcaatgtctctggaccaaatgtgtaggtcttaaacagtttttatcgactgccattaacatggctaaaaagagtttctatgatgctggaagaagctggtccttcagaatgcttctagaaggaggtttaattaggctcatatagctgatgctttttaggctgcattaagggagctctttcagctctcactgatccctgtcacatggggaaaaagtagaattgagagaaaacataattcctggaaacctgagttgttgttcagtgttagaaatggaactatcgagtataagactttggtttaaatatatcatgataaagatacttcagtgactaaatggaaatttttttatgttttttgttttttgcatgtgtgtgccatctgtgatggcagacagcacatttgttagaatctgggaagacttaagtattttttcaatacttatatatttatatttattctcatccaggtactagaagtttttctgtttgaaactatttcttatctacagagtaaacttcacaggaggaaaaccagtgttctgttccccttcccataagtactaggccacaaacatatttacttttaagtagcctgtgtcaattagctttttgggggagggtggttagctggtggctagatgatctgggatagccttactcacacatctggtggttggcaggctggttggtctaggaggccctaagccgggatggttcatctccattctatgtggtctgccctccagctggctagtctggacttactaacatggtggtcttgaagtcacagagtagcaagtgagagcaagcaccagtgcacaagcacttttcaaatgtttgctgtgtcacatttgctattgtcccataagctaaagcatggaagtgcttctgtggccaagcccagagtcattgtgggtggtgaccattcaaaggtgtggatacagggagatgtgaaaaaattgggggccattactgcaataattcataataattagcaatgaatgtaagctgttaagctttgataaatcttgttaaacacccatttctgaatgtagtgtattctagagactaaataatgtgattgtgccattggtaacacctcttccaccaagtgtggaatggagtgatggtttttctgggaagaagccaaaggcagacagtgtggttttggacatagatattcttgtgagtggcttaactgctttctgatcttgtgtggctattatcaaaggagtctctagatttcctcaaccttccattcaagcattatcacgaaaaccctagtgtattagactctactagattttgtggtcaagccaaaagaccgttatttgggaaccaccaccacttaagagatgaaagaaacatttgcagtctttccttggaacctttatatgatttataatttgtacctaagagaggaaatccgtatttgagcattggtaataaggacaagggattctctgtaaatgtgttttaattggttaagatttaaaaatcttcctgtggttgcagtgaaaaatccagcattgtactgtgaagtgagtggccaggaattaccaatttggggcatcagcctttgacctttgcttgtgaagatctcagaagtaacactttccacataactgaaataggcttcacaacagcttgtggcctgaaatatattacatgaaaatgcaactggaccccaggaagtatgtgtgggaaactatacaaggctcattttgtatgtcttagagatgtacattcccccagaaaattgcctggtggtagaatgttagcttttcttctttcctcctaggataaaaattaaaaatctctgacattttaaaagtcagtgacttgaaagagcaatcaaaatttataaacacacacatcattagaccccacaaacacttccaggaatttattcaacaaatatttgcatattaattggagtattgcttgtagtagcaaaagattggtaatatcctaagggtcaatcaagaatattgaagacactgatagttttggaacacgcatgaccaagcaggtagagggtgagagggagacttttcactacataaacttttacgtatgtgttttgaattttaagcaatgtgaatatattttcttattttaaaagttaaatacattttttaaagagatgatatatagtgatgcaaaattccatagactcctatccgagttgacctgatcagagctattcctgttcaaaaaaaatctagccagtttttccccctagaaatgcctcacgatagtgtacttctgaatttttaactataattctgccttttccagaatatcacatgagtggaatcatgcaatatgtagcctttttttggtcttgcttttagtggattcatccatattatgtgaatgaatagcctgttccttttcattactgaatactattccattgtatggatgtaccacagtttgttcattcacctgtcgaaggacgacttagttgttaccagttttttggtggttttcaatagagctgtggtaaacattagtgtacagatctctgtgtggacataagtttgcagtttattggggtaaatacgtaggaatgggattagtggatttttctttgacagaaattaccaaactatgttccaaagtggttctaccattttatattctcctgccatgaatgtgattccacgtatggatgtctagttgtcccagcaccacttgttgaaaagactaccctttctccattgaattgcctttgcatatgtgtcaaaaatcagttgactatccttctgtggatctatttctgggctctctgttgcattgatctatatatctatcatttctccattaacacacagtcttgattattatagctttataataagcctagaaatcaggtaatagagtactctggctttttaaaatctttctctcagggtatgcttaagttactttttaaaaaaatttttttatagaaacagggtctcactgtattggccaggctagtctcaaactcttggtcttaagcagtcttcccactttggcttcccaaagtgctgagattacaggcatgagccaccacgtctggctttttttgctttttaagagacagggtcttgctctgtcacctaggctagagtgcagtggccccatcatagctcactgcagccttgaactcctgggctcaagtgatcctcctgcctcagcgtcttgagtagatggggctatgggcacatgccactatgcccacctatttttaaatattttttgtgcagagataaggtcttgctatgttccccgggctggtcttgaactcctgcctcaagtgatcctcctgctttggcttcccaaagtgttggaattacaggcgtcagccactgcacctggcctggcttttttcttctttttcagagttgtagtggtgagagaggacatccttaacttgttccaatcttggaaagcattccatctctcaccatcaagtatgatgttgtaggatttttttttaatatactgtgttgtgcagaaaagagttaacatagcagacctgaggctgctgtctttagaaggccaacgtgcacgattggcccttagctggtgtttgggaaattggcttttcaaatgtttaaaaagaaaagattatattctaccttcatttattccttttccaatgcttttcatttctttatggtaatccaggtttcctaccttgatcacagtctttctgcttaaagaatcccctttaacctatcttttgagggcagatctgctggcagtaaattctctgtttttggttgtctgagaaagttttcattttccttcacttttgaaaggacacttttgtgggttgacagttgtttttcctctttcaacatagtactccaccattgcctggcttacgtgatttctgatgagaaggctgctgtaatccttttttttttttttaataccttaagttctgggatacatgtacagaatgtgcaggtctgccacataggtatatatgtgtcatggtggcccgctgcacccatcaacccgtcacccacttcaggcacctctcccaatgctatccctcccccagtcccccatcccccaacagactccagtgtgtgatgctcccctccctgcgtcgatatgttcccattgttcgactctcccacccatgaatgagaacatgtggtgtttggctgtctgttcccgcgttagtttgaggctgctttaattcttatccttgttcctccatagttaatgtgtcttttttcctctgactactttgaagattttctttttgtctttggttttcagcagcttgaatatgatatgcctaattgtggcttttaaaattttttcatttttgtcctgctttgtgttctctaaactttattatatctgtggtttgttgcctgtcactaattttggaaagtttctcagccattatttcttcaaataattctatcttgttcttttttttttctctttctgggattctaattacaagtgtgttatactgtttgttattgccccacagttcttgagtgctcttcagtattttcattcgtctctttttaatttttattgactgatcaataaccttgatcttcaagctcactgagtctttccttggctatgtcaagtctactgttcagcccattgtttttcttactgttttttttttaatttctagcatttccctttgattcattcttacagtttctatctctttgctgaaattatctgtctggtcttgcatattgtctattttttacattagagtctttaagatattaatcatagttcttttacatttttttctgatagtctcaacatctgcatttactgagtctggatttagtaattcctttgtcacttggaatgttttcttgccttttgttacgcctcctaaatatgctgaaagctgaacatgggcaggagatgcttaggtaaatatttgatatgtttggagaagaacatatttatggaaatttgtgttaatttggtcaggagttggcctgtgtttttttgtttttgtgtttttgcttttgagataaggtctctctccgttacccaggctggagtgcagtggcatgatcatggctcactgcagcctcgacctcctgggctcaagctatcctcccatctcaggctcccaagtagctgggactataggtgtgctccaccatgtccagctagtttttaagatcttttgtagagatggggtttcaccatgttgcccagagtaggtctggaactcctgggttcaggtgatctgcccgccttgacctctcaaagtgctgggattacaagtgtgagccactgcgcccagcaagagttgacctgtttgatattgggtttgttttgttttgctgtgggtaccagagatttcttttctctctctctctctctcttttttttttttttttttttttttttttgaggcagggtcttcctctgtcacccaaactggagtacagtgacacgatcatggctcactgcagcctcagcctctcaaccttctgggctcaagcagtcctccaacctcagcctcctgagtatctgggaccacaagtgcatgctaccatgcccagctaatttttaaatttttttttgtagggatggggtttccctgtgttgcccagtctggtcttgaatttctaggttcaagcgatcctcctgccttggcttcccaaagtgctgagattacaggcatgagccactgtgctccaccaggcaccagagatttctgatttctctagtgatacattcattttgactcttgcttagctttgggtttttactttgtgctgcttcccaagagctagctctaacagctctcccagttgtattctattgttcttaaccatggagctggtttgccaggttgtggttagtaggggaggagggagttctctgatgatctgattaaaccttacttagacaggtactagagcctgggtcttgagtgtgtccttggcaagatttacttttcctcctcctggactggagcttctttttctttttcccatgttcctttaccctagctgcagtgggtatccaccagtgttctccaaccatgggtttcaagtccttcccccaaagactaagcctttttttctgtattggggataaagggatctgggtaggtttcacagtgggtgctgttttcctcagccagctagccagcaccatggtgggcgctttctctgagatttttccctgatcttccctgtgagagcctggtggaattcctgtaggaaaagcttgtaagagtgtagcaacctcttacaagcttcacactctcatgccagctcatactctggtctccagtaatttgtcagaacttctagtttggtcctcctacaagtttatatgctcggatcctgtgtctccctgcgggtatgagtatttccatatattgggattgtgggacagtggtttgtcctaggacctcagttctgtcatattgaagaaaagtagttgcttttcagtttgtctagcatttttcttttagtgagagtggagatggtagcatcccagtgctttatatccaagctgaaacctggaagttttaatctatataaatgtctaatgcaatgcatggtacatagaaactcagtacaggttagttttcctttatgtttctttttcttactctcttgaattttatggttttatgactagggagccaggaataattgattctagtttggtttctccctgttttaggcttaaaaatcctctataccacttaaacattatacgtttgtcttgctttcttccaaaattcaatgtatgcctttgtagtttttgaatatgtcattagcactcagtaatttgcgtcactgaaaattagagcatgattttatctatttagattgtagattttgttagtgaccatgtttttgtcatttttgttatccacatcgccaggtgccattcgcttcagcagacatttgttgagtgcccactgtactatgagtgaggcactaggtattgagtagaatacaaacctgactaggtaagtggaataaccaaggggtccccaagggcagtggaaactccatggagggaaggatattgcaacttgcacagtatctccatttcaatctagaaaggtttaattcttttaagaattctatttttatactaatgatacatgaatgcatcctagcaaaaaattgaaaaattgtagaaagagccatggttgttcttgacatcctcctcctatcacattctccttcccagggttaattttgattactatttctgtttgactgtagaaattgctgtgtgaaatatcatgccatctaataacttagtaaatacttttatttttaagggaataagctctcaaatttatttaacttttaaggaatgcttatttaaagagatgactattatcattcagtggggatgtgtgacctgatgatagttctttgtttcactttatagtatagctattttaattgttaaatcctacgttagtggtcagtggaaatgttgtagtaaatgggaaacacagaaattagtagtgaccaaaaagatgacctattggctgggcgcagtggctcacgcctgtcatcccagcactctgggaggctgaggcagggggatcatgaggtcaggagatcgagaccatcctggctaacacagtgaaacccggtctctactaaaaatacaaaaagaaattagctgggcgtggtggcaggcgcctgtagtcccagctacctgggaggctgaggcaggagaatggcgtgaacccgggaggcagagcttgcagtgagccgagatcacagtactgcactccagcctgggcaacagagcaagactccgtctaaaaaaaaaaaaaaaaaagatgacctattgacttttttttttcttttttgagagtcagggtcttactccatcacccaggctggagtgcactggccctatcatagctgactgcagcctcaaactcctgggctcaagtaatcttcccacctcagcttcctgagtagctaggactacaggtgtacaccaccatgcccagctaattttattttattttattttattttattttattttattttattttattttattttaagagatgggaccttactgtgttgcccaggctggtcttgaactcctgggctcaagcaatccttctgcctcagcttcccaaagtgctgggattgtaggcctgaggcactacacctggcctattgacttaaaaaaattatacagtaggttggacttttttggggttatttatggttctgtggattttttttttaagacagggtgtcactttgttgcccaagctggagtgtcacagttgtcactcactgtagcttcgaactcctgggctcaagcaatcctcctaccttagcctcctgagtagctaggcctacaggcacgcattaccacacctagctaatgttttagtttttttgtagagacgaggtctcactatgttgcccaggctagtcttgaactcctgggctcaagtgatcctcccaccttggcctcccaaagtgctgggattacaggcgtgagccaccacacctgaccccgttctgtggatttttaacacataaatagatcagtgcaaccaccaccacaatccaccacaatcaaggtgcagaacagttctattacccaaaaaattcctttgtgctgactctttagtcatactctctttccatcctaaactctggcagccactgatctgtgttctatcactacagttttgttattttgagagtatcacataaatggagtcaaactgtaatcttttgagtctcattttcctctctcagggtaatgcttttgagattcatccaagttgtatatatcaatggtttgttcctttttattgctgagtagtattccattgtccaaatataccacagcttgtttaatcattcaccattgaaaggcatttgagttgtttccagtttttgttgattgagtagagccgctataaaaattcatgtacatgtgtttgtgtgcatataagtttgcatttctctaggataaatacctgggagtatgatggctagaattgtactaccattcatggtaaaactagttagctagagtttgaatgctaggatggatagagtagcagagacccaagtttgaatcctgctttttctttttactagctctgcaaccttgagtcagtttaacctctttgtgcctcagtttcctcgtttgtaaaatgaagttaaccactggtattgtgtgaaataaatgacatattaaggataaaatgctgagcaatgtatgacatactgaatatattattatctcatgtttaatagaaccctttttgtgagaaacattcatctttgatgaattaaaatggagaaattaagtaatctataagtgtggcgtgtttggtaggcaagccttcaaaatatgttgtccctggggaaaatttcagaagtcctcagtggtgaaaaggtttaggaacatagatgtatgagagtcttgtataacatccaaaggttggaccagatgcccaagtttggtggtttgacttgccctgtcaacactgaagaatcagattcaccaaaaattgagtacattgctatatttcatgtaagaagctgcaaaaagtagctcagaatcagtgaacacttattgagctcaggagatccacctgctttggcctcagaaagtgctgggattacaggtgggagccaccacctggcttaatctccccagttttgagaaacacattgaggtcggaattacagaaatactcagcaagtcttgccctagagcactataccattagaaaatgcagtggagaccctttcttgcataactgccacatagtatggtctggctcagtctgagcaggcaccaagggcagagaggatatgttttcccctggagaattttcccgtatcctatgaggtgcgcacagaagactacccattcactcaccaggcagtggatgaaattcagcatttgcaataaggaacctaaatgttcttttattgtctgttcatcattttgtaatgttttcacatggtacagtccatcaactgtgacagttctttatctgggatttcagcagaactgggtggaacaaaaagtcttgagcacacaatcttaagagatgtcacctctggactgtttctgcactgccttccctctcccgtaccatcaacaatccaacactcatgtttacctgcacctttcctcacagctgggaaatccttccctctttgccctgccaatcctgcctgggccaattcttccaaattcctgtaaattctatctcagcgagagattttccactatccccaactctattcttttggatgccatcccctactacatatttcctcattaagtcctgtcttttctattcactttggccctaatgccatacttccttactctgtgacctatttgtgtacatgtgacttgcaggtatacagctagacagagtgatagaaaaccttcaggttctctgcatcttatctcccacaaatacctgaaggggacttgctgcctcttattcaattaacaaaccaaatatcgattatcattttgtgtaaaaaaaaattacatgtaacatgttcttatttgtgttttttggtttttcttaaagacaggatttcactctgtcaccgaggctggagtacagtggtgctatcatagctcactgtaaccttgaacttctgggctcaagcaattgttctacctcagcttcctgagtagctaggactacaggtgcacaccaccatgcctagctaattaaatggtgggttttgttttgttttgttttgttttgttttttgtagagacagggtctcactatattgtgcaggctggtcttaaattcctggcctcaagtgattctcctgcctcagcctcccaaagtgctgagattacaaatgtgagccaccctccccagctgcatgtagcgtgatctaatggctatatacttcctgtggaaaacaatagttaggaaaagaaatacacattttgcagattgtcaaaactgctgctttgccatgctaccgttgtgaaaagtgtggctgtacagtctgcctgggtaaagtatggcttcagagtgtagattgcagacagctcttccctggctccagtttggtttctagccttcctcatgattccttgcccacttaaacaatgttaacaccaggaattttgtcttttcaaatatagacaaaactttgactataaacagctgtatcctacttgtctcacatgaaacttatacaggagcggtgtttgtgtatgtgtgtgtgataagcctaaatttagctctctttggaataactaacataaatccagaagaaacttttttctttctttagttgatagtatggattagaaaattaacatgcaagaaggagcttttttagacttctaaataaacttacttgaaagagctccaattatgccccttagcctcttaaggataatccgtgtagacacttgcctttagggtaattgtctctaggctactttcttcccataatctctgtgtcaccatattccaagtccgactcaacttccttctggactgctgtccataaagatgcagactcaaaaggctttttcactatacccttgtttcccaccctcaccactaggctaccactgacctctggctgtgcactgcacagtaagtagtgtgtgtaccctctagaacctgacattcaaggtcccccatacccaatcataatctttcccactacccttgactcctctcaaatacttttctctagccactctgtccaagcatgtattcactagagtctaaacataccatgagtcattctgaccgtctgcctctgcctggagtgttctccatattgctctgagtttgttccatcctgtgtgttcttcaggacccagtgaaaagctcatcttttcactacagtggtttcttccacctctgaagccccacaggactaaatgtgctcaacactcatttacccagatgggatagtgtggtagagtacttactggctacaatgtcctttcatctctgtatgtacacttagagtgtgattttgcagatccttgcaacaagaggtggagtctgtttctctactccttgaatctgggctgtccttgtgactcactttggtcagtaaaacatggcacaggtaactccagatgacttatgagcctaggtctcaagaagtgttgtagcttctttcttactctccattctgaggcaaccatgtgaggaagccccagctaacctgctggaggaagagagatggtatggagagggagagagagatccagtcatcaaccagccatcagatatgtgagtgaagccatcttagaacattcagccccagtcacattggcagatgactgtaaccatatgaaggaccacagaaaagaccagcagaacaaccacctagctgattctagccgaaattgctaatccacagaattgtgagctaataaaatggttattattttaagctactaagttttggggtgaattacatagcaataaataactgaaagggcagggtttgtactgctatatccccagggcctagagggcatgaccatggcaggttttcagtaaaagactgttgtggattactgtcattgtggtgtcactcctctctttgcttaatagacaaccaaacttcccagtcctcttggctctcacaaaagttcaaagcttgacttcaacacattcttccagaataacaccttgaagttcttctttgccccactgcaccagcatccatccatttgcccccatcacagccctatgacagacagttcattacaccccacctcagctccatgttgcgtccctcctacttacccttattctctaaccctgtggggtcaacccattgaccacctcagtgccataaagctcttctcaacttcccagccccccatccataccctgaacgcgcactacctgaatcacatgtgcttataattaggaggaaccttagaaattgagacagccccttctagttatgaatgaggaaaggaaggcccagataagaaataataataaatggcttattcaaagtcacatggaggcaatgtcaaaagtagagcccacatctcacacagatgattacctagtggattgcctgtgttttcctgcatctggtgcttggtttatgtgtaggacaatgcctttaatgattaaactatgggaattctttggaggcaggcataataccttttacttatgccttttctcattgccagcatatctccacttaaagactaaccagcgactactagacacatcagtagtcaataaatacctgttgattaattgacattttaaaaacaattatgcctggaactttttaatatattgtttgtggtagtgattacaatagtatacatttgtcaaaactttaactgtacgttaaaaagggtaaattagagtatatgtaaatttttttttttttatttgagacagagtcttgctcttgttgcccaggctggaatgcaatggcacgatctcagctcactgcaacctctgcctcccgggttcaagcgattctcctgcctcagcctcctgagtagctgggattacaggtgcccgccaccatgcccagctaattttttgtatttttagtagagacgggggtttcactatgttggccaggctggtcttgaactcctaacctcaggcgatccacctgcctcggcctcccaaagtgctgcgattacaggcatgagccactacgcccagcctatataaatttttttaaattaaagcgtaatcaaagcaattatgctgaagaaatccatttatttgataaatgtggctaaatatataggtaacatgttactatgtgaaaagaagtttggccctttgaaaataaacttgcatataataggcactcaatgttagtttccttcttccttgtataccaatgcttcatgatcacctgtcaaggctactaaagaaagcattcttgtactagaagatagctggatctgatctgacttctaagattctatgatttgtttaaaaggtaaataaatgactgttttgaaatgcctgtgtaaagtaaaaatacgtaagcactacaacactgttctaaaaggtggccccctaggaccttaattttactttcaaagacttagttacaaaataactagtcccctgttaatagaagttacttaaagcaaaaggatgtctgaatatcctttcagtgtcgtactggagcattggctgacgggcccacccaagaattacttagttctctaggggattgcatctttgtttggctcactgttcactaatgattagagtcgagaccttttcaagcaacatgttaacttatagatttttgcctggtagagatgtaaaattttctgtttggtagaagaaattatcctaaagactacagattaattttcctatagggcataaccacttttctaatttagcaattttattcgagcattctttcaaggcctatatatagcaagtctctcaaatattctttgaataagctttaaatcctgttagttccctaataagttaaatgtctttgacatgtgttcagtctacatttgtatgagtcatgtttttaattttgaaaattatatttcgatacccaaacattctacaacattgcctgtgggtcatgacccatcctgtacagagtccctgaaatccattactgactgttggttttgatgctgtgctagcaccttcaaatacctttgtgatcatgctagtacttgaagaggtcttcacaggaataattttggatacctctgcaggtactcaagaacactgcagaaagactttctgggacttctctcacaaaatgagaaactaatgttccttcctatcatgttattgttctgtctataagctgagaggatgacattaagagcctttgttttaggagatccatggcaaacagactcacagggtctttcttgttaaacaatatttctataatctggctttcctagtaatggccataaaataactatatcatagcaataaaaattgataaactatcagctgcctcaaaaatctaatagctttggcaaaatatactatagctcatgtatatcctctttttctctaacagattttaatacttttccttttcatactactgaacagcataatcaaatcaacaaattcagctaatggccattgtgttgtgggcactgtgcttggccctgcacatccccatgttccctctcccctttgtcaaaaactagctccactggttgttaatgtcaatcactgatttgcggttgtccagaataaaaatggagagcagagcccaaacggagggtggcagtcggccttgtcattacccaaagaactaaaaatggagtaatgcaaaagagtggaactccttcacattaacaaaagcttagttatatacagtataagaccactgaatattaaacacacaaatttgaaatatgcagagaaccaggaagaacaggttaaaacatggttcactaattctggtatttataagtattctgagtcagcttgacaactttattgaaagaagcatgaaacatcttacaataaaaattcaaactcagaagtaatccaggtgtgattcccattcatacaaaaggatcaaagtgccaacttcgtatgcagtatagggaatcctctgcagaggaagtgtgaaccaaacttttaaaataccagggaggatgaggtggagtggattgagaacaggagtggaagaaaaaatttcaacccacttttcctggtgattatttaaaaacaaaaaatctactatttaatgtttcacaataaagtgttttagaaaaagtaattagctcggccagcttctgccccaggatgtagaaagctggaagcagtgttgttcacatccttaaaattaaaaaaaaaaaaatgctgggctaatttcaaattcatgacttttgtcaaacccatcagagagaagtattttgcccaagtattagttcagagaagtatttgttcaagtgtttcttatttaagttgggttgtttcttactgttgtttttgaggttttttccctaatagtctgggtaaaaatcctttggttatttgatttatcagcaaatattttttgtatgtaacttggcttttcattgtcttaatggtgtcattcactaagcaagattttcattttgttttttttaagacggagtctcggctctgtcacccaagctggagtgcagtggtacaatcttggctcactgcaacctctgcctcccagattcaagcaattctcatgcctcagcctcccgagtaggtgggactacaggcgcacaccaccacgcctggcaaattttttttttttttgagacggagtctccctctgtcacccaggctggagtacagtggcgcgatctcggctcactgcaagctccgcctcccgggttcaagcgattctcctgcctcagcctcccgagtagctgggactacaggtgcctgccaccacgcctggctaattttttatatttttagtagagacggggtttcactgtgttagccaggatggtctcgatctcctgacctcgtgatctgcccgcctcggcctcccaaagtgctgggattacaggcgtgagtcaccgcgcccggcctttttttttgtatttttagtagatgtgaggttttaccatgttggccaggctggtctccaactcctgatctcaagcgatccaactacctcggcctcccaaagtgctgggattacaagcctgagccaccgtgcccggccttcttctatgtttataagaaaaacttgcttataaaagttttataattttacatttatgtctattttgagttaatctttgtaaatggagtgaggtttaggtgaaggtctatttttgtgtatatggatgtctttaatttacttttgcatctttgttgaaaatcagttgcctatatttatgagggtcagtttctggtctctcttttgttctgttggtttattctcagtctcactctggctcccaggctggcgtgtacagtggtgcgatctcagcacactgcaacctccacctcccaggttcaagccattctcgtgcctcagcctcccgagtagctggtattataggtgcccaccaccatgcccagctaatttttgtatttttagtagagacggggttttgccatgttggccaggctggtctcaaactcctgacctcaagtgattcacctgcttcaacctcccaaagtgctgggattacagacatgagccactgtgcccagcttgctggtctgtttttaatcactttgccaataccactatcttgattactatagctttatagtaagttttaaattcaattgttattattcctccaattttattcttctttttaaaaagcgtttttggctcttctagttcttttgctgttctttataaattttagaagctgcttgtctctctctacaaaaaataggctgtggactcttaccagtctgtggcctgttaggaaccaggccacacaggaggaggtgaacagtgggcaagcaaacattcctgcctgagctccacctcctatcagatcagtggttgcattagattctcataggagcacaaaccctgttgtgaaccgctaatgtgagggatctaggttgcacactccttatgagaatctaatacctgatgatctgagatggaacagtttcatctggaaaatcatcctcccttcccccgtccgtggaaaattgaaacctgtccctggtgccaaaaaggttggggactgctgccttattgtacaggctgatacttccagtatgacattgaataggagtcatgagaaagggcatctttttcttgtttcaactttaagtctttcacttttttttttttttttttttttgaggcaaggtttctctctgtcacccaggctggagtgcagtggcgtgaacacggctcactgcagccttgatctcctgggctaaagcctcgacctcctgagattacaggtatgagccaccacgcctggctgatttttctttttttagatttaacgtggttgaatacattgatttttttttttttttttttgagatagagtctcactctgtcacccaggctggagtgcagtggcacgatcttggctcactgaaacctccgcttcctgggttcaagcaattctcctgcctcagcctcctgagtagctgggattacaggcgcctgctaccatacccagctaatttttgtatttttagtagaaacggggtttcgccatgttggccaagctggtcttgaattcctgatctcaggtgatccgcccatctcagcctcccaagaatacattgatttttgaacactgaacccaacctgccttacattcctagggtaaaccccacttggttgaggggtattattatttttacatattgctgttagatttgctaatattttgttggaggtgtttgtttctatgttcatgagggatattggtctgtagttttctctttttgtatgtattgtctgtgtttggtatcaaggcttcataaaatgagttgggaaagcttccctccttgcccatattctggaagagatcttgtagattttttttttatgtttgttggaatttgccagtaaaactatctgggtctgggcatttcttttttaaaaggttttaaactttgaattcagtttccttagtagttatgggagtattcaggttatttattttattttcaatgagttttagtagtttgttatttacaggggattgctccatttcatttaagttgtctatgtgtgcagttgttcatagtgtccatttattatccttttaatatctgcaggacctgtagtaatatcccctctttcattcttgatattagtaatttgagtgttcttttttgcttttcaattgtgctagaggtttatcaattttgttgatcttttcaaagaaccaacttttggcttcatcgatttttctctgttgtttttctgtttagtcctttatcttgactgtttcctaatcatcttgctttggatttattttgctcttcttttcatagttccctaaggtaaaagtgtaggttgtttttttgagaccttttttcctcctaaaagagaatttaatcctataaatttctctctaagcactgtttccactgtagtccacaaaatgggttatatttttggttttcttgagttcaaaatattttataatttatcttgaaagtttctctttgattcgtggattatttaaatatatgctgtctaatatccaagtgtttggagatcttcctcttatgtctctgttgttgattcttaattcctttatggtcagggaacatgctctttatgatttccatattttatattttggaaggtttgttttatgatctaggatatggtctatcttattgaaagaacacgtattctgctattttggggtgaagtgttctgtacatgtcaggtaatgacggttgatgatggtgttcagttcttgtatatttttgctgattttctgtctactagttctgtatattaattagagtgttgaaacctccaagtgtaattggatttttctattattttagatcttagagttttgcttcacgtattttgaaacactattgtaaatgtttacacatttaggattgttaagtcttttgggtatgttaacccttttaacattatgtcatgtccctctgcatccctcttctatcttggtaattttctttgctctaaattactccttttggccaggcgtggtggctcacgcctgtaatcccagcactttgggaggccgaggcgggcagatcacctgaggtcaggagtttgaaaccagcctgaccaacatggtgaaaccccatctctattaaaaatacaaaaagtagccgggcatggtggtgggcgcctataattccagctgcttgggagctgaggcaggagaatcatttgaacctgggaggtggaggttgcagtgagctgagatcacgccactgcactccatcctgggcgatgagcaaaactgcatctcaaataaataaacaaataaataaattgtttcttttaatcagtgtttgcatcacatatctttttccatccttttgcttttcacttacttatatcattgtatttgaagtgattttcttacagatagtgtgtagttgggtcatgttttaaaaatccattctaaaaatctgtctttaaattgtaatgtttagaccactacatttaatgtaattattgatatgattgttttacatctgtcgttttttatttttgatacctgtttttatttcctcttttttcccattttcctgtcttcttttggttatgtgaacatttttagtgctactacatttttatttacctactgtgattttttagttatctctttgttttttgtggttgttctagggattataatatacatagttttatacagtctacttagagtaagtgctttaccacttcaagaggaatgcagaaaccttaccaccctataggtccctttatcctcctttctttatgtcatagttgtcttatatattacacctatacctgttgaaaattccttcacacattgttaccatttttgctgtcagccaccaaacatattttaaagaactcaagaaaaggatagtatattgtatttatccaaatattcaccatttatgttgctcttttcattcctaatattctaagtttccttctggtatcatttaccaattgtctgaagaacatcctctagcagttcgtttagagtaggtctgctggctataaattctcatttctgaaggacatttttgctgagtatagaattctgtgttgacattttttttacccccagcacttcaaacgtgttgtgccacttccttctgacctccatggtttcttttttgagacggagtctcgctctgttgcccaggccggtgtgcagtagcatgatctcagctcactgcaacctccgcctccctggttcaagtgattctcctgtctctgcctcctgagtaagtgggactacaggcacgtgccaccatgcagctaattttttgtatctttagtagagatgaggtttcaccatgtttgccaggctggtctcaaactcctgacctcaagtgatccactcaccttggcctcccaaagtactggggttacaggcgtgagccaccacacccagcctggcctccatggtttctgattaaaaatccactgtcattctaaatgttgtacccccataaggtaatgtaatagctgctgctttcaagatttttttctttgtattactttcagcagtttgatttaggtatgcctggacgtgggttaattttttttttttctgttgggatttttcactgctcaggctattgaaagtataagtcagctctagattttataatagactggaataatattgataaaagacttcttttgaaagtggcttggcatcatagggaattgcacagtgaaatatataagtatttactatacatctcagacagaatttaacgttagtaaattctagttgtaactcctgctctctttcaatgatgtggaagattgttaaaaacggactagaatggaaggaattaagccccagaaaaaataagtgagttttgtagctttacatacctagtaagttgcaggtcttattttcaggtactgtttccactgtaatgtattgctgtgtacttacagaattttcgcctccctcaagctgaaactttaacataggtttatggtgagatactggtttgaaatatctactttttatcaggaaaagtctaaattttcagtttcttcagtgaggcatcaagtcttagttaagagcacgattggcaccctgtggcctgccagccaaatctagtctgctacctgtttttgtacagtccataagctaagaatgggcttttcatttttaaatggttgggaaaaaactcagaatagttcatgacatgtaaaaattatatgaaattcaaatttcagtgtccataagtcaaattttattggaacccaaccacatcagtttgtttacatattgcccatggtttattttacactacaatggcagaattgattaggacacagaccaaatagcctgcaaagcaaaaaatatttactgattagccctttacagaaaaagttcgctaactcctggtttacaataatgttgagtgaattaggttagagtgtcagtaatctgaactgtgtgaaaagggtagctaggattcaaactttactctttgaataagtatcttagatgtgagaaaattagaagatgagagttaactgattataatcctagtctattaacatatattaaacattatcagtcctacagcaatattccacattatctgtactttttaaattagcccatcagatcaggagaggttgataggaggaaaagttggagttgtttctacctaggtatttgaaaattgttggaggcattgagactcatgcataagggacttaggaagcctttactggctggaggagataaaggctcttatttaaaattctgtgttttcctggttatatttctgttttcctagagttgggctttttataggtctagttagttacctagttgcctttctgcaggcttcttttgtgagggtgtttctctatggctagtgggaggaaatggctggtcatttttaaatgaagaggaaagcccaactcttaccaggacctcagcctgacattgtcccttacccctatagaggcctttcttctgagcctatagacccaccttgccagctgacatcagaagcctattgagatgtccatagcctgttgttcccaacctcttcccgttttctccccttcttttcaaagaccaaatgagctacatctacactacgtatacatttaaggattttttttaaggcacaaatcatcttgttacccactgaaatttaagcttagttgggtcacctaagaaacaacctagaaactgccaattttattttttcatttaaaaatataatttcagcttttattttagattgagaagatacatgtgcaggtctgtcacgtgggtttgttgcatgacatcgaggtttagggcacagatggtcctgtcacccaggcagtgagcatagtacctgataggtagtgtttcagcccttcctcttccctctctccccatctagtagtccccatctttatgtctgtgtgtacccagtgtttagctcctgcttatagacgacaacatgcggtatttggttttctgtattaattcacttaggataatggcctccagctgcatccatgttgctgcagagaacatgatttcattcttttttatggctacatagtattctatggtatataagtaccatattttctttatccagtcctcctaggttgataccgtgtctttgctattgtgaatagtgctgtgatgaacatatgagtgcatgtgtctttatggtagaataatttattttcctttgggtgatatacctagtagtggaattgctgggttgaatagtggtttgatttcacattctttgagaactccccaaaccactttccacagtggctggactaatttacattcccatcaacagtgtctaagttcctttttctctgcagcctcaccagcatctgttactttttgactttttaataatagccattctgactggagtgagatggtatctcattgtggttttgatttgcatttctctgacaattagttttgttgagcatttttttcatatgtctgttggccacttgtatatgacttcttttaagaagtgtccatgtcctttgcccacattttttttttttttggatacagggactcactctgttgcccaggctggagtgcagttgtacagtcagtctcagctcactgcagactcaagctcccaggctcaggtgatccccctgcctcagcccctcgagtagctgggactataggcaggtgccaccatgcctggctaattttttttttttttttttgtagaggcagggtttcaccatgttgcccaggctagtcttgaactcctggtctcaagcaatctgcccactttaacctcccaaaagtgctgggattacaggcgtgagccattgtgcctggccttttgtccaccttttaatggggttgttttttcacttgttgaattttttaagttccttatagattctagatattagacctttgttggatgcacagtttgtgaatatttttctcccatttgttagggtgtctgtttactctgttgatggtttcttttgctgtgcagaagctcttattaggtcccactggtcaatttttggttttgttgcagttgcttttgaagacttaaccataaattctttggcaaggctgatgtccagaaggtatttcctagattttcttcttgtatatttatagtttgaggtcttacatttaaatctttaatccagcttgagttaatttttgtatatggtgaaaggtaagggttcagtttcttcggcatatggctagctaattatcccagcaccatttattgagtagggagtcctttccccgttgcttatttttaactttgtcaaagatcagatagttgtaggtgtgtggctttatttctgggttttctgttttgttccattggtctatttgtcttttcgtaccagtaccatcctgttttggttattgtagccttatgttttgaagttgggtgatgtgatgtctccagctttgttctttttgactaggattgctttggctatttaggctcttttttgttgttgttgttccatatgaattttagaatatttttctaattctgtgaaaaatgatgttgctaatttgataggaacagtgttgaatccgtaaattgctttgggcattatggccattttaatgatattgattcttccaatccatgagcatggcatgttttttcatttgtttatgtcattgtgatttctttcagcagtgttttgtagttctccttgtaaagatctttaacctccttggttagatgtattctaggtattttatttttgtgtgtctggctattgtaaatgggattgcattcttgatttatttctcagtttgaatgttattggtgtatagaaatgctactgattttcatatattgattatcctaaaactttactgaattcatttacagaatctaagagtcttttggagaattctttagggttttctagacataagatcatataatcagaaaacagataatttggcttcctcttttccaatttggatgccttttatttttttctcttgcctaatggctctggctaagactcctggtactatgttgaataatagtggtgagaatgggcatccttgtcttgttcctgttcttaaggggaatgcttccagcttttgcccattgattatggtgttggctttgggtttgtcataggtggctcttattattttgaggtattttttttgatgcctagtttattgaaggtttttatcatgaagagatgttggattttatcaaaagcttttgctgcatctatttggcataaatgcatctatttagatgatcatatggtttttgtttttaattgtttatgtggtgaatcacatttattgaattgcatatgttgaactaacctagtatcccaggaataaagcctacttgatcatggtgaattaactttttaatgtgttgctggatttggtttgctagtattttgttgaggatttttgtctaccttcatcagggattttggcctatagttttcttttgttttgcctttgcctgatttggttatcaggatgatgttggcttcatagaatgcattagggaggagcccctcctcctcaatttttttggaataatttcagtaggattggtactagttcttctttgtatatctggtggaatttggctgtgaatacatctgttccagagcgttttttggttggtagattttttttattattgatttagttttagaacttgatctgtttagggtttaaatttcttcatgattcaatcctgggaggttgtatttttccaggaattcatccgtttcctctagattttttagtttgtgtgcatagaggtgtttataatagtctctgaggatctcttgtatttctgtggggtcagtgtaatgttacccttgtcatttctgattgtgcttatttggatcttctctcctttttgttagtctagtaagcagtctatcagtcttatttagcctttcaaataaccaactttttgttaattctgtgtgtggatttccgggtctcagtttcatttggttctgctctgattttagttattttcttctgctagtttttggggttcttgtttttctagttcttctaggtgggctgttagatcattgaattgagatctttctcacttctttttttttttttttgagactgagtattgctgttgtcgcccaggctggagtgcaatggtgtgatcttggctcactgcaacctccgcctcctgggttcaagcgattctcctacctcagcctcccaagtagctaggattacaggtgcccaccaccatgcccaactaatgtttttgtatttttagtagagatggggtttcaccatattgtccaggctgatctcgaactcctgacctcagatgatccacccgccttggcctcccaaagttctgggattacaggagtgagccaccacgcctggccttttctcacttcttgatataggcatttagtactgtaaactttcctcttaacactgccttttttacatcccagagattttggtataccgtgtctctggaaaccaccaattttaaatgttctgtacacattaatttttaggctaataaaaatgttactctcttgatttggaaacttatcttttaggtgacagaaaaacaaattttgtactattcatgcatatgtattttcaatacatatgtgtgttctttttgtttaagaccgggtctcactctgtcagccaggttggagtgcagtggcataattatggctcagtacagcctcgacctcctgggctcaagcaatcctcccacttcagcctcccaagtagctgagactacaggcgcacaccaccacacctggctgaatttttttttttttttgataatttttgtaaagatgagatttcaccatgttgcccaggctagtctcaaactcctaggctcaaacagttcctcccaccttgacctcccaaagtgctgggaggtgcccagtccatatgtgtattttatagctattcactcttggatctgttactaccatgaaatacagctgtcctaaatgccctgggccacatcatccaggagggtaaaaccagagtctggatgatagtcactcatagactttagctgttatagttctccagcttccagagcagtcttcagctatacccattttgccctggaggtatctgctatgttttcctgactaggtactttatagcacctaatgtcccttctctcttctttcctcttagcacttttggtgacctcttgggcagggtctttcctggactactattgatttcaacctctggaagcttctcttctattaatatgtttgcacagcccccagtgctgctgctaccactgacttgcttgacttcccatttggctgacccactcatgcagtactcaactaagggtactagtgtctgtgctaaggttcttggctctctcatctttctgctgtagctgggactcctggagctgtgggagctgcatgtcagcttgtttaggtttctgtgaagagcctctcactaggattctgaactgagtccttgcaagctagctgagctaaagaatgaacctgagtaacacacttcacacagttttatgaattactgctccctcacgccttggaatattgccaccagattcagttggtgagctaccattttctcttggggccccttctttaacaggagattcctgttccctcaataatacaaatttctggtaggataggccgctcctaggcactccctaacaggtgagaatcctcctggtgtgttcatctccttatgcttaagtagggcatatgtgaggatttgtgtatgtattgatagtatattccttatagtgcatacattcctgttggaaagcaagacttcagagtagcaggtaaagaattacgattactaaccttgcaaaagagaagatcaagagggtgccctttcagtacttggaacattttaaatgaaaataggtagtagccagttataattatgggtactgagaataatataaagactttcttgctatgataggtttaagaaaataaggaagtatttctgacaactgttgaaatgggtcccaaaggaatatagtagaatttcctggctaggcctgagaaaaaaatgtccatattctcccttttggaagttaaggtaaatgtagaggacttaagaggcagttggcaggatgggggtgggggtgtgttcttacgtcatcacccagccctcccatggaggtagcataatgtagtggaaagatgtgtctttgggaatcagtccatgggttcagatctcagctccctgaagctgttctgtgtaaatagatactatcatgtggcatgtatgattaaatgaattaaaatagtgcctccatgagtatatcctcctgtacttggggagggacttgaggtcacctagctcttgagatctgatctgtatgagctaagatggcagtttattgatatatagtgaagattcaactgtgattgcattttcatatgatggagccacctcacaccggattgcaagagccgatttgcgtgcatggctttcaaattccatgatgagtgacatcatcttagtagcttgaaattgaccatcttgggagtatctatatcacaggaatcagtaaactacaaatcagggctttttctccctcttgaagagcctgatgataaacatttatcagcatatcactgatactatctctctgtctttgggtgagttgtgtggtaggccaagccatcttcacaagattacatcccaagtgtggacttggaccagggactttagttccatgattctcatgtttgatgccatcagcatgagagttgcttttggtccttttcttttctcttcttttcttttcttttctctttgagacggagtctcactctgtcacccaggctggagtgcagtggcacaatctcagctcactgcaacctccccctcccaggctcaagtgattctcatgtctcagcctcctgagtagctgggattataggtgcgcgccaccatgcccggctaatttttgtgttttttgtagagacagggtttcaccatgttggccaggctagtcttgaactcctggcctcaagtgatcacctacctcagcctcctaaggtgctgggattacaggcatgagccaccgcgcctggccttttggtctttttctgaaactgcggtgttcttgtccttgagcccggaggggtagatacttggacatggactgtatctcctctggaccatgcttacataggaatttcaagctgtgtaactttcgtttttgtactccttcagactgatcccccttttatttttagtctttttccatcctaagtagaatataaactacagttgcttgtttttactaaactgtagtcatattctaatcctgcctccctgaaatgaagtcagacgtaactgttttttgtatccatgccattcccaaattaatttggagttttggatattgatgagcttttttggctcctatataggcaatatcagggtttgtccccttagctgtccaattacatctgaatgcagattttaccagtttatctttcataataaaaatctgcattttgctcatccccagcatgagaggtaccgtgccgtttggtccatgtcctgataatgtgtcacttccaacatggagcctccatgccgtctctggacagatttagtcaatattctatcatgcccccaggaaatttggagccttcctttcttcctctgttatacaacctgttactctgggttctggtaatttgttttcctttcttccttatccctccaccagagcccacgttcctggagattacagacctgcaattatctgtccctggtatctgataccacaactgtatcaggcctctagatgaatttggcatgtggatagattaataaaattatgtgaaattaaagggtcggtgaaagttgttagcctgtgggagtttttaagattaagatcactgtctaaattcaagttgtgtactgtcagttaagaatcaattcctgggcagctttttgcctcctttataatatttctcagctttgataattgctaaagtatgtgaaagtgcctttggacagattccctatataggaaggagcacgcaaaggaatgtcactcctgacctacacctttgtcctggaattatgtggataaataaactaatccttctatttaaaggatggtttcccttctatggatagacaggccagattgtttgatgctaactcatgaaattctgcctgtgtaaaggatgcctgtattctccctgcattcattttgtgggctcgctttatttgcatcagttttgacttaagtgttcctaatcattggcaatgaagatacaggttaaatacaatatattattgatagttcagcagacaagaatgtagagagagaatgcaaagaaggataaagatagtgtcaaagagggaaagccttaaatatatgtacatagagcataaaggaaagtatatagcatataagtagaagtataatatacctgaagaaaaagtgaacaagtcataagggtacaacgctattaataatctcaaagtgaacttacacattcaaccagtgccccagtcaagaagaacattataagcacctcagaggccttcttcctgagtacccctttcttctaccgcaggggttaccaggttactgctatcttgaattctgtcactatagactaatgtcattttcacactttgtgtagatggacaatacacatacacaaacatatcacaattttttaaaaaaactctacttttttttttgagacagggtctttgtcacccagactggaatgcagtggcacaatcatggcccactgcagccttgactcactggacttaagtgatcctcccacctcaacttccagagtagttgggactacaggtacatgccaccatgcccggctaatttttgtattttttttttggtagagatggggtttcgccatgttgcccaggctggtctcaaactcctgggcttaagtgatctgcctgccttggcctcccaaagagctgggattataggcatgagccaccatgcccagccaaatctactctactagtgatgaacatttctgggttgtttctagcttggggctgttacatatagtgcttatctgagcattctcatacatgtcttcaggaacatttgtgtacatttctgttgtatatataattaggagtaaagtagctgggtcatagggtgtgcacatgttaagtaagcttcagtagctattgtaaaacagctttccgaagattttatcctaatttacattctcaccagcagcataaagaggcactttgccaacaacacttgtattgttgatgtttcgaattttagccattttgatgagtagtagtggtgacttccttatttctcttttattgaggcataatttacgtatagtaaaatgcagagattttaagagtacagtttgagttttgacaaatgtatgtacccacatagcccacaccctaatcaagatataaaacatttctatgtccctgaaagtatcattgtgtctcttttcagtcagtcccctctaagcggaggtagctactcctattctgatttctgtcaccatatagtttttcctatgactgaacttcatgtaaatgaaataatatagtatatatattcttgtatctggcttatttttggtttattttcctcaatataatgtttctgagattcatccatgatgtagaggaatattcatatcagctatatttctaataaccaaagactggaaacaacccaaatgccctccagtaagtaaatggttaaactgtggtgcattcataaaatgtaataaaagaaacaaactattcataagtggatcaacttgggtggctctcaaaagcattatgctgaatgaaaaatagcctatctcaaaagtttacatactgtatagtttcacttatgtaaaattattaaaatgacaactttattgaagtataatttatataccacaaaattcacctgcataagtatataattcaatgccttttaatgaatttactaagttgtgcaaccatctccataactcagttttagaatatttccatcacgctaataaaatcccttgtactcatttgcagtcactccactcttctcccctcagccctaagcaactactaatctactttctgccattgtagatgtggacatttcatataaatagaagcgtataacatatggtcttgtgtgtccagattctttcacgtagtataatgttttgggggtttatctgtggtggtacaacatatcaataattcattcctttttgttgctgaataatattccatcatgtggatgtaccacatcgtggttattcctttgctagcagatgggtatttgggatagttccagcttttggttctcatgaacagtgctgcagtgagcattcatgtacatatccttgtgtagacataagttttcatttctcttgggtagaattttaggagtagaattgctgggctgtatgttaaatttatatttaattttttaaagaaactgccagttttccaaggtggctgaacccttttatagtcctaccaataattcctgggaaatatagcttgtgtacttgaaaagcatgtatattttgcttttcttggagtgttttgtagataccagttaggtcaatttttaaaatagttcttgtttaggttttgtatattctttatttttttctagttctatttattaccaagagtggaatgttaaactctgttagtgtccaattgtctgtttcttcagttctttgtctttagttttcagcagtttgatcatgatgtgcctaggtgtagattcctttgtatttattctgtttggtgttcttagtgtcttggcagttttaaacttttttttatttttattttttatttttatttatttttttgagacagagtctcgctctgttgcccaggctgtagtgcagtggcacagtctcggctcactgcaacctccgcctcccgggttcaagcgatttctggctaacttttgtgtttttaatagagacggagtttcaccatgttggccaggctggtctcgaactcctgacgtcccagctacttgggaggctgaggcatgagaattgcttgaaccccggaggttgaggttgcggtgagcggagattgccccactgcctccatcctggcaacagagtgagactccgtctctactaaaaatacaaaaattagctgggcatggtggcagtcgcctgtaatcccacttactcgggaggctgaggctggagaattgcttgaacccaggaggcagaggttgcagtgagccgagatcgcgccattgcactccagcctgggcaacaatagtgaaactccgtttcaaaaaaaaaaaaaaaaaaaaaatttcaactacccagataagtcaacttggtatcttaagaataaaaagatatatacatgtacaaaacaagtccctttaagataaaataccatttgcagataagacctcttaagagtaaagtaaatcaataagagatgcttttactatgaaatacacaattctttctccagatagaaactcaaacgatttaaaaaaacgatttcccattgttttatctgctgctgtgagttgtttccacactgaaatttttacccacatgtacccattatacatttacaataacgttcatgtgatttaaagtaatcatcccaatttattagaaggaaaaacaacctttatcccaggttttcgtaacaacgtaacatgccttatatgtgaggcatgtaaacctcacatataaggttaaacacacagaaatgaccccaaacttactgagcaagttcaaatccactgcacaccaacttttaatactgtgctaacagagggcaggcactgtactggccaccagaaagaggacagacaaggaaaaaactgagaaaccaagtcctttggctcccacagagccagggtcacaggaccaggtgcaccaaacactgtggcttgggtgatcacagcctaaaactgttaaccaatgatgtgtgacaaaccaattagaggggggtttgagttaatcccaagatcaatcaaataggatatgggtgtgacatgaaggagggttactgttaaaccctcacctctggtcagatcaatgcccatggcaaaggagcagtcagacatggaagttaacatacaagtcagtactgactttgaaggcaacaaaaaatgagggaaaatgaaatggcaacaaatttccctggggagaaatcaaagggtctggtagataaatgccaatacatgttaaatcccaaaaaaatgtatttggcctccccagcagaggttctcaacccccattacacatgggaatcatatggagaacttacaaaaatcccaatgtccaaattgcacccattaccaattaagtcagaatctctcttttggaagaaccagtttttagatggattgctttttctgtttttctgtttttgattacattgacttttgttcttttattatttccttccttcacttactttgggtttatcttgctcttctttttctagttaaagtgggagcttagattattcatttgaggcctttcatcttttcctcatataagcattcagtgctctaaatttccttcttagcactcatttaagttacaccccacaagtttttctttttgagatggagtttcgctcttgtcacccaggctggagtgcagtggagcgatcttggctcactgcaacctctgcctcccgggttcgagcaattcttgtgcctcagcctcctgagtagctgggtgcctgccaccacactcacctaatttttgtattttaagtagagacagggtttcgccatgttggccaggctggtcttgaactcctgacctcaggtgatctgtccgccttggcctcccaaagtgctgggattacaggcgtgagccactgcgccctgccacgagttttgatatggtatattttcatctacattcaggcattcaagccactgtactgatgagaagtgtgacgcttagtttccaagtgtttggagaacttcttgtagtctttctgttttgttttgtttttttccttttttgagacagagtctcactctgttgcccaggctggagggcagtggcacgatctcagctcactgcaacctccgcctcctgggttaaagcaattctcgtgcctcagcctcctgagcagctgggattacaggcatgtgccaccacgcccggctgatttttgtatttttagtagagaggggatttcaccatgttggccaggctggtctcgaactcctgaccttaagtgatctgtccgccttggcctcccaaagtgctaggattagaggcgtgagccaccacacccagccgtctttctgtttttgatttctactttgattctattatggtctgagaatatactctatatgatttcacttcttttccatttgttgaggtttgttttatgacctgggatgtagtcaaccttggtgaatgttgcttgtgcacttgaaaagtaagtatattatgctgttgttgggtgaagcattctataaatgtcaattaaatctggttgactggtggtgttatttcttctatatctttgctgattttctgtctactggttctatcaattactgaaagaggggtattaacattctcaagcataattgtgggtttgggtttgtctatttctcaattcaggtctgttgggttttgctttgtgttctttgaagctctgttatgtggtgcatacacatttaaaattgctatgccttcttggtggatcgaccctttgtatcattcttttagtccctggtaattttctttgctgtgatatctaattatctgatattagtatagccactccagttttcttttgattggtgtttgcatgatattttttttccatccatttactttttattttgagatacggtcttgctctgtcacacaggctggagtgcagtggcacaatcgtagctcaccataacctccaattcctgggctcaagcaatcctcctgcctcagcctcccaggtagctaggactacaggtgtgcactactgtgcctggttaattttccatttacctttaaactcactgtatcattactttgaattggaatagactgaaatgtgtctactccatcctgtctggaatgggaagtttgctctctgcactatttttgcaactcctgtctaaatttattatctcaaaatctcttaactcaaaataaaaaattaactcaaaatttaaaaattaactattaaaaaagcaagtatatgataaaaagagcagtttattaatgttcctacatatctggaaagtattaatttgagaaagagaaagaatcaacctatcattttgtgagattttcacttactgtactcttccagagtgaggaaacaaacaggctaagaaacgggtaaaacttacaagcctggggataattgggaggctgaccccctatctgtgggcccagaagaaagcaagtcactttgtaacaaggaagtatatctatttttcctcaaaagataaatattcaccacacctggtattcctggttttgccttgggagcggggagctgttttctcagtccttgcattttctagtctccctgcctggattttagtcatttcactacttattagcattctgaaaggttaacagaatttaaaatgtgtaactcgagaagaaataaaaggctaatcagttagttacaacacttgttagttctgtaaaagcaatgatgagtgagaaagctggaaagtactgactaaaatatggctttctgagaattagttgagttcagtcatttttgctgttcatgctccagtagccgccccaggaagccagatttggaaacagtacctgagtcatttgagacaaaacaacaagttacccctgaattgttttaaatgttaacgaaagagatcactaaaagatctaagtcatggatggaacctaattacctccccttggccctagaaaaccaaaaacatccagataggaatatgaaacacagaagaaagcaggtttttcctttctattcatttctcctattatcttagccctattttaattattctgagttaacgccattttacaaaaatggacagataaaaaattaaactcaaaattttgaaacaaagactctttgttgctgtgtgtggaaagtgaccatcttgtcaaaaaaatacctgtgagcctacagcatgattgattgttcaatgtgatgaaactttcctggaccctaagcctcaatattttgttatctgaaaatctgcagtttaatttcatccttcaagatcaaaggcaaataaattaacttggtctagtgattccacaaatctctagagagctgccaggcaaggcagatccacagaataactcattaacttataatgcttaaagcaactttgggaaaactgttaggaattgaacacaggctaaaactcctgaaggcactcaccaatgtatctttctacacagttgaccagaaaacagctaagctctgcttgactactccagtgaccaggagctcactatctaacaagcaatttattctaatgtctagacagctctaaacatatggatgattttctatgaacagaaaaaatctgccttttaacttccaaattctgcctttatgctggatttctttctgttaacaggttccaacctctctacctttattcccaaaccatctcttgaccctacttcatttttctctagctaatatccactttctttctttctttgccttctcttgcaaactcctcaaaaagtagtttacagtctgtaactccttccttactctcaatctctccttaattgcttctatctcaccagaattcttggaaaaatgtgcatacttcccaaccctcatctttaagtatctgtatgctgcatttgacacgctgatcactctggccttcttgaaactactcctttggcttccagaagcttttttcaagttccctgtgttgctaacactttttttcttcctctaaccatcttgtaggtgatggtggttccctgaagtgccctacccacatgcttatggctcccaaaacaaggtcctctggtccagagctggagatagaaaggaaaggcgaaagagacaggaaggtaggagggaaaagcaaagcaaagaaggaaggaagaaagaataggaaagatacatcaacaaaaagaaaaaagtcctgacaaccagatacatcaagctggaagacgatcaacactgaggaaactatgttctgttttccactagttcttcctaccttctaactggtctcagttggcaccttcctctatgccatcacaaaatctagaaaaatctctgaactctttcctatatcttaccctggaacatccaatcaattattaagccctgtcagttaacctctaaaataatcttccaaatcaatgttcctttcccatctcagctgtcattttcttagtttaggacctatctatttcctcaaacctagaatgcaagagcagtttcctaactggctttaaaagtcctaatcttgttgtccccaaatttaccctccacccaactgccagagacctatctaaaacacaaattggatcatgtgcctccacggtcaagagatttcaatggctgtcctttgctcctaggatctttattaaggtcctcatcaaggccaacacagccctccacaatcaagccatgtctacttctgcagctttatccctcaccacattctgccccagttttatgctcaaacaatgctgaacctctgcagttcctacctctaggctttataccatcccttctcccaggaggaccctcttcttgcttcctcacttttaaaacatataaactaattcttataaggctcagcaaacaggagccttatccttataaggcacagcaaatctcttctaggatgcctcccctactatgactcacccacactttgacaatcaacagcagtatgctctcagagtggcctgtgtatagtaccatcactaacttaaagtatttttaaccactaatattatcaaatctccgagaatgagttcctaccaggtatggactggactttaaaaattttgtaatggatgttattcttcctttatctctttgaaaatcttccagatttagacagtgagccaataatacatttgtccctggtcctaagtctctctctgctctcctgcctgccactctgaacagaagcaacatctttttactgtctctgttcatgggcaatctctgacttcacagtcagggatcatttcctccattcactgaatgttttaatcccattatctacagaaatacaattcccagccatctctacctttttctggacctaagagtccagaatgtccataactataggcctgtaactaataatcctcacttattgtctgatctgtttctggtccagagatttatactttcttgaccacagatatgtctaattttttactttattatcacttttaaagaaaggagatatgaatttaaagtatgaaatcagagccatcttgacgagaagccctcaagtttaaattttatgactattacacaaccttttagatcggggtcagcaaactacagcccatgggccaaatctagcatactgcttatttttagtatggcctggaggctaagaatggtttttacatttttaaatggttgaaaacaatttaaaaaatattttgtgacatataaaaattatgtgaaattcatatttcagtgtccataaacttttattggaacacacccatgaccattcacttatgctgttccagttactgactgttgtgcaacaaacaactgcaaaatttagtggcataaaaccaccaccactttatcacttcatgaattttgtgggtcaggaattcagataggcacagcagtgatgacttttttctactccacaatgtatgggacctcagttgggaagattcaaacagctggatcatctggagacgtcttcactcatctggcatctttgactgggatggctgggcttagcagagactacctccagagtgcctatctaaggcctctctggcataggtggcttctcaatagtcaaacttcttacatggcagctcaggagtcctagtatgagtgttccaatgaacaaggcagattgccttttatgatttagcctcagaagtctcatactctattgtattgaagtagtcacaagctcacccagatttaagtggaaggaggcacagatcctacctcccgaggagaagagaataaaaaaatttgcagctgtgttttaaaccttcatttatgggtttcacatcattttattgcaaggatccaggattaatgactgatttaaaatgtgatacacatccaggtctcagagcatccaagcttcaaaacaatttagcttcacaagaggaccatcatcagggtcatgacatgtgaacaattttaatactttcctatttgcttctggtcagtctttaattccaaacacatagaacacatgtgtttttaagtgttataggagtagactggtgccttaaaaaagagtaatttgtatctgtgtgatagatagcaaaaatggccccaattctttatccatgccctttccttatggatgctccttgaatctggactggctttgtggcttgcttagggcaatcgagtacagtatgaggtgatggtgtgccagttcagagcctaggcctcaagaggccttgctgcttctattcactcttagaaacctgaccaactaccatgagaacaagtctgggctagcctgctgcaggatgagagatgcatagctctgtgctcctacctcctaccactgccccagttgacagccgttggacttcaaaagcagagctccctgctgacctgtagttgaccataggcataaggggagaccagctgagaacagcagaactgctcagctgaacccagcccaaatgactgacccatagaatgaactaagtaattactattttaagccactaacttttgaagtggtcgttatacagcaatagttaactgacagaatttgaaacacagcttttaatgattaactgtagagtggaaatttcatcacaaacctcagtcgtactacactaaatcactttgggtactaattttccaaagtaggcattactgctgggatccacagaggaaggcactgtagctaatgccaagatcacagatgggtcaagcacttgacccaaaagaagtacataacagcagccatacgagtagcaaatgtcactctatctggaagtttctaatcctgtctgatgccaaggcagccataaggtacctcccctgtccagagataagcgtggcacctgcaaccagtggttaactatttaactggaatgtcagagtaacacatcagagcacccctataatcccagcactttgggaggccgaggcgggtggaccacaaggtcaggagttcgagaccagcctggccaacatggtgaaaccccgtctctactaacaatacaaaaattagctgggcgtggcggcaggcacgcataatcccagctacttgggaggcttaggcaggagaatcgtttgaacctgggaggcagaggttgcagtgagcggagactgagccagtgcacttcagcctgggagacagggcaagactctttctccaaaaaaaaaaaaaaaattagtttatattaggttgaaccatatgaaactgccattgttgcaagtcaaaatgtttgcatatcagcaatttcatagggttcaatctaatactgcaggatttggctcatgaacaaaaataagcaaaaaataaaagcttccttcctttgcttctcttagtctccaaagccctcacatattctagagaagtttaattcctatgaacttttaaggacatatattaagaaatacataaagcctcgcttataaatacatttttttttctcaattcaaaacacctagtttcctttaggagttgtattccacttaccagacttaaggtaattagcctgtgggtccccagtggagtattaggtctctctacctacatctcaaatttctagatcagatctgagcaccctcttttcatgtgccatttgtacacggcgaaccaggattccagaatgttgtttaacacaagaggaggttgttgacaaaaaagtattctgattattactatcagtgtgtgcttggtgtcagtggggggaggatatatttgattttattctagtttctgctttttctgccccagagttgcaaccagatggctagactatcatctctgggtctcttgtcagtcagagcaggagaagcctaagaggcaggattcctacccctgcatatgtgactagagtggtgaggcagttttcctccatcttcctgggcagccacaacaagaccctgtgaggaggcgcaggtgcttcgaataactggcactctcccaggccacagccgaagccacatgctcagaacagaggctcaattttaatccttctgagacaccatttcagggattggccaatatacaaacatgtaatcaatgtaatgcttttgtgtgctcgtgtgggtcttgagcttgtgaattttttgcattaacggttttagaattttctgcctagaaatttttagaattacccaagtataaacgcagtcttttttatggtaaatgttatttcatgagaaacactgcatacataatttcagcttcaatggtcagaagatcctgtgctttcaagcttactgttagaaatgcaaaacagggacaccaaaactccatcatcccacctcagttccctcagtacaggatgtttccctccttcaaaggttttttataagatctttcgtccagtgtattttacataaccagctttctctatttcccaaagaaaattattgcacagtctaattaagttttcccttaggaaacaccactcctgacacacaaaggaagacaaaacaatggtggcagactgtggaaacagaaatatttcatttttaccagctgaaaaactataaaaattaaaactacccctaagctattaatatgcaacgatttgaaatatcagcaattcacaggagactggtaaaaagtcctttgttcatttactgtttttatcaagttctgaattcagaaccccacataactactttgacaactgatagcatcacaaccacctaaaaacaagttcagagcgttccgttgtagacagtataaatgatgcttgtttttgcatgatctgtctcagaagtacagccaaggaggaactaagtctcacatgttcactctcacagggcccatcaaagaactcaataaagatctgatgaaggaacttaggctggaatttggaaaatgtggataacaccaatttctagtccattatcatattatttttattataatggctttgtagtaagttttaatttgataaagcaaactcccctcacaaattttcctgcttctggggcatttattctttccaaaatgcaaacctgattatgatacttgatgtaaaacccttctgttgcttcccagtgctcacagactcccttttaggcccctgcagaactgcggtttagtagagtggagagtgcgagtttagggtgaaatctgactgctcaacaggagagtcactgccaccatcagagaacctctctctctgacctggttccttaccaggctcactctctcctttaaatatgcattgaacaaataatggtttttgcaagggtgctgtgtaaggggttcccaagatcacccctaggttcagtgattcacaaggaagactcacaggattcggcatataatcatactcatggctatgatttattacactgtaaggatacaaagcaaaattagcaaagggaaaaggctcatgggatgcagtgcaggggagacaaggcacaagcttctaagagtcctctcctagtgcatacacagaacacaatttccctagcaacaagttgtgatgatacatgtgaaatgttgtctactagggaagcccactagagactctgccccagggtttttattggtgactggtcacataggcaccctctgactggtacagaccaaaattttagacttcaagaaataaagcaggtattcagcataaaccatattacttgtataaacaattccggcacaatgagccacccttatccgttctgggaaggtcaagaaccatccccaaaataaagttcttattcgccagcccagagtcaaccttgtaagcaggccttttcaaagtcaggtctgctatgataacatttttttttttttttgttgcacagatgccaatcattagcttggctgggcacctacacattctgcccagacctggatggggtaaacaaaactgtgacagtactctgagcaggggactaagggaacaggaatagaggaacacccatccttttccagtggcttgaaagaaggggcaatgaggactgcttcttgggagaggcaatgcctgagcccagtttgaacatgatagatattgtggtgtccatagatttaaatgctaaccaggtaagtgagcttggtaaattaatgagactaagctgtatctcagaaagtgagttacccatatggaccagggctattaatcactttgattccctgctttaaactttgtatggcttctaaatctcctgcaaagcatgcagctctgtcagaggtggtgccaacctaattttccagtcctacctgtgatactctgccccttcagtctctgtggtcccaacatccggtattcttttcagtgcctggagtatgttcctttctacctccaatactatcctaccccctactctggactgctcatcatcaccctatcctacttcacatggctatctcctagtcatgtcagatttcaatccaaacaacatttcctcaggatagccttctgtcccctaccccagagtaggtagggacccatgtcatttgcttcccagcaccaagtaacttctcctttatcactgtgggcacattaaagtccatttccttacacattgacacttcaagagggcagagactatgcctgtgttgttcactgtgataaccacagagcctaacacggtgcctggtacatactgggcactcatcaaacatatgaatgaagaatgaatcagggctcactccccttccccaacactacacacctcctgtgtctaaggcacatggcctaagctaggtcgacaagtcagccaagtgttttgacagaggtattgggaaagaggcactgcattgctacagatacagtctgcctgagagtgaaactaaatcacaggaacacacaggtgagaaaaggagatttggggctgcaataacagcctggatgttgccattcctaaagtcagcagcctgtggacttcatttaccagtaaaccctctttctgttacttaggctaatttaagtcaggactctgagatgtataactaagaatccttatagaaaaatagtaactggaattaggcacgtggttggtcctaaagaacaagagaaagactaccaggaagcctaacttgtgatgtcccaagctactggcctagggagtccttacagttccttaaattataaaaagggttggttattgttcagggagaaaagatgccctggctgggaagtagagcacaagcatcctggctggtcattatcctaaaaactactttatttgtggaaactcaaaccagatctcccaataggctacagagagacaaaaatctcccttattttcaatgggggtagatataattattgcaaataaaaagcttgaatatcacttcaaactagattctaaaccacattaataaagcattggctggataagcacttgaaaaagaaaacagtcactagcagccagcataggctctctaagaacatgacacacccaacttactttaggctcttttctgttccagtcactcatttattgagaaaattgtttataggtacagtaatacgtggaggcagctgacaggattttcctgctgatagattaaaaaaaatgcaggctgcaggcaggtaatcctgaaggtaggagtcttctggtgggacacagagctatgcccttggccctatcttgatcaaaactttgatgagtaacatagatgaatttagggttattgaccctaagagggataacattcatcaaagaaaagaggagaattcaaaagcaaatattataagcaaaaacaggatgaaatttaactagaacatatgtaaagtcactgcaattaaattgtttcccaaatacaggatgatagcagtttcagcttttgatgtcagtaaacaccacagtttagtgatgcagctactaaactcgggctgaattcagaaacataatgtctacctcagttggacaacaactggacaaccatgttccaatctgagtaccattaatggtgaccaatgaaagtgcatccagagaggggaaccaagactagaaaaagtttggggatcatatcacataaatgaccattgaaagggtgagagatggtgtagccgcctgggaaagcaaagacagaatcctataaaactgaaaatatccaaaccctatgacccagcaatcctatttctaaacatatatctggagaaactctcacaaatttgcacaatgatcaacatagaactgtttataaaagcaaaattcagaaagtagttaggtttccatcaatagaacggctagacagaataaggttcattcatactctggaatactttgcagcagttaaaaacaatgaagtgggtctataatcaatcaggatagactaagtttgccaaggtaacaaaaggaacctaaaatctgagtggcttaacacaaccaaagtctgtttattccgtatgctacatatttaaagtgagttggtaggagagcttattgtagttattcttgacctaagctgtcagaagctccatctctaccggccaggggaatggaatgtggcaaatctcatattagctcttaaaatttccatttggaagtgcattcattacttttactgacatttcaatgaccaaagcaagtcacagggccacgcctaacctcaaaagggacaggaactacaatcctaccacatgcccaaatggcagacagccaaaaacatcatgtgacatataataatacatactatgcaaagattaatagaaaacatatgaaaagatctaagatattttgctgtgtagaaaaaacagacacattcataataccaccatttatgtaaattaaaacatagatccaaaacaaatctatatatcgtttatatctatctatctatctatctatctatctatctatctatctatctaatctatctgaaactgaggagggaggaggatgacattagaagaggtgaccaaaggagaaataagcatttctgtaatgttttagtccctttatttaaaaatggtggctcatgcctataatcccggcactttgggaggctgaggcaggtggactgcttgagctcaggagtttgagatcagccttggcaacatggagaaacctcatttctaccaaaaattaaaaaaaaattagctggaagtggtggtgcacatctgtggtcccagctactcaggaggctgaggtgggaggctcactggagcccgggaggcagaggtttcagtgagccgagatcatgccactgcactccagcctgggcaacagagaccctgagaaagaaaagaaaagaaaaaagaaaggaaaggggaggggaggggaaggggaaggggagaaaacaaaggggaaaaggaaaaggaaagaaaagaaagaaaaaaaagaaaaaaggaaggaaggaaagaaagaaaggaaaggaagggaaggaagaaagtagctgggcatagtgatgcacacctgcagtaccagctacttgggagtctgaggtgggaggatcgcttgagcccaggagttcgaggctgcactgagccatgattgcgccaccgcactccagcctgggtgacagagtgaaaccctgtctctaaaataaacaagcaagaaaaaaagaaaaaaagatattacaaaatcttaattgttgataattctggctggtagagaatatgagtatttatcatattattctttgaatttttccattatattaaaatccttgaaataagttgttacatgaatcagaaatgttttagcttaaaaggccacgggggccaagcgcggtggctcagcctgtaatcccagcactttgggaggccgaggcaggtggatcacttgaggtcacgagttcaaggccagcctggccaacatggtgaaaccccttgtctactaaaaatacaaaaattagccaggtgtggtggtgtgtgcctctaatcccagctacttgggaggctgaggcaggagaatcacttgaacccgggaggcagaggtttcagtgagccaagatggcaccactacactccagcctgggcaacagagcgagactctgtctcaaacaaaacaaaacaaaacacacaaaaaaaggccacgggtgggagaaaggggaatgggaagtaggaaaatagatagctttaaatattttggacaaaagagatttgctgtgtgtgactatggagaggagagccaggaatgatactgacagttcctgaaaggcagattttggcttgggaataaagaaccaccaatctattaaggtttttggtcttattttttttagtagcctcaaaactgtatggaggaaaaatatgtattctttggggtaaaaaataatgttgtcaagagtcagacaaccacctgtctgacaaatactgtggcaaggattcctgcactgggaaggaatttggatttggtaatctccaagttccctacaattctcaggttccatcaaccttggactggaacctctcagtttctaaattctagttcacaggctctgggaaatgcaccacagttatcccaaggaaaacttcaaaagataatgcaacagtctgaacacaatacaaatctgaattgtgttacctgggaatatttcacaatcaataaggaataaatcacttaattgggactaatagttattataggcaagagagtcacaagaattatactggccttgaataaagctagctttaattctcacaccccgatcaaccttatgcacataattaaatcagtattatttggagaactattgcctgtttaattactgtttctgtgacttgttatttgttctcccagtaccaaaggcaaattgctcccacagctaaagagatctccacagaaacatcccactgaaataaacattcctttataaaatggaagagtaagaataatgaatgtgttttcttttaaactagttgctttggctgctgtcaaaagaaaaaataaaagtcttagcaatggaaaacaagtatcacttctatgaggagggccagtctggcataaagatagtgaggtaaaaactcaagcagctctctgctgctaccctgctcccagccaagaagataagggatttcaataggagtaaatgagacaacatgttatagctgaggattttctttcaaaaaggtaccataccttttaaaccagtaaggttctttgctgtacacagttaatatatgcctagaaggttataagttgagcagcctttgcatgcctggaacctgacagatctcaacagacacctgggaagcccactgtggcttttaaagaatgcatatttctggctgggtgcggtggctcacacctataatcctagcactttgggaggccaaggtgggcagatcacttgaggtcaggagtttgagaccagcctggccaacatggcgaaactttgtctctattaaaaatataaaaattagctgggtgtggtggtgcatgcctgtaatcccagctactcaggaggctgaggtaggagaatagcttgaacccgggaggcagaggctgcagcgagccgagatcgcaccactgcactccagcctgggcaacaaagtgagactccatctcaaaaaataaaaataaaaataaaaaataaagaatgcatatttctaccacaaaaatactgaaagcatgctgcaacataaaaacatgtgctctgcccatgtgtttttgctcgtttaggatttccttccttcagtgattctgtaccacataactaacaataggaaatactttcataaaagtgactgttatttagtagtttcttctattaactttcaaaactaaaaccaaaccaaacaaaaccaaaaaacagcccacaaagctcttaaatattcccaagttaatgaggttagtatggcttaaatataccttctttctagacccacattcctgactgtgctggagtttcatgtgtcctggtctctgttacccaccagaaataccatgtgaggcagaaagccccaatatgctggaaaagcagctgcctagaccaccacaatgccttgcagagacacagttggggccctaatctatgagcaaaacctgattcccacccccctccaggtttctccatccttcaaatgcaagcacttaacatcctaaaatgtcacaaagcagtgcatttatccttgggagatagaatttggtgataaaatgcaagactgtaatgttaggaaggacagagtgtggggaaagccagagacaaacaggagagggaggaggagaaaggggttgaggaatgaagttctgcagggcaaaggttactggaaaacagcaggacagaagcaagagactacgacagagaggcagggccaaggaaaacaacgaggtcaatgatatgctacacaaagacaaagaactgtgcttccagatgagattaccacatatgcctttagagaagtggttctgtttttcagggggtcattatgtattcagccaatagtgcagctaatctgcttactcttagcaacttttgtccacctaactgcaccaaacactacatatctgaaactattatttcagagatataaatactttaagggggagggaaagcaacccaaaacatccattaaaatatcagtgaagacttccggttccaagtaagatggtataaacacacacgtaacctttctgttgaccaaatgcaactataaaatctgtaaagaaaatatgggcaactattagagaactcttaaaagtatataacagcaggcgatcaagaaagaatgccagaatgcggagtacaactgaactggcagtgacttaaccactttttttcttccagtattcactggcctgaattcaacacaatgaaatctgaaagtgagcactgtggttagagcacatgttctggttcaaggtgcttttttggaaaagggaactactaatgctcagagaaactggagtggtgaggtggcggtggggggcggtggggggggaatcccctgggtttttctctcctttttctcccctttctaatgtctagaaaatcccatggtagaggctgtggcagcagcaacaaaaagtaactggcatagggagactgtacgagctaaaactctgaaagagagagaagaaacttctgtccatttggtggaactatggctccaaaagggcaaagccaaatcccattgctttttttttttttgagacagtctcgctctgtcacccaggctggactgcagcgatattggctcactgccacctctgcctcctgggctcaagagattctcctgcctcagcctcctgagtagctgggattacaggcacacaccaccatgcccggctaaattttatattttcagtagagatggggtttcaccatgttggccaggctggtctcaaactcctgacctcacgtgatccatacgcctcggcctcccaaagtgctgggattacaggcgtgagccaccgcacctggcctcccattgatttttcctactttttttctctctgtttgcctgccccttgtgccctagaggcagtgtattgtgaaagtgtgtagtttctcactggaggactaaaaaggaaagccctggaaaagtagaaagtaccagagaaataacaacgaaggaagagctcaggaaaacaaactcacaaaaagttgcttacaaactcctgggaaggcctccacttcctcacaggtggatctgattctaattagcatatcaaagacttggagaaatgagttaacacacacttaggtccctgactgacaggtgggtggcacacacacgacagaggtgaacagcactgcaaagccattgaatactgaactgatatttgaactacaccccacagaaagtgagatggaacttgcagtctgaacctaaccagaccaactgctgctgaaacaaatacattgacattctccatggggttgaaacaagatccagagtctcataacataatatccaaaacatccaggataaaatccaaaattatgcgatatacaaagaaccatgaaaatgccagctcacatgagaaaagacaacagatgccaacaatgagatgacacaaatgttgaaattatctaacaaggactttaaagcagctactctaaaaatgctcagattgccatgcatggtggtctgcacctatagtttcagctacccaggaggctgaggtgggcagatcacttgagcccaggagtttgagtccagcctgggcaatagaacaagatcttgcttctaaaacaaccaccaccacacactcaaacaggcaatcaccaaacctgaacactcttgaaagaatgttaaaatagaaaatatcagtaaaaagaagatataatgataaccaaatggaaactctagaactgaaaaaacaaccgaaataaaaattaactggaagaacacaacagcagaatggaggaggcaggcaacctgaagacagataaactggccaatctaaacgaaaaaaagattggaaaaaaaaaataacaaagcctcagggacctgtgggataacaataaaggatctaacatctaacatttgtataactagaatctaacacagagacgaaaaagagtgtgatgataattttttttttttttttttttgagacggagtctcactctgttgccaggctggagtgcagtggtgcaatctccgctcaccgcaacctccacctcccgggttcaagcaattctcctgcctcagcctcccaagtagctgggactacaggcgcatgccaccatgcctggctaatttttgtatttttagtagagacggggtttcaccatgttggccaggctggtctgaaactcctgacctcaagtgatccgctagcctcacctcccaacgtggtgggataaacaggggaaaactcccgcgccagttgtaatttttggatatatgtacttaaatttaggaatgtgctgcaaaatttttaaaagttattggaactggggctttttttttaaaagacataaagctggccgggcaaatttggtcacgcctttaatcccagcattttggacggttttggcgggcagatcacgaggtcaggaggttgagaccctcttggctaaaacggtgaaaccttgtttttactaaaaaagacaaaaaatttcccgggggtggtggcgggcgcctgtagtcccagttaattgggaggctgaggcaggagaatggcgtgaacctgggaggcggggtttgcagtgagctgagattgggcatttgcactcccccctggggtacagtgggtgtcttctttttaaaaaaaaaaaaaaagacataaagcagattttaatttagaaagggctagcaccattaaaatctgtcaagataacattatagagttgaccaccgagtgaggtctatagcagccaaacagtgagctgagaaattagggattggggtggggagtgttaggagagtgataattcaattgtattcttcaaattttcaatattctttctttcagtaaacattttttttagtttagaccggaggttgacaaatcagcgtgtgagctaaatctagcttgtcacttattttgatatggcctacaagcatacagaatggtttttacatttttaaatcattgaaaaataatgaaaggaagaataatatttcataacacatgaaaattatatgaaattcaaatagtataataaagtttttttttcttttttgagacagagtctcactctgttgcccaggctggagtgcagtgcatgatcttggctcactgcgacctccacctcctgggttcaagcaattctcatgcctcagcttcctgaatagctgggattataggcattcaccaccacgcctggctaatttttgtattttaagtagagatgtggttttgccgtgttgtccaggctgatctcgaactcctgacctcaggttatctgtctgcctcggcctcccaaaatgctgggattacaggcgtgagccactgcacccggccacaagttttgatatgctgtattttcatctacattcaggcattcaagtcactgtattgagagaagtgtgatgtttagtttccaagtgtttggagaacttgtagtctttctgtttttttctttttttgagacagtctcactctgtcgcccaggctggagtgcagtggcacgatctcggctcactgcaatctccgcctcccaggttaaagcatttcttgtgcctcagcctcccgagcagctgggattacaggcatgtgccccatgcctggctaatttttgtatttttagtagagaggggatttcaccatgttggccaggctggtctcaaacccctgatctcaggtgatccactgcctcagtgtcccaaagtgctaggattataggcgtgagccaccgcgcccggctggaataaagttttattccgaagagagttgtgttcatttgtttatgtactgtctatggctgccttcatgctacaatggcagatttgagtagttgtgacagagaccatgtggccctcaaagccaaagatatttcctatctggtcctttacagaaaaagttgggtgacccctggtttagacacacttcccaacctggccttctcatgcaaggtgatttctactcacagagtttgaaattcccaaataatttgctaacaagtctttatattaaagagggtaagcctggttcctggtgacagagataattgtggttgacaaagaaatacttgtctgtggcaggaatctgcctaggtaaatttgtatgttcttcctttatttttccttggatgttttttgagggctttggaaaagagttgacctccagactcctcatctggtcacaagattcatgagtcatatggtatatcttaattttaaaaaataagctttgaaatgctgagataaagtcttcatttagaaaagttcattatcccaacttctgctatctctttcaaagatttgttaggggtgaggagaagcagtgacatatgtagaatatgttctcttcttattttttgtttattcaatctctagatagatgtttatggctttaattactggactactgagaagtggtagaaatgaaagatacacaagatgaacagatttgaaggatagagttttgtttccatgacattgaagcagggatagaattgttttgtagagaggggtgaattctgaattaaagcacaggcacttaaactgtcttactatagaggttaggattgtttgccccaaagcagaggataatcagctcaagaaacacatttatagcattcatgacttctatttaagaaatagttggccggacgtggtggcttatgcctgtaatcccagcactttgggaggccgaagtgggtggatcacctgaggtcaggagttcgagaccagcctgaccaacatgacaaaaccccatctctactaaaaatacaaaattaaccaggtatggtggtgcatgcctgcaatcccagctactagggaggctgaggcaggacaatcgcttgaaccagggaggcggaggttgcagtgagccaagattgcgctattgcactccagcctgggcaacaagagcgaaactccatctcagaaaacaaaacaaaacaaaacaaaacaaagaaatagtttgggccgggtgcagtagctcacgcctgtaatcccagcactttgggaggcccaggcgggcggatcatttgaggtcaggagttcgagaccagcctgaccaacatggtgaaaccccgtctctactaaaaatacaaaaaaattagctgggtgtggtggcgcatgcctgtagtcccagtcctcgggaggctgagacaggagaattgcttgaacctgggaggcggaggttgcagtgagccaagatcgcgccactgtactccagcttgggcgacagagtgagactctgtctcaaaaaaaaaaagtttgggaggttctttgaccacatgggcaggaattcacccttcgggatataagaaacatgctgctctggtctgaccagtggcttaactgaaatgtctgtctctgataatggctctgaatattttcctgaaagcctaagggagctagactttcagatgtttctttccttaaggattacttccaaataccatcacagatttattctgatttttatctcagtccttcttgaacttgtttacattttcattttgtttcacttcttgaactgatgagttctctaagttagttccctaagcatggctgaaagtcctgttttccttttgataaaattgcctttaggtttcagggaatacccctttgttatttaattctataattggatgaataaaatcaagctgatcatttctacactcttcttaatagctcattgatttctgtttcatccctttagagcaagatttctcagccttggcactgttgacattttgagccagataagtctgcacattgtaggggactatttctgtgccttgtaggatgtttaacggcatccctcctgacctctatccctagatgccagtaacatcaattattgtgataaccgataaatgtctccagatattgccaaatgtcccctgggggggcaaaattgtcttcagttaagaatcactgcttagatctttggcttttccaaaatgcaaagtctgtgcgactgtcttgatgacacagagatgtctctgtttaattgattatattgcacttttctggatttctttcagctctggttaatgtccatcttgaatgacagtgatggccacttttatagtttcaatgtttcaagtcagctgaatcatttgggagtgacatgggaacagatatcttgaaatcttagaaaagtattttttccggttgtaaacgtcctatatgtttactctaaaactgtggggaatggaaaaattcagaaagaatgtttttatcaaccagaaatctgtcacttcagtgcaactaatgttagtaaattggtttatggtttttgctttctatatattttatttcatacatgtatagtaatttcactgtaaaaccaatttttatacattttaaaacaacttagcataaatgtttccctgtataccatgtttaaatgactggatgaaataccataatattaatgtaccttaattattcctcttttgtgtgataggtcggttttatttttattataaagttttaatggacattttggttcataaatcattttccgtgtttcaaattatttttctttcttttttctttttcttttttttttttttttttttttttgggacagagtctcgctctgtcacccaggctggtgtgcagtggcatgatctcagctcactgcaacctccgcctcccaggttcaagcgattctcatgcctcagcctcctgagtggctgggattacaggcacctgccaccacacccagctaatttttgtatttttagtagagacgcggtttcaccatgttggccaggctggtctcgaagttatctgatcctggcctcaagtgatctgcccacctcgaccttccaaagttctgggattataggcgtgaaccaccgtgcccagcctgtattaattttcaaggacgaatgttagaaatagaattcctaggtcaaacggtgtgaatatgtttaaagtagagcattattttttaaactgctacatggccctgcagagggcagtgaataggggccccttgcactgaccatgcatttcaaaagtatgtctcatgggtatatagtaggaaaggaaagggctatgtttgagctaatcacttttcctttccttggcctgcatgttcttccgtgggaatattaatggggagtcaagtagccaccaaaccgcaggcttaggttccagtcccaaataatcccagttgggttgacttccagacagtcctcctttaaaagggtattttactcaaggaagacatttactccagacatttgtattttgcctggtttgcagtcactgttaaaccactgtgctgttaattattgtacttgagatgatagtaggaataagatctgaaaactgccatcaaattactgttcccagtggtgcaaggtgaggtctagtgtacattttgtttctgccaaaatgaaggtaaggaagaaaagaatgcctttataaagtctgtgctctgatctgaggactagaaaataaacagctgaataatataaccaagtgtaagacatcgagatatatcacagttactctaggattacactatactgatttatggttttgtttaacaaaacattttattctaaggtaatttttttcatggtacaaataaatttatttgcttgttttatgttccttattcctcttttcttcccaagaagttactttgacaatcacagaccttattgggcctctttcccttctagttcttaaatgaatattcatgacagggacatcacagaaaacaattgtttgccgtatgctttcaggtgtcatcaagcatcatgctcagcccctgggctgctgtgactttgagatctgcctggtcaactaaagagggctagtccttctatggggcttttctttcttaaaaaaatttttttgacatacaaaaagctgtacatagttaatatatacaactagatgagtttggctgggtgtggtggctcacgcctgcaatcccagcactttgggaggccaaggtgggtgaatcacttgaggtcaggagttggagaccagcctggccagcatggtgaaaccccatctctactaaaaatacaaaaactagccaggtgtggcagagcatgcctgtaattccagctactcaggggctgaggcatgagaatcgcctgaattcgggaggcagaggttgcagtgagctgagattgcaccactgcactctagcctgggtgacggagtgagactctgtctcaaaaacaacaacagctactaaatgagtttggagataagtatatacctataaactatcatcacaatctatgccataaacctatctatcacccccaaaagtttccctttgctctattcttctgtcgtggtaagaacacaatataaaggcctatcctgttagcaaacttttaggtatacaatatagtattgttaactatagcactctgctgtacaaaagatctctaggacttaccttaaattaagtagtacattcttaaaattaccacttaataaggattcacatgttaagtaggggtgcctagaagcagaacctgagacagtattcaaatgcacatgatttattgaggagtgttctcaggagaaacctgtaaggggaagagggtaaccgggtaaggaaggagcagccagttagggtcttaagaaaatctagccatagcctgtttgaggtgatggcagaacaattattgactgcaggctgcctctgggagggagactggaagagtgtaatccccagttcttgggaagagaggggccattgtgagccattagcagccaacaagaagtagctggaaaatgggtacagtatgctagctaggtaaacaggattgggtgggggcagcacagtgtgttattcctttgcctgtttattttgtgcaggatactgtgctaagagctaggggtaaaaaatgaatgtgacacagtccctgctttcaagatgcttgtggtctagtgacaacagggctgaccatgtaaagcagcagtgtccaatcttttggctgccctaggccacattggaagaattctcttgggtcacacataaaatgcactaacacctaacgatagctgatgagctttaaagaatcacaaaaaaaatctcagtgtttaaagaaagtttatgaatgtgtgtttggtggcattcacagccgtcctgtgccacatgcaggctgcgggttggacaagcttgatgtaaagaatattgatggtgcaagtgaggtgcttctttgcatgtacttggatggaaagcaaaggagtgaataattgtgggggagggacgtctgggaagcttcatcgaggacatccaatgaatgaatagaaccagggttggggaaaatgggctggtcaaggaaaacatggggaggaattgtaggtagaaggaagagccctgtgcaaaggctggcaagcaagtatgaaacaagacgaacgtgttcccggaatcacatggggcatagtatatgccaaacaattggagtggattggggggaacagcagttgatgaggcctgagagactgggagccagaactgggcctcgcaagccatgctgaggagattgggcttagaaggggcaccattcttgctgtcatccctccagcctgtcctctggcttctggatcaacttggagtgctcattgtcaatgtacctgactgccccctggtggccatgttgctctaagcatgtcgctttaatgcttctgagccccaatttcctcatctgtaaaatggctgctgctgctatgtgtaggactgttgttgtgcttagaaataataaatagagatataaagatttaccatcattgaattattctgctgatatttattgttttctgtcattttcctacaataattaaaacagcagtatgtcacagaaatggacagacaaatcactggactttaaacagcccatacccaaaaattaacttgctttgttttcttttctaaaagtcattgatgactcattttcttatttcccaggactggtgtaactcgtattagataatctgtttcctaggctttttactgataatacaagattttttgtttccatctataataaaaaatagttgttactgtaattgttttaaaaatgccaaattttgcctattctttaaaatctccctctgtcaagaacagtttgataactcttttacttaaagaacagaatattatagaaaatggagaaactgttttatccaaagtacacatacccagaacttcagatgagaggagtatccatctcacaagaagtcttaggtcttctgaaactctcagggaggtgaggagagagggtccatggtcagttggctttcttcactgagatttttagagaataaaactgttttttctatgacatttgttgcccttgatcccatcatgagtcatccatatggaggttatattcagtgggaacataaactttcatttctctgggataaatgcccaggagtgcaattgctgagtcatagttgcatatttaatttttaaagaaatgaccgaaatattttctagaatagctatactattttacattcccacaagccatgtacgagtgatatagtttctctacactttctccatgatttgatattttcactatttctttatttcagctattgtaataataagtatgtaataatatcttgtggttttaactggcatttccctaatggctggtgatactgaatgtcttttcacgggcttaaatgccatttgcgttcctctttggtaaaatgtctgctgattttttttttttttttttttttttttgagacagagtctcgctgtcacccaggctggagtacagtgatgcaatctaggctcactgcaacctccgcctcccaggttcaagcaattctcatgcctcagcctcccgagtagctgggattacaggtgcatgccaccacacccagctaatttttgtatttttagtacagacggggtttcaccatgttggccaggctggtctcgaactcctgacctcaaatgatccgtccgccttagcctcccaaagtgctgggattacaggtgcgagccaccatgcccggcccatctcttgatttttaattaggtcatttgtttccttactgttgaatttttagagttccttatgcattctgtaatataagttcattgtcagatatgtgttttataataaatattacatgtataatatttctaagaaatgaccaaaatattttctagaatagcgattcctttttacattcccaccagcaatgtatgagtgatagtttcttcacatcttctccagcatttgatattacacgtgtgtgtaatatgtgtaaatattctgtcccattctgcttgcttttgcgtcttcttaacaggggctttctcagagcagaagtttttttaaaaatataagtagatagtttatttgggccaagtttgaagaccacaacccagcagcatagattcaagttgccctggatatgcttctgagagcaaaagtctttaattttgatgaaaacacatttttctttgccaatcatgctttaggtatcaagtctgagaactctttgcttagccctagatcctgaagactttctcttatgctttttgtaaatattttataattttacatttttcatttaagtctgtgatccattttgagttacattttgtatattaggttgtggtaggcagagatgtccgtgtcctaatctctgcaacctatgaatatgttaagattgctatttagctgactataaaatagggacattatcctggattatctgggtgggtccaatgtaattacatgggttcttaaaagtggaagagggaagcagaacagaagggtcagagaatgagatgcgatgacagaaacaggatcagagagattcagtgttgtttgccttgaagatggaagaagacagccgagatcaagggagtaagagtgtcctctaaaagctgtaataggcaaggaaatgagttctcccctgtagcctctagaaaggaacgcagtcctgatgacatcttgattttagctcggtgagacctgtgtcaaaatcctgacccactaaactataagatagtaaatttatgtagttttaagccactgagtttgtgataatttgttactgtaacgttagaaaactaataggtgttttagaaaagcttctattaaaataggattttatacatttgggtatactgtgtatctgaacaatttttatatatgcaacatccccatgatatcagataaatgaagtgctactctaagtagatctgtgcattcagtggggaatagttagaaaatgtattacttttatttctgcttaaatttctacattcattgtgactttaaattccccactactactttttaataggaagtgtcttgttgttactgttggttttgtttgcgtttcagaagagatttgaatgaaattttgcaccagagagccaaatgtagccccaaaaatttatgtgatgggaggctcttttttaaaaatattcaattgactttgactataggacaaacagaaccttagttaatggttctgattcttgtactaattttattagttttttaaatgacagctttgagatataatttgtataccatgcagcttacccacttaaagtatacaattcagttattttaatatattcacagatatgtgcaaccaatcaccaaaggacacaatatgttttcacactgtcttctaattttgtttctgagaaattagctgttaattttattggagttctcttgtaagtgatgagttgttttttttcccgggctgctttcaagattttctccttgtctttggctttcagtaattttactatgaggaatctctttctggatctctttgcatttatcctacttggagttctttgagtttcctgaatatgtaaattaatgtttttcagtaaatttggggagtttttctaatattttttctgctcctttctcattcacttttccttttggtactcccattatgtatatgttgatgaacttaatgatgttctacatttctctgaggctgtttcttcttcttttttccatctgttcttcaacttgcctaatcactgttgacctacttcaagttcattaattcttttttctgcttgttcaatctactgttgaggcccttcagtgaatttttcatttcaattgtgctttcatcaccagaatttctatttggttattttttatacttcctatttctttattgatagtctctgttttgtaaaatattgtcatcataccttcctttacttctttaatcatggttttctttagttcttcgaacatatttatatggctaatttgaaggttttgcctgttaaatctgacatgtggttgtatgggtcatactttcctgtttctttgcatatctcttaagtttttgttggaaactgggcattttggataatatattgtaacaattgtgggtactacccctccaccagggttctttattattatttgcttgtttactgctttagtaactgcctggattattttattgaagtctatttcctcaacccccattctcaccctgcagtatgaagcctctaatgttgctcttcgggggtacaagcttgtgtatgcccacagtcaccctgggatgacagtgggtttggtgaggctctccttggctgtctctttacttgaccacaccatgctgttatggtctactaattgttgactggttgctcttgttttgtttttgtttttttgagatggagtttcactcttgtcgcccaggctggagtgcagtggcgcgatctcagctcactgcaacctccacctcccgggttcaagcagttctcctgactcagcctcccgagtagctgagattacaggcgcctgccaccattcccagctgctctgttgttttaatcatgtcctggaatataaattgctccacaaactgatccaatcaaattagggctcctttgaagatagttcctgagatctgtgtttgagatttcttctgaccgcaagaggctctttccctgctgtctctttctctggttctctctggcatattaggcagcctaggcttgaacttctgtacactcagttgcaaatgaagtcagtttcattgcaggagaattgaagccccctattctatgccctgcctctctccctgggaaaaatctttgagccacagctctggcgcagtggatggagataaatggtgagcttccctctgagtgtcagccccaggtctcccaggtttgcctcttctggtatagaacccccaccccacaaggtaacgccagagcaatcaaggctctggtattcttggtggcacaacacccaaggcatagcctccatcccatgagttgggggctaggtggaagaagggagcccccacctctcagccacattctcctggaacgtagcctcagcaaaagtagctgggaacgggataagagatgccgacatcctgttcttcccaggaagaaaggagcttggagctggggtagaaggaaccctgtgttcttggctactgtactctggcatgagatctttgctgggagggaagatggaggaagtggttctagatccaaatactgcagactttgactttactttatgaattttagtagattttctcgaataagtacttcatttgctgtatgcccttaaaaccatttccagagactttaaatggttgggttttttttaattgaaataactttcaccaattttgctgggaagagggtcgtccatggagctgctcacactgttatgccagaagtggaactctgtgagctttttaatgtaaaattttgttgctgctattcttaattgctcagagtggccttgtatttggatttctacctcctcagtagattgtaaatagcttgaaggcagtagccctgacctttattcattatggaatcatgatagcccctggtagcatgttgtatgttgtggcacataaaagaatgtcagtcactggctatattgctgtcttttcaagtttacattttcagcacttcgtttgtgacttaaagtgcttaactgtgtcttccttttttcttacactccagtgctagtgtgttcccagaagggtgatgcttcttttttatctgtcattggccatactcagggaagtacacttgaaccgttggaagttttagtccaaagcatttttatttacccttcacaatataggagctttgtttaacattccttgtagtgtatatataattttgactttaggctacttatttgggatatggggacaggaagagagtgagagagggataaagggcaggcagaaaatcagtgtggtcgtgttcttaaaggtggatgtgcctcacttgttctttcttcagccaactatgtctcatgcttttcaaccttggctcttgatggccctgccctcatgactgattttttctttcctgttcgtctcttattggggatcactggctggttatggccccatggctgccccaccctttgttttggtggacagtggccatgtggccacatctgaggctccagttagtgctgtaccactcatttgtggcttgggcttcctcctaaggctaatgtggcctttcttagtctttgacatgctttgtattgaaagatctggtagtactcttctgtcattattctaagtcatttgagaatattcttgacaaaaatcattcagtttgtatgatttgcttgctgctatttctgggatccatgggacagtgttgactgccctctgggatgggtgtgtgtgaactgttttattcagtgtttttctttttcccaggatgctccaggatgaaacgccataggcctgtcagcagcagtgacagttcagacgaaagtgagtagaaccggctggcagctggtaacctttctatctatatcccttgaggatttttcctttcatttgaggataaaccatttcatgcttttttcaatggttgaaaaatgtttctgagaaggaaaattcagggcaccattatcttatttaaatttcattagagatagataaattagaagaattgattgtgtgtggcatataacttttcacttttcatttacctaaataacaaaagccagatctagtaatgctttaacagagcttctctagaaagaagaaaagtacaagagcataaattgtaggccctgattctaattgtagcttaggtactaagtgtttgactgtgagtcaatcatcatttgtaaaaggcagtaaccttattagcaatagcctttggggaagtgctgaaggatacacagattacttgctccacatttgtagtttttccagttgtttttggagatactttttcttcaagtggaatatgaattgtgttattgcagaacattatgaggtgtgattataccaaatcagataatctcatccttagcattgttgaagcttttgcactgtaggagatcatctataaatgtcactaaactccattatgaggcactcttcagtgcagtttgactgttttcttcagtggtatgagctctctggtttctccatcatatttttcatattctcttgggtgacatttagttttatgacatttagttatattagtaggtaatgtgtctcagtatttttttctaattatctttcacaggtccttccacttcctttacttctggctcaatgtataggatcaagtcaaaaattccaaatgaacacaagaaacctgctgaggtgagatcgtattctcaatttttagacttaagctatagtttggatgcttgtcttccaaaacctcatgttgaaattatatcccaatgttggaggtgcaggcctaatgggagatgtttggatcatgggaatatatccctcataaatagattaatgccctcccagagcaggggggtaagtgagtttttcactccgttagttcccttcagagctggttgttacaaagagtctggcacctcctcccattctctcttgcttcgtctctggccatgtgatcacatatgctagctctcctttgccttccaccatgagtagaagcagcctgaggcccttaccagctgcccagtcttgaaccttccagccagcagaaccataagctaaataaacctcttttctttataaatacttagcctcaggtattcctttatagcaatactaaataaactaagacaacttttaaaaatataaatgtctgcctcctaactatataccaacaatacccagaatctgaagatgtgaagaataaagaatgtgtcagtgggtaggcttgttttctgatgaacttatttgttttccaagaaagatttcattttctatctcctttaggagaacaataatcttcacactgtgatttcattttgtgatttcaatcatcttcacactgtgatgacacatagtgcctggctttagaatattcctcccctaaccaggaagtcaaagagagccagactaggggaactgggaaggacctagagatctcctggcctatgattgggaaaagctaagttagcaggtgaggagagatagtacagaaaggtataggtgagtaggttgtagatggactacattaaagatcatatgggtcatggtctgtgaagctgtgatgggtccttacagcctttggatcactgctggcccagaaagagtaggtcaatccttatcaggctggtcatcttttccacaaagggcagcaaagtgccagcgttcctcttggacttgataatggtttagtggatcctacagactttcctctgtgataattaaatgataaaatgactttgtatatcttcacttctactatgagtagacttccttagctgtaaaggaacagagaatatattagttatgtattgctacattacaaattatcacaaaattcgtgtcttaaagcagcacacacttatatctcagtttctgtgggtcagtaatctgggcatgatgtgactagattctttgttcaggatctttcagggctgaaatcactgtggaaaatgggatgtgttctcacctggaggcttgcctagggaagaatttgccaccaagctcatgttgtaggcagaatttgtctccttggagctgaaggactgaggtttctgttttccttcttgcttttggcagagagcactctcagtttctaaaagccacttgtagtttcttgccacatggccttttccatagatcctctcacaacatggtagcgtacttattcagcgccagcaaggagagtctttccctccagtcagctaagatgtagtgttacataacataatataatcatgggagtggcatccccaccacatttgctatataatgtgacctaatcaaaggaatgacatcccatcatgtttgccatattctgttgtttagaagcaagtcacaggtcccactgccttagtagaaagggagtgactctttgtgggttacttttgggtgtgtccaccagagagcatttctctcttccttggaggtcacttttcatttgtttcttttgccagggatttttctgggcacaatagaatgtaagagtttatttatatatgtccatgtcatacagaaagacttagggaatataacacacataaacaggagtggaagaaatttcccacctgtctagaggagactttgactacagaatggtgagaaagaaacctcactacctacccttttaggacgacagctggttctaggacataaggcaattcaagggctttgggttttgaggcctactgcctcccaggcagtggtaatagtagtcttttttgttgcaagggataggggacctgggctgctgaaagcaaattgttttcgtttatatttaatattctgttataaaaaggaaaacctggtgatattgtaggacaaaactagcctttgcattagaagagcttgatcccatgttctgctttgctggcttatttcatctctctgagataatttgtcagcataacatggacattatcatacctatctctcatacctatcatttattgaagttttatgtgccaaaagctttacattaaatagtttgtttcccaaatttaaacaattatgagactctccttggatgcctgtttaaaataatgattccagacttaccccaccctgtgacactactgaattagtatttccaagaaaagtgcctgggatctggattttaaaaagtgactcaggtgatttttataatcaagcacgtcggggaagtaatatactcttgttctattcctccagtaacactataaagtaggtactttccggttttttgtttgtttgttttgcaggtgatgaggctcagagaagttacttgcccagggtcattaaaaaaaagcagaactgacattcaagtttttattcatcctgaatcttgttttattaaccagtatgcattggacatattatgtagggtacaataagtatatagtaaacatttgttgaaactttggcagttaagaaatatgggacagcaccagtgttttctcatgagtagttataatcaaagtttccataatggagtgagagcaaaactcaagattagagagaacaaacctggaattgaacaggggctgggaacccaggcagcaaggagaatatggtaggaacccttggtaaaagaagaaaagtaaaagttaagtgggaattggcaaaggtgacaagcacacactactcacaggtgagtctgaaggcagcctttgaggaatcagatggaaccactgtgaattctttcttcctatttggcccctgaaactgaagcaatattgccattggctgctttttatttatttacttattttgagacggagtctcgctctgtcgctcaggctagagtgcagtggtgcgatctcagctcactgcaacctccgcctcccaggttcaagcgattttcctgcctcagcctcccaagtagctgggagtacaggtgcctgccaccgtgcctgggtaatttttgtgtttttagtagagacagggttttaccatcttggtcaggctgttcttgaactcctgacctcgtgatccacccaccttggcctcccaaagtgctgggattacagacgtgagccactgcgccctgccgccattggctgcttttttcaaagcgtcagtttatgccctatttctgatagcagactatcacttttctctcaatttctgattttcctggccttacttgctgcacctgtttgcttcaaacagttgttttaaggttcacttaagaaatatgacatatttgtatgcttctttatttctgatgttcccatttttcttttttgttcatttgtttctgtttgaagaatttcctttagctgttattttaggataggtctgctggtgataaattcgcttagttttccttcatttgaggatgtcttgatttctccttcattcctgaaggatattttcacttgatatagaattctggtttcacagtacttttctttcagcacttggaaaatgttgtgctacttccttctggcctccatggtttctgatgagaaatctgcccccattcaaataggttgttctcctctaggtagtcatttctttcccagttgtttttgagatttttctttgtctttagtttttaaaagttagattatgatgtacctgggcatggatttcttttggcttatcctcttcgggctttagtcagcttcttgaatctgtagatttatatcttccactaagtttgggaaattttcagccattatttcttcaaatatttttcaactccaccttctttttcccctccttttggggcttcagttgcatgaatggtagatcttttgttattttcccacaggtccctcaggcacttttcttttttttttcagtgtatattctgttgaacagattgaataatttctcttgttcattggttccatcttctgtttgttaattccattcattagttgagcctatcttatgagtttgttatttcagtaattgcattattccatcctaaaatttccatttggttattctttatatatatattccatttcttcactgagactttctgtttttttgtttcaaaagtgtttgtaatttcttgttgaaacatttttatcatggatgttttaaaatccttgtcagataattctaacatctgtggatctcagtgttgatgcctgttgattgtctcttctcgttcccagttcttagtatgatgagtgattttcagttgtatcctggacttttttagtattatgtcattagacactgagtcttatttaaatcttctgttttagtagtcctctgctataaccaggcaagtggggaagaggggtcctgactctctactacctgttgtagaattcctgagctccccatcctagctctttcactctctgggaagcagcactggggagtctctactgcttcatagaggtggaaattcccaccactttgttgcccccactgatgatggagggtatggtggtagtgaaggtaccaccttattgatcagtgatggtgacagcccaggctccctacccagtctgccaacatcacattgaggaggagaggtgcctcattattgctgggagagagtgaacatcaagacctctcatgtggtgtacattgataccccaataatcaccctcttttaaaaaccatttttaacatcttttcttgaaatataattcttgtagcatacaattcacccattttaagtgtataattcagtgggttttagtatgttcagagttgtgtaaccattacaatcataatttagaacattttcatcatctcagaaagaaaccccttacccattagcagttactccccaatctccctacctgcaacccctggcaaccactaatttaccttccttctctatggatttgcctattctagacatttcatataaatggaatcatacaatacgtgccctttgtgtctggcttctttcactgaacatagtgttttcacctctcatgttgtaacatgtattagttccttccttccttctttccttccttccctccctccctccctcactccctccctcccccccccccccccactttctttctttcttttggcagagtttcactcttgttgcccaggctggagtgcaatggcgcaatctcggctcactgcaacctccgcctcctacgttcaagcgattctcctgtctcagcctcctgagtagctgggattacaggcatgcaccaccatgcctggctaattttgtatttttaatagagacggagtttctccatgttggtcaggctggtcttgaactcccgacctcaggtgatccacccacctcagcctcccaaagtgctgggattacaggtgtgagtcactgcacctggccacttcatttctttttatgactgaatgatattacattttatcagtacaccacattttgtttatccgttcatcagttggtggacatttgggttgtttccacttttggagtattatgagtaattctgctatgaacattcaggtacaagtttttatgttgacgtacgttttcagttgtcttgactatacacataggagtggaattgttgggtcatatagtaactctacttaaccatttaactacttaaagaactacgagtctgttttccaaaggggctcatcatttttcagtcacaccagcaatatatgagagtgttagaaatttgttattgctgtaacagagacttcaaattcttctagtgacactgtttttgtctctcctcttggctcaaggtctctttgtgcttgtcctcataggaattttgtttcttgcagctctcccaagctgttagccagtgttattatccctggagtctttagcgtagtagagggtatgggggaggggcagtattcgctaatcttctcattaactctttcttagtctttagggtgcatagtggtcctgtttctgggggtggaagtggtggtagggaaggtagtcttcaggtagagcctttttgccactgccccctgttccctcattggcctgtagcaggtatcttctgatgttctcagcctttgtccttgaggttctctctcctgtagattacctttttgcccgttaggtaacacagggaggctgaggctggatgcttttcccttctcccagcagtaatgaaactacaccattgtcctgacttgatacccttcccctgcagatgaagccttttgtttggtaagggaaccagggcactaagcaccaagtacccagacagcaccactctggtgctttctccaggtaccgccccctgccccggccctgcccccaccccagcttccctgtgtgagcctaattgggttcctgaagaaaaagcttgcaagcgggtgggaccccccccccataactacagcccccaagaacttcatattctcatatcagtccccacgcagcatccagcgattcaaaatttctagtttaatgttcctgctgtggcttctgccacaggtaaccaaatgctctgccctgtgtctccctgcaggcacctgtctctctgaattgggtatttgtgctgtgattcacttctctgatgggttcatgaaaatttgttaatttgctgcctgtcctgccatttgcttcttataaaaacgggaggttgttttgttttgttttttgttttctgactacaggtctgagacaaaaccagaattcttgagccttatgattttactgggaattagtcactgacatgcaatataaattaccccttttgcagaggattaattggctgcattaaaagatacatatttttctttgatatttagtgtatcagtgagattcttgtgcaaatctccctctaatttatcctgtagagaagagtttcctagggatatgtgaatcccctgtatggttcaggggctttgtgtaccttctggaaattgtatacagatttttaagggtatgttctttgttaatttttttttctgagatagtagccttatctgattcttaaaagggcccatactcgtaaagttgttgttgttgtttttaatccctagaaaaagtacatagtaactggctgggtgctgtggctcatgcctataatcccagcactttgggagactattaaaaagtcttccattctttatcaaaagctaggatatttttgactactagtctggtgtgtaaaacatatcaacctatcttaaaacattgactgcatatcatctgtaggcctggagtctcattattatccaagactttcatagcaacagaatgaaagctcatatattttaattcagtggagagcactacatactctctagtaaagcctgtttacatcattgtacctatatttctaacaagcttaattacttggttttctgacctacagcagataaaaagcactgagctacaagtgcatacttattacacaaaaagggacattgagggaagggagaataatttgcaaagcagccttcaaatgttatttcttgtgctgaaattgctcagatctctaaatcagactttgttgctcccccttctccgttatacctctgtttgatatgggggaaagggaataatccaacttaagcaacccaaaggtacattgctttatggtaattgatgttgcagttggtgttagcccatagccatcaaaacgttctgtttattctttataagaaacctgagagttattttaaactatttgaaaaatatttccatgggttttaaagtttcaaatttagaaattacataagctttttgattcattgaaaaaaatcaatgtgggatgcaatgtcttgacaaaacaagaacagagtttttaagggttttaggcacagtgttctttgctaagttttctctgctattgattttctggataacctgacaactttttttgcctaaagattgtataattataattaattccttttgcttaaatataattaccagtttgtagctgttttatgcttttggggtgacatgttagtttgtggtcagttatgtgtagcttcagatttcagtgactgaatcaaaattgatcaatctctctgctttattcacacggaccagacagtgttactctttgtgtcatacaggaagttaatgttttgacttttcctatgaaaaatgtcacacaaatgttcagaggagctgtgctttaaaaaactgccaactgagagatgttaatgagagcaataaaagccagagttgtctgcaaagggcattttcattttgtggctctggcaggttaagcattgatgttctaattgaattcatagtgaggcctcctttgtttctgcaagcatctgacaggccagatgtgcacacagtgttgggcttggcatagcttctggactgtatgttagccagtgaatcccctctttgaccataaatgaacagttatctggtaagtacaaagcctttttgtttcaggaacttttgggaaaactaccagtgcatataaaatagacacactattaagaacttgtaaaacttctcaacttcattacctagaaaggtcagggtcagcatctagatccctccttcattatctttaatttagcaacaaatggctgtgttttattttgtgaagtttctacattaccttgtggcctttggaacgttagttaaagttcttgttggggctcttgcttgggaactgtgtctttgggagccaaaccatgcacattttaactgagctgtgaactcatatctctcttaccccatcaacaattactttgtggactatagagaagaactcagttatatacttgtttctgattttagaaggaatgctatggtgatgataataaaataacaccatctagcatttatttggaaattactgtgagctccatactgtgctaagtcctttatacaagttcacccatttaatctttacaacaacccctatgaggtgagtgttattatccccattttatagataagttgagacgcagaatttggataacttgctgaaagctacagtagtgaaatcagtataccaatccaggtggtctgtcccagacccatattcctttaagattttttttttttttttttgagatggagtcttgctctgtcgcccaggctggagtgcagtggtgtgatctcagctcactgcaagctccgcctcctgggttcatgccattctcctgcctcagtctccctagtagctgggtctacaggcacccgccaccacacccagctaattttttgtatttttagtagagacgtggtttcaccgtgttaaccaggatggtctcgatctcctgacctcgtaatccacccgccttggcctcccaaagtgctgggattacaggtgtgagccaccacgcctggcctaagattttttaattatataaagtatttgcctgcttcagactttaaactgtaaaacaaaatatattgagagatccagctagattcagctcaactattttggtaacttttctataagtctctctcccctccctgttttctcctcactctgcagagttaaccttttttgttacgtttttggtttattcttttattgtttctttatgaaaatatatacaaatatgtatgtatgtgtgtgccacttctgtatataaaattctcctcactaatcgggatttgctatagttattttgttttcagttcaaaaactttaaaaatgccttttcttatcaaaagcgggttaatgagaccagtctggtaaatatgttttatatcactttgcagatatcttctgcctgagtactgaactgacattcccatccactcagcattttatgttctgtctcatgcttgagattgacttccatagcaaaataaggcagcctctcacactctgccttaagtaaaaatgcttctctagaaaacttagatctgatgctctttaatctggctagcttgtaaaattgaaatcaggcttatcatatgcctgtttttctctaaaggggaaggaaaaattataatagtcattggattcagttttcatttgcttaagaaaaacaggtatgaattggttggtggtttcccagacttcaccttcgtggaggtttgagtatttctctcttttttttgaggcagagtctcgctctgtcgcccaggctggagtgcagtgacgcgatctcggctcactgcagcctccgcctcctgggttcaagcaattctcctgcctcagcctcccaagtagctgggactacaggcatgcaccgccacacctggctaatttttgtatttttagtagagacgaggtttcaccatgttggccaggatggtcttgatctcctgacctcgtgatccacccacctcggactcccaaagtgctgggattacaggcgtgagccactgcacccggccaggtttgagtatttctgaagccatagacaaggaccacatttcattggcctctgcttttgtatacctttgtctgtagtcttcaagttactcttctgtttggtaaacatgtatattagtttcctagggctataataaattaacataaacgaggtagcttaaaacagtaggaatttattctttcacagtatgaaggccaaaagtaaaaaatcagccagtctgtgctccctccgtaggttttaagggcgattcattctttgcctcttccagcttttggtggatgtcagcattgattgatttgtggatcaatgaatcactctaatctctgcctccatgatcacactaccttctcctcttccatctcaaatctccctccacctttctcttgtaaggacacttgtcaatggacttagagcccacttggatattccagaatgatatcttcacctgaagattcttaacttaattacatctgcaaagaccctttttccaaataaggtaatatccatagtttctgggaactaggatgtggacatatctttttggaggccaccattcaatccactgcaatatgttttcaggttaggaaactatgtagagcagatttcataagcagttatggcaagtatgaaggtacggcttatgctttgtaattagatcatttggcattattcattattagtcaagcccaaagcatgatcttgtaatcaattgatatattttataaagactatcacttggaaaataatgaaatattttaggatgttgacacatactttccagaactaaggaaggatttcccacagcaccatctttcccaaagatagtagtttagcaaattggaaattgccaccactacttaaccactgcctcattaaagatactctgaggccaggcaccgtgcctcacgcctataatcccagcactttgagaggccaaggcgggcagatcacttgagtttagcagtttgagaccagcctgggcaacctgtcgaaaccctgcctctacaaaaattacaaaaaaaaaaattacaaaaattagctgggcatggtggtatgtgcctgtagtcccagctactcaggaggctgaggtgggaggatcgcttgagcctgggaggcagaggttgcagtgagccaaagtcacgctatcgcactccagcctaggtaacatagtgagaccctgtctcaaaaaaataaaattaaattctggaacagaaagacattagggagaaaaatagtgaaaatttgaatgaattctatacattagttaatagtattatagcattgctactttcctggtttaggtaattgaactctggttatataaactgtaaacaattagaggaaactaagtgaaggatatatggaaactttactatttgataacttttctttaagtctaaaattatttctaaataaattttaaaatgaaatgatgcccaaataattattaactatcagtggatacttgttacttaatttaagaaagttaaggattgttttatacaaactgttttgagtaacctgtattgttggtttaaatttagagaacccaagaaaataattcaggaaggactgcattaccctttattaaatcccaaataagctggcttccttgtcagtacttcaaacctttccaaacagaagttgatctggccatttaggaagttagagatgtttctcttgttggaagcagagtggatggggatggtctttttaaaaggagaacattgaatggtatcagttgcatagtgatggtcttctcaagatatgtgcaatatctttccaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggtatttgcatgcttgcacctttgacttagggaatgaatgctctcatgtttgtctgctgcttggggagaaacttagagtggctaattatgcatttatagtacaaagtcacataccattttcaccaattcactcagaccagtggcagattttaccaggctataataagcaataaagtcaggctcatgtatttagggacatagtatgtgcccattattcataggataaaaccatttgaagtccaatctgaaattatgataaaattttggagacaagaatttccaagtcttgactcaacagtcagtagcatttattagtcttctgagagaaacagaattaattacataatgcctgtcttagtctgtttactgttgttataacaatacctgagtctgttttatttatttatttgtttgtttgtttgtttatttattttgagatggagtcttactctgtcacccaggctggagtgcagtggcaccatcttggctcactgcaacctctgcctcccgggttcaagagattctcctgccttaccctcccaagtagttggaattacaggcgtgcaccaccttgcccagctaatttttttggtatttgttttaatagagacagggtttcatcatgctggccaggccgttcttgaactcctgacttcatgatctgcccaccttggcctcccaaagtgctgggattacaggcctgagccaccgcgcctggccgagtctgtataatttataaagaaatatttggctcacagttctaaagactgggaagtccaagggcatggcagcagcttctgaagggcttttatactgtgttataacatgtgagaaaagaagaaggacaagtgaacatgtgtttaagagatcacaagagtgagccaagctcacttttatgatgacccactcttgtgagaattaattcactcctgcaggaactcattcccacaagaactaactgctgctataacagcattagtcaattcatgagcactccaccctcaatacccaattatctcttaaagaccccacctcccaacaccatcacattgggaattaaggttccaatacacaaacttttggtgacacattcaaactatagaaacacctgtgggaagttttatatatatatatataacatatatatacatatataacatatatatatatatataacatatatatacatatataacatatatatatataaaatagggtcttaaagtaatggtatctataaatagagggtcaaaaacatagagtaatggtacctgtaaatagagggccaaaaacatagagtttgtaaatgcataaacccaaataaaaggggattactgaatgattgagttgactctaagcacatggccttcatttgcattagacctgagaagaaaattgaaataggagagggctttggttttagaaagaggagagaaggacttttctgccagaggaagtaataagtaataagttcagttaaagagtagcgactggttttggaagccattttttctttctggtctttgtgtttccaatactttacacaaaggttggcattaaacaaaatgctgagtaaaagtttgagtgaatgaatgaatgggtagaatgtagagtgccaaataaaggggctagtgggacctactggttactgtgagaaattgcagatcttattgtacacccatcaatttctgttacatattagatttttttaagggcagagataacatccttgaattctctgctcctagtactaggtttttaagacctagtcatgctccagaaatgcttgttggaatcatttctagaaacccaggctgtcctacccacagaggctgtcctacccacagagaggctgcctatgctctgttaaggaaagctccacagccttgctcagcacatgtcccaaaactcactggttcatcatcaacaccatctcctgccccctaaaaatcagagtagcatcatgaatgaacatatgagttgagtgttttcatgtccttgttgtcagtatttttatacaaatatagcagccctggtgctgagttgaccatcaccattccattgatactccgaggattattgagtgtgactagcatcttgactttagtctcgttggtaagtcagtatcaattatctacttattggaggtgattttaatcttttaggttgagtggaaaatgtcccctgtaccactttaaaaatgttatctgataagtgagccatgggtaagtagggtagcaagaatggagcaacagtttaagaacagtaatttattttcatttttttaattttttgagatagggtctcgctctgtcactcaggctggagtgcagtggcatgttgtcagctcactgcaacctccgcctcctgagttcaagtgattctcatgcctcagccacttgaatagctggggttacaggcatgtgccaccatgcctggatatttttgtatttttaatagagacggggtttcaccatgttggccaggctggtctcaaactcctagcctcgagtaatttgtccgccttggcctcccaagtgctagaattaaatgtgtgagcccccgccctcagcctaagaacaacagtaattttagaaactaaaagagtttaacttgttttcaaatatagggatgtgcgttcctaattcatgtgtggcttcagtgctctattatttgttccgagggcttcacatatttaccattataagtgctgtgaattgttggtaaatctcttctgtttcccatagttctttgcctatcatacgaaactcttaattttaatggaacaacaaggcagactattaaattattgatcatattgaattccttaatgaaatccttaactggttgctcttggtaggtatatcagtttctgttttttagaaaatatcaataagacttgtactgtagtatgtagcctttcctatggaacagtaattctcaaattttagggtgcatcagaatcatttggagggcttgttagaacagatttcttaacctcacccctagtttttgattcagtagatctgaggtgtgaggtctgagaatttgcatttctaacaactcctgacatgatactgatgccactagtctggggatgacactttgagaacaattttgttatgaaatatgtttatctcatttcctgaatttaatggaaatctccatacttttatcatcttccttggatttctcttttggctttcaatataagccagccatattggaggctcaacctatttaggatttggttggagtacctaaactttgtttggagtacctaatttcctcaaccacagctgcttatcacagcaacccttaactatcatcattttgcatgggtcaaactatgtcttgtgatttttactttctgaattttgtaagtcaccttaaaaattaaatctttgtgatatgaaattatattggaacattaataaataatttgttttcatgtccttcaacagattttcaaaatcaaatgacttcaattaacatttttaagtactatataaattcaggcctatttagataccccatggtatgaagttactctcagacttgccttttaactaggaactagtcttaaggttttttggcagagctttctatttgccatccatatacccttttcagtgaaatatatctttgtcttttgcctgttttctaatcagattctttgtttttttactattgagtgttgagaattacttataaatttgagatatgaatccattgtcaaatatgtggtttgcaaatattttctcccagtctatttatagattgacttttcgtccagttaagagggtcgttcacaaagtataagtttgtgattttgatgaagttcaatttattgattttttttttcttctggatcatgcttttaatgtcatgctgtgaacttttcacttagctctatgtctcaaaaatattcttctatgttttcttttaagagttttatagttttacatttaaatgcgtgaaccattttgaattaattttgtgtaagatatgaggcatagatcaaagttcaaaatcaggtaagttgattcttcccactttattcatttttcaaaattgctgtggctattccactttctttgtctttccattcaaattttataataagctttccatatgtacaaaaaatcttgctggattttcataaggattatattaaacctttatcacttgggaagaattgacatctgtacaagtcctgtacacattttgctaaatttatgcttaagtgttaaaattttttgagcagttgttaatggtattatatttataatttaggtttccacatggtcattgctagtacatacaaatacaaccaatttttgtgtgttgatgttgtgttttctataaccctgctgaattacttagttctggcagttttatttaaaaaaaaaaaaaaaaaagaggttccttaggattttctgtgtagaccatcatgttacctgcaaataaagatggttttatttcttcctttccaatctgtttactttttatttcttttcttgccttattctagtagctaaaatgtcttgtagtatgtcaaatagcagtggagagagcagacatcattgtcttgttcccaatcttaggcggaaggctttcagtctttcaatatattaagtatgatattaactatagggtttttcatagatattctttgtcaagttgaggaagttcacctctactcctaatgtgtggtagtttttttcataaatgggtattgaattttgtcaactgaaatgatccctatcaaatgatatgatcaggtgattttttttcttcttcagcctgttaatgttatagattacattgattgattttttttaatattgaacaagccttgcattgcttgagcaaacctgagtattagtcagcttgggctgccataacaaaatatcacaggctggatagcttaaacaacagaaatttatttctcaaagttctggagtctgaaagtcctagatcaaggtcttgcagagttcagttttggtgagggctctcttccttgcttgctaccttctcactgtgtgctcacatggcctttcccttatgaccttatttaagcttaattacctcctgtaggccttgtctccaaatacagtcacattgggggttaaattttgggggtgacacaattcagtccataacaccaagttgatcagggattatattatatttttatactgcttgatttgacttgcaaatatcttgttggaaatttttatgtctatgtatttttatgtcttatttttatgttcccgaggaatattgacctgtagtcttatatatataaaaataattatatataattaatgtatatatataaatttatatatttatatagatataaatttatatatatattaattatatattataattaatgtatatgttatatataattaatgtatatataaaaattacaaattataattaaatttgtaatttatatataatttatatataaaataattatatataatttatatatgttttatatataattttggtgacatacaccaaaattataaatttatatatatttataaatttatatatataaatttatttttatatatttatatttttatatataaatttattatatatataaatttataaattatttatatatataaataatgtgagagacagggtctcgctctgttgcccaggctggagtgcagtggcaccacctcaagctcagtacaacttccacctcctaggctcaagtgatcctcctgcctcagcctcctgagtagctgggattacaagtgttcatcgccacgcccagctgatttttgtattttttgtagagacagggtttcaccatgttgcccaggctggtctcaagctcctgacctcaagcagccctccagcattggcctcccaaagtgctgggattacaggcaggagccagtgcacccaacctctcatgatatttatatctgtattgtatcagggtagtactggtcttataaaattagttgggaaatattccttcctcttctagtttttggaagaaatggtatagaactggggttaattcttattaaaatgtttgatggaattctccaatgaaacactccagacctggaggcttctctttggggatttgcttaagtataaatttgagttcttttttttgtttgtttgtttgaggccttgctctgtcacccaggctgcagtgaaatggcacaatcacggctcactgcagcctcaacctcctaagcccaagcaatcttcccacctcagcctcccaagagctgggaccacaggcctgtgccgccatatgcggctaattttttaagaattttttgtagagatgaagtcttcctatgttggccagtctggtctgaaactcctgggctcaagtgatcctcccgcctcagcctaccaaaatgttgggattacgggcgtgagccactgcacatggcaaatttgagtcctttaatagataatttgaatagccctgtaactatttcatgttgagtgactttggttagtttgtagtttaaggtactggtttgtttcatctaagttgttgaatttacatgtatagaatggctcatagtattccctgtgttgctttcattttaaaattcaatcttggctagacttctacttccaaaaagatggagtaggtatgcttttccctatgcctcccactaagtacaattaaaaaccctgagcattttatataatgcaaacataagactttgaaagatcaggagaagaaagcagaacagctagagtccttgagacctgaggaacaacccagttttatgttccctgggatttctttttgttcccagagttggtgctggagaagctagcaacccagaagcacaaaccagcaaaaacaaaaaacaaaaactaagaaaagcctgtcctctctagccaaatgaccaggaaagggaccgcctatcagacaggaaaccttttttttattattttattatttttttgagactgaatctctgtcgcccaggctggagtgcaatggtgccatctctgcttactgcaaccttcgcctccctggttaaaatgattctcctgcctcagcctcccaagtagctgggattgcaggtgcacaccatcacacccagctaatttttgtatttttagtagaggtggggtttcaccacgttggccgggctggtctcaaactcttgacctcaagtgatccacccacttcggcctcccaaagggctgggattacaggtgtcaatcactgtgcctggccaacatggaaaacttttagacagaaaactcttctccagtcaaacaccacagaaaaatactttgggccaccccaaccttctccagcaaagatggagtagggagcttagacagcaatgatgtaccccatttggggttgtgttagaggagactgagtggacagtcaggattttcacctctgttcagcagtgtcagtggaggccatgcaggaaacaatagcaaggcattctcaccaatcccagtgatggaggtatccatggaagcctagtggggggctgaaactctcagccccacccaacagtaacagggatgttgacacaggccaaatggtgaactaggtcttatacaaccacctggtggtaacaaggcaatgcccccaaccctgatctccagccagatagtgtcataggaagccagccaaaatcgaaggtttgcataagatccagagtctcataatgccccaaatgtctaggttttagtaaaaaattactcatcaagaatcaggaaggtctcaacttgaccaaagacagatgccgacatcaagatgccagatattagaatagtttaacgaagattttaaaacagccaacataaaaatgcttcagtgaacaattgtgaacatacttgaaataagttaaaaaaaaatagtatccctctttcattcctattattggcaatttttgtattatctttttttcttgctataggttggtcagttatcttgatcatttcacagaacactcttcttatttttgtttgtttttagagacagggtcttactctgtcactcacgctggagtacagtggcatgatcacagctcactacagcctggaccttttgggctcaagtgatcctcctgcctcagcctcctaagtagctgggactacaggcgcatgccaccacgccaggctaatttttgtagttttttttttttttttttttttagagacaggggtttcgccatgttgcccaggctggtcttgaactcccgggctcaagcaatccgaccacctcggcctcccaaagtgctgggattacaagtgtgagccaatgcgcccagcccattacttttctgtttttaatctcattgattcctggtctttattatttttatccttctgcttactttgggtttattttgcttttttctcgtttctagtgttgagaacttaatttattgatttgaagctgtttctcttatctaatgtaagcatgtagtactataaattttcctctcagcacctgctttaactgtgtctcataaattttgatatgttgaatttcattttcgttctcttaagtatatatttttttaacttctcttgaaatttcttctttcacccatggattatttcaaagtgtgatttttggtttccaggtgtttggaggttttcttgttatctttctgttgctgatttctagttttctttttttttttcttttcttttaagagatgagatctcactatattgtccaggctggtctcgaactcctgggctcaagcaatcctcccaccttgacctcccaaagtgctgggattatgggtgtgagccactgcgcgtggccagtttctagttttgattccactgtgatcagaaaacacactctatataattccagttatttaaatttgttgaggtttattttatggcccaggatatggtctgtcatggtacatgttccatgggtgcttaaaaataagtgtatgctgctcttgttgggtagagtattccataaatgtcaattcgttcaactctgttagttggtggtagtgttgagttcttctgtacccttgttgattttctgtttgttggttctatcaattattgagagaggttgaggtctatagctataatcatggatttgtccatttccactttgagttcagttcatttttgcttcacgttttggagcactgttgtttggtgcacacacatttatgattgctatgtcttcttgatgacacttttatcattatataatattcctcttcatctctggtaattttctttactatgcagtctactttatctgatgttagtatagtcacttttgctttcttttgagtgatgtttgcatcatatgtctttctccattattttactttcaacctacttatatccttatattttaagtatgttttatttagacagcatatatttggatcatatttttaaatctgctgtatcaatctgtcttttaattggtttagaccacttatatttgatgcaattattaatatgttaggacttcagcgtgtccttttattttgtgtgtgtgtgtgtgtgtgtgtgtgtgtgtgtgtgtgtgtgtgtgtgttctctgtttttcatttctctgttttatttttcctaccttccttggaggttccctgaacaaactaccaaactcgatccatgtgaaatagatcatttgaatagccccaaagctattagtaacattgaatttgtaattaaaaacttcccctaaaaatacctccaggcccagatggtttcactgagaattctaccaaacattgaaagaaataacaagtgataacagtagaagagaaatttgaatcaaagatgaatagagttataaaagaaatagctaaccatgggaatatggggatatgctgctgttttagaagctctaggtttacagccaaaaagaacttagtgaaggcaaacttatcaacataaatgaagaaaatggttatggtgaaaagaatgaagatgtcccagaggaagtgatactagtgaaaaagtgcacattaaaggaattcttggaagtattttacaacattgaaggtacaaagaacaaaatgttgaaaactaatccacacttagaagggaatatgacaatttgccaaggggtagaaaaggtgcttgctccatgttgtaagttatgcaatgaaaaggagttaagcattgtaatcttgataagtttttacaaataaataaaagtgtaattctcaatgtttctagtgtttcaaattatattatattaaatacatattggttttattattttttatttcactatatgtttatagtcaatgggaagatagctttttaatgttttgacaaaatttttaaaggtcattaatgacagttttccccattgtttattaagattgcttttcacagttttagcttgcacagtcatttttacagtatcataccaccatgcaaagcaaggactatctgtaatctttagtgacagaaagcagatcattggttttctgggaggagacagggaagcaggaggatacaaggaaacttttgggggtgatggacacattatcttggttgtgatgctagttgtacaaatgtatgtagatgtgtgtgtcaaaactttatacatttaagatatatacagtttattgtatacccaaatcatgtatatgatgaatataatacttttatattcatatatacacatagatacattataagtatatgaacaatcatcacaagtagagatgagtatatgtatagatgggtaagaaaatgtgatagtggggtcgagtgtagtggctcacacctgtaatcccagcactttgggaagccaaggcgggaggattacttgagcccaggagttcaagaccagcttgggcaacatagtgagacctcgtctctacaaaaagtaaaaaaattagctgggcatggtggcatgcgcctgtagtggagctgctcgggaggccgagttggaaggatcgcttgagcctaggaggttgaggctgcagtgagccactgcaggctgcagagagtaccactacactccagcctagataacagagcaagaccctgtctcaaaaagaaatgtgatagtggctacatgaagacacaatcatgggtggttagaaaaggagaaagacaagatgtgactgtaaactacctaagggcagaacccctactgttcagataaaaaggttttcagtaaatatgtgttgtaaggagaataggaaaagaaaacaaagaggaaaatggtggatgttaattaagaaaatttgagaagggccaaaatataagtcagaaaaacaaagatgagaacaggaggaaactaagccttccattttcaccatttgcattcctttcttttttttttttttcttttcatttttgagacaggatcttactctcttgcccaggctggagcatggtggcacaatcacagctcactgcagcctcgacctcccaggttcaagggatcctctcacctcagccttccaagtagctaggactacaggcgcacaccaccgtacctggctaatttttgtatcttttgtagagatgggatctccttgtgttgcccaggctggtctcgaactcccaggctcaagcaattctcccacctcggcctcccaaaataccgggattacaggtgtgaaccactatgcctggcccacttgcctttcttatactaaaataaaaagatttttttggccgggcatctcaaaaaaaaaaaagattttttcactttctcaagtgcttgattgaaagagtttaatgtaagtagacataacattacaactaataagtgatgttttaaatcaaaataggggaatgggaggtagggaaattttactaagttcctcagtcagatcaagttttaagtttgtcacatgacctctgtggttttcataaatgtgcagcttgcttttcttagatttttttaagtgagataattcacctattataaatttttatttttatttatttattttgagacggagtttcgctcttgttgcccaggctggagtgcaatggtgcgatctaggctcaccacaacctccgtctccccagttcaaccgattctcctgcctcagcctcccgagtagctgagattacaggcatgtgccaccacaactggctaattttgtagttttagtagagacagggtttctccatgttggtcaggctggtctcgaactcccgacctcaggtgatccgcctggcttggctgggattacaggcgtgagccaccgcgcccggccatgtaaatttttaaatcaagatagaattcacataccataaaattcacccttttaaattatatggtggtttttagtatattcacagagttatacaatcatcatccctgtgtaattccaaaacgtttttatcaccctagaaagaaatcccacatctgttagcagttactagtcattctccgcttcccccagcccctggcaaccactgtattagtctgctagggctgccataacaaaataccacagactgggtggcttaaagaacaaaaatttggactttttcagacgtttctctttctctctctctccctctctttctctctcaaaaaaaaattattttttcatagttctagagtctagaaatccaagatcaaggtgtcatcagggttgacgtctggtgaggcctctcttcctagtgtgtaaacagccaccttctcactgtgtcctcacatggcctttcttctgtacgtgcacagtttgtgggggtggagctctggggtgtctccttctaaggacaccagccctatcagactaaggccccatccttatgacctctcataacctttattacctacttataggccctgtctccaaataaagtcacatcatgggttaggtcttcaacatgaatttgagaagggcctattgagttcataacaaccactagtctgctttctgttcttatggaactgcccactctggacatttcatataaatggaatcatacaatgtatggcattttgagtctgacttttttcatgtagcataatgttttggaagttcatccgtgttatatgtatcagtattcattacttttatgaccaaataatattctgttatatggatacaccacattttgttaatcctttcagcagttgatggatatttgggttgtttccacatatgggctgttacgaataatggtgctataaacatcctcatacagtttttttttaaattttaatcaggtcctctagaagaaaattcatacaggtttttgagtgcacatatgttttcatttctcttgggtacatacctaggaatagaattattgagtcatatggtaactctatctttaacattttgaggaattgtcaaactattttttatagcatctgcaacattttacattcctgtcagtaatgtgtgaaggttacattttctccacatcctcaccaatacttgttattgtctgtctttttgttatagcctttctagtgggtatgaagtgtatttcactgtgattatgatttgcatttgtctaatggctaatgatgttgaacagcttttctcgatgtccttcttagccatttatatatcttttgaagagaccttttctactttatcacacaaaaaagcctttatgaggtcagaaaacacaagattttatctttgtcttctatgaaatgctgctgttcacacagccagaatgagtcgtcttaagtcccatcacattcatttgagtatgtatgtccttggctgctgaaaatctgaccctttaatgaatagggcagcaaagttccctgaccatcagtgttctagaatgtcccattttttaatactgcatccatgcacacctcctatgttgtctttggagaaattattcagatccttaactcaatttttttaaacgggcagtctttttattgagtcataagagttctttacatattctggatacaagtctcttatcagaaatatgatttgcaaatattttctcccattctattgattctctttttactttcctcatggtgtcctttgaggaacgacagtttttaattttgggccaggtgcagtgactcacacctgtaatcccaacactttgggaggctgaggtgggaggatggcttgaaaccaggatctcaaggccatactaggcaacatagcaagtcctcatctctacaaaaaataaaaaattagctagccatggtggcgcatacctatagtcccagctgttcaagagacttacgtggaaggattgcttgagcccaggagtttaaggctgcagtgacctatgatcacaccactgcactccagcctgggtgacagagtgagaccctgcctcaaaaaaaaaagtttttaattgtgatgaagtccagtttatctgtttttttttttgttgttgttgttgttgcttgtccttttgatgttatatccaagaaatagcaaatattgcctaagccaaggtcaagaagttttatacctatattttcttctaagaattttatagtttggctattacatttaggtctttgatccatttgaattcatttttgtatctggcttgaggtattaggggtccaagttcatttttttttatgtgtggatatctagttgtcacaacaccatttgttgggtagcttcctttttgaaaatgatgaacactgtaccccaaacccacctaccttggttccatgtattccttataagtcaggctgctatgaaagaaagcatagttattgaattagcaagaaatcctagttttatattttgaaatcttagttcttttttcagagacagcgtctcgttctctgttgcccagcctggaatgcagtggcacaatcatagctcactgtaatcttgaactcctgggctcaagcaatcctcctgccttagcctccccaattagttgggactacaggcacatgccactgtacccagttattttttattatttttttagagatgggatctcgctatgttgcccaggctggtctcaaactcctggcctcaagcagttatcccatcttggcttcccaaagtgctaagattacaaacatgagccactgcacccagccagttttatttttttaatctcctgtttcacagatctaccaaagtgacttaaaatttttttatctagtttgagatgctaatttctgtactttatgcttcactctgtccaaatataagggaactttttaaaagttaatggaataatggaattaagtgatgaaaattaaaaatataaacttcatttctcaacgtaagctccatcaaggtcaagacacttttgtaagcaatgataccagccatttagttcttccctagagaactgagcgtcctgggaatttaaccatgtcagtgcagtcttttttgcattattaactgaaggaaaatgggtacccttaaagattttttaatattaggacacaaaaagaagtcagaaggaggcaaaacaggaccgtaaggtggatgcttaatgatttcccattgaaactctcacaaaattactcttgtttgatgagaagaatgaactggagcattgttgtgatagcaaaagacgttctggtaaagctttcttgagcagttttctgtaaagctttggctaactctctcaaaacactcataataagcagatgttatcattctttggccctccaaaaagtcaacaagcaaaatgccttgaacatccccaaaaactgttgccatgacctttactcttgactgacccacttttgctttgactgggccactgccgcctcttggtagccattgttttgaatgtgctttgtcttcaggattgtactcataaagccatgtttcatctcctattataattcttcaaagaaatgcttcaggatcttgatcccacttgtttaaaatttccattgaaagctctgcacttgtctgtagctgatctggctgtaaccagtttcagcacccattgagtgaaaggtttgcttaactttaatttttcagtcagaattgtgactgaagaactgtgactgtatgctgaaccagttgagatgtctgtggtgttggctgttgtttgtgctgttaatcatcagtcctctttaattagggcatgaacaagatgaattttttccttgcaaattgatgagatgtaaaaatgatgtgaatgtgggctttatcttcaactttgtctcttcccttcttaaaacaagctatccatttgtaaactgctgatttctttggggcattgtccccatgaactttttgtaaaacagcgatttctcctttcttctacccagatttcaccataaatttgatgtttgttcttgcttcagttttagccaaattcctattgctctaataggggcccttttcaaactgatgtcttatccttcttagtgcctgtaaaagttagtatgaatttatttttgtgtaaatttttgaaatctacatatagttttttattttccatgaactttttgaagacctcttatatgttactgttttcccaccctacatgacaaaacagcattatgttaatttttattggttaattttataacttttgtgttagttttccttttgtgtattttaaacagtttttgaaattaaaaatagctttattctcaaaaaccataaataaaaatgttctcttccaatgtaattgccaagtttaaataaatgtaagtgttctataacaaacccttgcaataattatttttagatttaaaactcttatcttcagtgattatgtattactatgttaataattgttgaattgtaaaaattatctccaccttccaaattttaaaaattgtaagtcagagtgcattgaaagcatgatgacattccttaattctgcactgaaggtttttaataaagaatgttatagcaattcacaataacatgtggaaagtatcagaatgtaaaaacaaaaaattatgaatatattattttgggcttgctacttcatattagttttggtaaaattaaaacccaattggttagtttctgctgatggaaatctcacttctatggagaaaatattacaaaatgtaaatctgttagagaaatttaagaatgaatctggccgggtgtggtggctcacgcctgtaatcccagcactttgggaggccaaggtgagtggatcgcttgagatcaggagttcgagaccagcctggccaacatggtaaaaccccatctctaccaaaaatacaaaaaaattagctgggtgtggtggcttatgcctgtaatcccagctactcgggaggctgaggcatgagaatcgcttgaacctgggaaacagaggttgcagtgagccaagattgtgccactgcactccaccctgagtgacagagcaagactgtctcaaaaaaaaaaaaaaggaattgatctaatgtaatacaatagtaaattaagttaaaatgtacttgaaaatatttggaaataattattatgtattgggatacgccatttgttatagcaaacatcctcaaaagtctcagcatctttttttttttttttttttttgagacaggatctctgtcacttgggctggagtgcagtggcatgatcatagctcactgcagcctcgatctcccaggctcaagagatcctcctatctcagcctcctgagtagctgggactacagacgtgagccactgcacccaaccagtctcagcatcttaatacaatgaagtctttatttttcgcacatgtctccatccaatgtgggtttgaatgtggatcccctctgccccacacagttatttagggacacaagctctttttatgaatggcgcttttatttactacccattctcttttctactctctaacttctcaatccagtcagcatgaaaagagtggagggttatacagttggggtttttttctggtgggggcagcgggggtaggctttgaagtgacttacctacctacatatcattagccagaactcactcctgtggcccacctaacagcaaagggggctggagaacgcagtcttgctatgtgtgcaggtggaaatggaaatagggtttggtgaacacctcgcacttctctgctgctctttgatagtggcattacaaagtcaaagctatgagatcacaggaaccttattggttttattcaccactgtaaccctgtagttgatgctatggtctacactgcacagatttccatatagtcttaggatctttccacctagtgtctcagcaggatagtctgacttcttacagacagttcaggactccaagagtgaatgttttaagaggtaagaagtggaaggtgctcatttcaaagcctaggctcagaaactgacacagtattacttgcactatattttattagagcagttgcagagggcttccaaattgaaggaaaggaaaataggccccatttctcaataaaaggcatatcaaaggatttgtggccgtctttgatctaccacgtcataatatttttaatgtttgtctttttttttttttttaagagacagatcttgctatgttgctcaggctagattcaaactcctgggctcaagctatcctcccgcctcagcctcgtgatgagctggaactacaggcacaagctaccatgcctgtcttgagttacttgttttgttgcctatagacagattagtcagctagagaaactttactaataagactaaagtacactcttgctttttatttattaactaatttataaggttatcaaaatgctttagcatcttatttcctaatggacttagagcagtaattttggatatatgtataaattaattgacatgatccttgggtgctagaattactctactcgagctatagtaactgaaaatggatgagggagaaataagaatagatagagcacatcctttcagaatctttgttctggctttcagatgaggttttcccatctgtttcactgtcctttctgcagtttccctgttagttcagtatagtgtatatatgtggtgattgaggggaggggtacagagattacagagccatcttgcactgtaagttatagctgcttaggtaagtactgatgaccaaaagaaatttttcgacagtgagttcaacaaataaagatggtgttaaccctatttacatgtctctaggtagactgaaggattttgagtcattaacagtgagcttcagatatttctttttgggtattcatttatatattttaatcagtttctattgcagtaagattccaatagaaggaaaacaatgcttcattttttgttgaaagcaaacatacattataagttgtataatacacaatgattaatgaagttttactgtgtgtgtgtgcatgtgtgtatgtttttaaaattacggatgaactatcatacaaataaaaacaatcagaatacaaaaaaattaactgtgtagtgtatgcttatacacatgcatatatgtatatataaatgggattgttctataacttgcttttttcacttaatatatacttctgcatcgttaataaaactgaaagaggaaatgattggatatagataggtccctatttccccttgcaatgtaaactctggacttactgggctatggagatcagtgctttctttactaaactctagactcaaatatacaactgtcaattcaacagttccacttggatgtccagtagacatctcagactaaaaatgtcccaaactgaactactgatcttcccaaaccagttctatttgtagttctctagctttagctgatagaaaaatctatccttctagctgtaactctgtcttttcagtttaagccaaaattcttagtcatctttgattcttcattgtcttatatcccatattcaatataacaggatatcccattaactctactttcaaaatatatccatatttcatatagtaaaagaacaacccctaatgataaatggaaacacatgcctgcctcccactccactgctgtatttggtcatctaggcccctcccatctccccttactctcctcaccccatctccttcttcccacacctccttcttcccacacctcctttttcatcccattttaggcagcagcattctatcacttttactttcaattatgagaattcagtaaggagcacaatgtacagagcactttcttttttttttttgagatggagtctcgctctgtcacccaggctggagtgcagtggcgcgatctgggctcactgcaagctccgcctcccgggttcatgccattctcctgcctcagcctcccgagtagctgggactacaggcacctgccaccacgcccagctaattttttgtattttttagtagagacggggtttcactgtgttagccaggatggtctcgatctcctgacctcgtgatccacccgcctcggcctcccaaagtgctgggattacaggtgtgagccgccgcgcccggcccagagcactttcctacacatttatcttatttaaaatttaaaacagtccttttgcagttttccagttactattgctgatgataatttgcccccaaacttagcagcttagagcagctgtgttatacccattgattctgtgggtcaggaaatcagatagggcacagtggagatggcttccctctgctccatgatgtgtctagggcctcatcaaggaagacaaagtttgagagtgacccaacagctgggcactggaatcaactgaaggcttattcactgcgtgtctgtgtaacagcccatccctgggcttggataacatagactacacatggcctttccattagtttggcttcctcatagcctaacaacctcagcatagtcagatttcttacaggagtcaggcacagggctccaagtgcatgcgttcctgcaaaccaggagggagctacattccattttatgacccagccttgcagttctcatggcatcacttctattgatcaaaaaccatcacaagccctcccctatttaaggggaagggagatagacttcactacttgatgaagatgacaaagtcacattgcagaagaatgtgggatttggaaaataccatctgtcgcaggggttatcattgtcctttgttttgagtcatggagacttggagagaagtgattatcccagagtggtaggatgaacaagggtcatcttgggaaatgattcctagagttgttattacagtaactactatctagttagttttatttgtgtgtttagagatagggtcgcactctgtcacccaggctggagtgcagtggtgtaatcatagctctctacagcctcaaattcctgggctcaagtgatcttcctgcctcagcctcctgagtagctgggactataggaacataccaccacacccaactctatctagttcatttttaaggcatttatttcaaacctttacaaaacctatgaggttttggttttatgcagtttctgcagtgttcacaaatgattctaatccacttattaggaaatgtagcatagtctgtacctgccaaatatttagatcaactgaagagacactgaggggtctctgtacataagacactggaggaggccatagatcaggttagagtgactgcagttacctttttattgcctccttagttggcacagcagtatccacaaaggccagaggtagtagtgttccagccactggtctcccctggagagcagatgtgattgtgggtcctttcaccaaaggctagtcatctggaaagttattacaacattcatttacatgcaagcatccaaattgaaagttgaggttacctcatcctaacaaaattgctcatgcttctgggcttgcgagcttttgctgatttggtcaatggtctagtgaccatttaaagagtatcaggccgggcgcggtggctcacgcctgtaatcccaccactttgggaggctgaggcaggtggatcacctgaggtcaggagtttgagaccagcctggccaacatggtgaaaccccatctctgctaaaaatacaaaaattagcctggcatggtggcatgcacctgtaatcccagctacttgggaggctgaggcaggagaatcatttcaacctggtaggcagaggttacagtaagctgtgatcatgccactgcactctagcctgggcaacagagtgagacttggtctcaaaaaaaaaaaaaaagtgtgtctatccatagtacatagccaagaaagaaaatcacccatccagggaggataatcctgggatttcctccagctttagccatgttatatatactcgaagatattgaagctgcatttaaaaaatcccaaacatattttttttcactaattctcacagcccttccccctctatcattataagtacaataatttctccttgtgagtttatattaacttcatcttttacccatgtattttcttgtagttggtgttactgttttagtatataatttattgtcatggtcttggtccttagatgcagacctttagttcaagatacacgaggaaagatgagtgagatgacattgctgtcattatcattattgtaaattttgcatcgaagtataatatccacacagaaaagtacacaaagctgtacagctgaatgaattttcacaaattaaatgcactcatttatctgccacccagatggggaaataaaacatggctgggcacggtggctcatgcctgtaataccagcactttgcaaggccaagatgggagtatcacttgagcccaggagttcaagactagcctgggcaacacagtgagaccccatctctacaaaagattttaaaactagccatcgtggtggtgtgtacctgtagtttcagctacttaggaggctgaggtggcaggatcacttgagcccaggaggttgaggctgcaggagctttggtcatgccactgagaactacctaaaaaaaaaaaagaaaatattaccaacacccaagaacccctccttcttctccctgccagtaactgacctccctcacccaaggtatcagttttgccagtttttgagcttcctatgaatagactcctacagtgtagtcatttgagactgaattgttttgctcatcagtaggattttgccatccatccatcctgttgcatgtagtaattcattaattttcacttctgtgtcatgcattgtgtgaatatgccacattttttattctgctcttgatatatatttgggttgtttccagtttttacctaccataaaaatgctgatatgagcctttttatttatcatttggcatgcatctgtgtacacttttgctaagtatatacctagtgtgggtttgctaggtcatgggtatgtgtacgttcagctataatatctgctgccaaagtggttgttcaaattcacactcccaccagcagcataagagataatctatttgctccatttccttaccaacatttagtattttcaatttttggacagtctttttaagtttaattattctggtagataatagtgattgtaatttcagtttgcatttccgtgataactaatgaggttgagaaccttttaaaagtttatttgccatctggatagccttacttgtgaagtatctctttaagtttttttgcccagcttttaattgggttgtctttttctaattaatttgtaagagtttattatatattgtagatgtaagtcctttgttgtctatgtgcaattgcaaatatcttctcctgtcccatggattgcctttttattctcttaattgtctcttttgataaccagaagttctagtttcatttttcagtctcttcctttatggttaatggcttttgtgtcttatttaaaatatctttgcctgccccaaggtcataaatatattctcctctgttttcttccagaagcttaatgagcatattggtatagaaaaacatttatagcctaccttgttccatgtagaatttgaggcgattgagatgaatagttagcaaaacggtcttccttttagaagaagataactcttgacaaaaaattgggtattctcccttctaggccatgcactaaagaaacatgacatatttaatctcatagtctctaaagaattcatatgtctgtcctaccctttttagttgggtatgtttcagttggaagcaggcctctaacagcaattcccaaaattttagtttcaattagtatttgaggtttctgcatttttcctcaaatatttgttccctttggctttaaaaactccatatagtagaaaaattaaaatgtgcaaatgtgtgtcgttgttattagctttattcaggttcattatttggaatcaggcttttggaagaatgcttattaggaggcagtattctctacatttatagggtggactatgcctgtatatattttatgtttattcattggaatatgtttgtgtttgtaaatccttccatatatgtgatgactctagagtaaagaaactggctctagaagccttccggagaaatgattttcattattttatgatgacatacgtgtgtttatttctttttttagatggaccaccttgttctttaaaattgccacagaataataatccagatttttctcttggttaaattttctgaggcctcatacagtatttaaaccaccaataataacttgttggcatgaaaaaaatttatttttttctctggtttccttgccttgagcccttggatgtcaggaagggtgaggggaaatatcagtctgcttgggcttagatttatggttgctattgtttatggttgggaaatggattgagtgtgcatagctccatggcctcttggctttaactcatttgcataaatagtgaaaataataaggaatataaaaacaataacaatgacgttattgagcatctatttttactgtacactaagccaaacactttctgtttttttctatataattgttataatagtcctacaaatttggcattttttcccttcaacttttaagttcaggggtacatgtgcaggatgtataggtttgttacataaataaacgtgtgccatggtcgtttgctgcacaaatcatcccatcaccaagctgttaagcctagcatgcattagctattcttcctgatgctctccctcccctcactgacaggcagcagtgtgtgttgttccccctaccatgtgttcatgtgttttcatcattcagctcccacttataagtgagaacatgcaggttttggttttctgttcctgcgttagtttgctgaggataatggcttccaactccatccatgtccctgcaaaggacatgatctcatttttttttggctgcctagtattccatggtgaatatgtaccacattttctttatccagtctatcattgatgggcatttaggttaattccatgtctttgctagatattatttttatcatatttaatgattgttatccttacattttagctaagaaaactgaaccttatataaagtaagtggccaggcacagtggctcacgcctgtaatcccagcgctttgggaggccaaggtgggcggatcatgaggtcaggagttcgagaccagcctggccaacatggtgaaaccccttctctactaaaaatacaaaaaattagctgggcgtggtggcacttgcctgtaatcccagctactgggaggctgaggcaggagaatcacttgaacccgggaggcggaggttgcagtgagccgagaccatgccactgcactctaccctgggcaacagagcaagactccatctcaaaataaatgaataaacaaacaaacaaataaagtaatagcctgagatcaccatgtaagtgagtgacagaaaaaaacaagcctctgtgagactaaagcttgttttctttaccaccatccagtattgtctccgtgacagaaaattattaatttggctgaaatatatctttggtatgggatctggctgtgcctttgtgcagatatcgccccctcccaggttggtttcctcttctaaataaacttggtggccattgtaccaagaacacactaatgtgacgacattttattagaatgaatgggccagtcgtggtggctcacgccagtaatcccaacactttaggaggccaagttagaaggattgcttaaggccaggaattcaagaccagcctggacaacatagtgagaccccatctcttacccaaaaaaaaatttttcaaacgttagccaggcatggtggcatgtgcctgtagtctcagctacttgagaagctgaggcaggaggatcactggagcccaggagttcaaggctatggtaagctatgaccttgccactgcattccagcctgggtggttgagcaagagcttgtctctaaaaatttttttaaaaattagaatgttgggaaccaggatccatgagggtgaataaagaatattgtaagcagtcagtgagttaacagcacatgacaaaactaaatttgtaaaaccatttgctttctagaaaggaatctgccatacctcccagagggcatttagccatccattcagtgcctgaaatctgtcatttgttgattgttatcattgtctttctgttgcttttctaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggtaagttcttttctcacaagtaagttgtgacttaattcatgttttttttttaagttatcagaaccctttagcttgtttttatttttgttgcctcctttcttttctggccttttcatttatttttctcattgattttatcttatttcagtgagatatttcttcaaatgcatacatagaaataaagcaataatatttaaatatgaccttttctttcctcattcatagttaatggcacagatcaaggatagcatataggtctcatgaagttgtttcccaattcaggaagtttgagaatggccatagctgattggccatagctgattggacttctggttgagaattctgaggcaggttcctggcctgaaaagcagtgtgatcagtgagcagggccagaggtagaggcccctctggcaggggcttggagagaatctccaacttcagtattgagcagcaccactgcaactgacagattgctgtgacagtaccccttaatgcaggacttgctacctggaagaaaagttgcaggcctagagcaaaacattcacaaagcagttcttagctacttccacggagttctagagttgtcatacaatattcaaaagataaaatgaaacaaaaacaagcaaataaatttatgtttacatatggaagtaaacataattaataattttaaagtaaatgtgtgccatacaataccataccaacaatactgagaaatgctaggctgaaagataactcattttatacttacacacagttcttgttcatctgttttcagtctaagcagtgttcacgtccaagttttcctgtagatctgtgggtagtttttaagactccgtataagatatggtgaaggatacatttgatctcatttttgtttgaatcacattttatttcatttttgtttgaatcacatttgttcattgttagtataaggatcagtggtttttcttttcttcccgccctccctttttcctttctttcttttgaggctagtatctgaatgcacatgaataaaaaactgaaattatattaaagcagtttggcatgggaatgatagttactctgccagtaaccaatccttattccttgatttttaaagctttttgttttatgtcttttcttgctctgccccctaagaggagaggggagtggtaaatttagggtggcaaccacaaagagaagggaatgaaagactgacagagaagtaaaatcagaatatgaggacataatcaaatggattcatggctcaatgtgcgcttgtgttcataatgcatataatatccatagctatcacaatcattgcaaggctgcctttggcatgaaactaccttattatgaggttcctttggtattttgtaattaattctccttgggtgagttttttaaataaactttttattttggaatagtttgatttacagaaaagttgcagttagtacagggagttctcatatacacctcacagtttcagttcccctaatgttaacatcttactttaccatggtacatatgtcaaaactacaaaaccaatactggtacattactgttaacttcagactttattgggatttcaaggtttttttttccacttacaacctttttctgttccaggatcccatcaagtataccacattgcatttaggcttgtaagaattttaaaagaggattgcagtatctcaagcttttctttagggtgaatgatattgcagtgaggtgtctaagagcttaaagtaaactttttaaaaacaatattaagcgtattatgaattaagaactttttaagttgagtgctgactacatattaagcaccatactaagcaatgtaccaatattacttcatctcagcttcacaacaaatcagtgggtttcttattattatactaatttcatagataagaacactaagccctaaagaggataaataacgtgtcaaagtttacatagctaatatgaggtaaggttggaattttaatccaagttttcttgtaaccagacactatattcctttactccaaaaaaaaaatgtgtaacttgtcttggctggaaaaatgaaacataaggcctgggcagtttttggtttcataagtagccacaccttaaaatggtagtttatgtggaattctaaagtttcttaggacatcttatattacaaatgaagtggaatacttgggtacatttgttttggatcatcttgaggattattccggagtttacaagttgttagaataaatacataagtgctgtcacaaaatttgattaataagtgtggaaggctaagataaagttatagctgagaaaaggaatcaggaagcaaagaaggtaattccagaattgaagttagacctttgtgaatattaacaggtttatatgttgttatagtttgccattgaaaaatattattagattttttaaaagtcatatttgaaaaacaaaatattttatatgtgtaatcacctacacatgggacctagaattttcttttatgggcttcatacatttttatatgaaaatttccttgtataatcattagatatgctcattgaagctaacttgctaagaatgaattattatatccaaatagttatgtgattttaattactatgctacaaattatcgtgtccagaattataaagcttggtgaaagtcctcctacagtgagaataagagaaaatatagagatttaagaggagactggcaaggatttggacaagaaatcgaaagggtcagtaatatatcttctaaggaacatggtgaaatatacatctcctttcatgtgtcaaacactaatatatgattataggtaaatgttagagtagcactagcaaaagattttttgaaatctggttgttttagagcaggaaagagatgtttttatcctttagaatcctacccactcctgcactgggctcacagtaggtgttttgggaatgacagctgactgatgggttgattgattgtttgtatttctgtgcaggttgtgggccagttgatgagaatcttatggaaaagacagtagaagtcctggaacgccattgccatgaaaatatgaaccatgctat

SEQ ID NO: 5666 - DNA, 115667 bp, human; identical to SEQ ID NO: 5665

SEQ ID NO: 5667 - DNA, 115667 bp, human; identical to SEQ ID NO: 5665

SEQ ID NO: 5668 - DNA, 148905 bp, human
gaagaacgcgcggcgggcagacggctgggagccgctccggtagggcgagcgcggccggcggtgggtgggaggagaggttgggggaggaaggaaagggaagaggcggagcgtgggagcgcacagtgtcaggaatacaatagtgctccgcgccgcctcagccgccgccgccgcccaaccgcctgcccagcgctgaggcctgacgggccgggcggacgagggccgagggcgggagctgaggcgcggggggcggccccggcggggggcgggggcgaggaggggattaaggggcaggtgcgagggagggaagagaagaaagcgagcggttaggggggcggttaccactccgaccggactcacccggcacattgccgggccgcggcgtggagccgggcaggagccgcgagccagctgcgcgaaggtaggcgccgcggaggccggacccggcgcgggcgaggttgggggcgtcgcaccggctgggcggcgggagcggcggcctccgggagtggaagcgggcggcgcggagcgcacagtcccggcccggcctcgccgcgctccgggtcgctccggttccacatcgtggtcgcctccggcgtccccggcgccttggggccgagagcgtgtgtgggctgaggtaaagtgcctggtggcccctctgcccgcccgggtagtgcctggtggcccgggcggggggcgggggcggacgcgcgagctcggctgcagctcccggctacaccgggcaggaattgagcgccataactgttgcggctctttcctccggtgccccctcctggcgccccctcctccgttcctgccctttgcctggcttcggggctgacggggccagacccgtggcgggaggacctgctctgtcggccgccaggggtcggatgctccagggagcgagggcgcgccctggctgtttagctgttggggggcggaaagaaccgagtgcctggagaggggagaacgggtggtgctgggtgcggcgaggcaccccgggaagcccgggtgcccacccggcgggagcgggagcgcgggcgcccggcgggctggcgaactttccctcccactggcggcattgttcgaactgcgggtccgtggccgccgagcgtcgggcggtccgggggtgggaaaatcgtgagggctttgctagtcttccggggaaattttcccaccgctgggcacggcaaagttaacttttctccagctttcgagttcgttttattccctccgccccgggggccgtagtttgtttttttgttttgttttgttttgttttttgtttgtttgttgttttttttaatagccttcaatctttttctcccgcttttcacagcagagccagtgcttcggtggagtctagctttaaattgcacagggcagcctgagtttgttatttgtgaggagggggtggcgggatctggagtgagtgaccacaatggtggtatgtggaggcatgtttcaaagtttttatcgctgtgcggccctgggacatatgtggctactagggatttggcaagaaacttgtttggccgcttctccgactttgagttgcaaggaaatccgtggcctcagatgtgcgcgagttgtttgtgtgtgtgtgccgtgaggtgcgtttatctatgaagctgaggatgagattcccccctcccgccgtctgattgtgtaagaagtcaaaaccgtgttgaaggtgattccagtggtggcctggagggaaaggcgacctcattccctgtgttcagtctgataaagtgaactgctgctctctaaacttgggaagtaatgaaaaataatttaggtaaaaactggttgcacaacgtctttgcttagtttaagcaacccacaatccactttcccagaccagttctcctgttaaatactttccctttagccacttcttgtcagcctaggctgggagggggaaagagtagggctgagagaggagtcggtctgaacaaagcattgtgtttttatttagtttaatacttccaaaacatctgtagacaatgggagtatgggtcccggccttcgtaccctttgagtagtgtggttctcatgcttttgtagcatcatgtgattactcttcggatacgtaaaaatagattttttttcttttttgtttaacctaagagtattctacctccataacatatcattttctctttcgtttaaagtgagctctgagcttaaatacttgaactgtaaaaggataataccctctcttcaaggattacctgagaccgttgagaagtgtttcagtgcccagcgtgtattcaactttcaatcgatgttagccaccatctttgccaccttttctccagttgtgctcttctttatgcttttgtttgctagagaatagcttttaacccaatattgttgccttgctttctgtccagtcaattctggaatactcaggggtgcaagtctggctctagaattcacactttctctctcccctcttctctgagtcatgttgcttgccctcggcaatgcgatgtgaatctggtcataggtagaaaaaagtagagaaaggcttcccactcctccctgaagtgttgtgacccaccttcaggcccgtaggggagattcccaggagcaggacaggtgatggtgcagggctggcatcatagctaagaagtatggattggtgaaagttaaagaagaaagggtgttgaagacttgtaggtttagtattgtcctctcctttaataatgcttgtcttttccctctcttgtgttccaccaaccataacaacccattttttcccctaacctacacaaagccatatcttctttctgcccactgctttgaggtctggctggaactaggcaagtattttggaagaggtgggggaggtaggaggcatcaggtgctggtaaagacatggcattagggagggctcttacaagccttgatcagagttacagagagccagtccaaaaatgaagctgagcattatcaggggacataatgcacctacctccttgtggagcttacacaaaataggagctgagaagacagaggtaatatgctgtcttacattaagaaaatctctcattgaggtatgatttactatgatcttgacttgtcccacaatataggtgagaagtgagtgttaggtgacacctgtctggcactctcctaacatggggacactttaatggctcacaagtttctgttgttccagttacagtggctgggaaagctgaaacattctggtttgtatggtggggaggatctagggtgaatgggtaaaagtgatgaacaaataaacgggtactagcaagtaagtggtcattacaaaccaaataactaccactttgagttttctgatttctggaatctttatgactccctcatggttatttttgccttgttcctgtaggtctttccatagataataacaacaaaattcttaccattagaactgcctctgtgcttttcttgggagaaagtaaaaaaaaaaaaagggtcctgggaaaaacttgcccgatttcatagctaggcttgtgaaaaggaaggtgataagtcagaagacagccgactgaataaaggacctggtgtgaggaaatagtactggggctttgaccaataggaaacacctatgagttcatcaatgcttttcaagcagcaaataatttaatctttgccaaaacccaggaactatggctgtgccctgctacccaaggagctccttttcccttggtattggctgatgggcaaggaaacccaagcctagaatgtgtttttttgttttgttttgttttgttttgttttgagacacatgacaagaatatatgataccagcatggccaatacactagactttgtgtgttggaatcttctgggacacattcttttttaaattttaaaaacttattttgataattacaaactgttataagaatagtacaaagaactcactatattcccaattagtaacggtttgctctcatttgctttatcacttgctcttttagttctctttccaaaccatttgttagtaatcactgaaatttattatttgttgtttctttcaagccatttgttagtaatcactgagagattggtacttatcaagggcatcctgtcctgaacagtggctcagttgcagccactgggtatagcagaacagtggtggtgaggcagggtccagaggtagagcaaagtctacctacagctgtgaagcacacagtttgtaaaccgtgtagaatctctagggctagatatagaaatcattatcgattgtaaaagtggttaagataaactccacttttctcaccattcttgtcaagtttgttcttaactatgccaaactttaatactgttaatgaaaattcactccactccccaactttgcaacaataatatattctccaagattttcatttaattcattcagcaaacatgtattaaataccttctgtttgctaggggtataagaggtgaaagatacccccttaacagctcaacttccagtggaaaggaattaagtcatcttctcacagtcaggaggaagagtgctctgctgaaggggttcacagggagtgatgggagcaccatcctggttaaggatctgagaagtagatctctgggagtcatttgggatgggtgtaactatgaagatctgtcttctctgaggcctgctcttagatgacaaggttcatgagttagagaagcctttggtgtcatatacccagcacaggctgtgaggtcaggccaacttggattcaaatcctaactctaccacttgctcttggccagttatttaacttctctgtgcctcaatttctttgtcaaaccatatctctgagggtggtagtgagaattgatcaatgctctgtaaacattcatttcatcttactctacaaaaatgcaatgtatggggaaattgcctgaaaagtaataggtattaaggtgggatccaagctggtgggggcgggtgggggtggctcggtgtgtttctattttttcaacaaataaatatctaattgcactaagagctatgatggacattaccatataggataataacaataacagcagcaatgatttcttaaacatttcctgtgtcccgagtactgtgctaagtgcttaactaacagaggatctctctctctgaggtgtgagactcagaaaggtgaagcaaaggtaacttgcccaaggtcacgcagcaagtataaggtagaatgtccctgtgagggagaccagcatggtgccctgagccttgagaatgagcaggaataagcaaggtaagggttagagagaagggattgccaggcaggggtagcagcaggtgttgtgagggcactgaggtggaagagagatgtggaaaggatccacagaggtttggctaggacttggggtaagagagatgaggtgggcagggaaagattgacagggccttacgggacctcattaaagagcttgtgttttattccaagtacaatgagaggtgtttctttctctctctctctctctctctaatgggaggtctgtctctctctctctctctctctcactctctctcatcctctctctctctctctctctcatcctctctctctctctctctctctctctcatcctctctctctctcatcctctctcatcctctctcatccagggaagcatatagtgaggcctaaacaaaaatggtttaagaaagtcatttccccttcagtgtcccaccttgcaatccaatagaggcaatgtctctggaccaaatgtgtaggtcttaaacagtttttatcgactgccattaacatggctaaaaagagtttctatgatgctggaagaagctggtccttcagaatgcttctagaaggaggtttaattaggctcatatagctgatgctttttaggctgcattaagggagctctttcagctctcactgatccctgtcacatggggaaaaagtagaattgagagaaaacataattcctggaaacctgagttgttgttcagtgttagaaatggaactatcgagtataagactttggtttaaatatatcatgataaagatacttcagtgactaaatggaaatttttttatgttttttgttttttgcatgtgtgtgccatctgtgatggcagacagcacatttgttagaatctgggaagacttaagtattttttcaatacttatatatttatatttattctcatccaggtactagaagtttttctgtttgaaactatttcttatctacagagtaaacttcacaggaggaaaaccagtgttctgttccccttcccataagtactaggccacaaacatatttacttttaagtagcctgtgtcaattagctttttgggggagggtggttagctggtggctagatgatctgggatagccttactcacacatctggtggttggcaggctggttggtctaggaggccctaagccgggatggttcatctccattctatgtggtctgccctccagctggctagtctggacttactaacatggtggtcttgaagtcacagagtagcaagtgagagcaagcaccagtgcacaagcacttttcaaatgtttgctgtgtcacatttgctattgtcccataagctaaagcatggaagtgcttctgtggccaagcccagagtcattgtgggtggtgaccattcaaaggtgtggatacagggagatgtgaaaaaattgggggccattactgcaataattcataataattagcaatgaatgtaagctgttaagctttgataaatcttgttaaacacccatttctgaatgtagtgtattctagagactaaataatgtgattgtgccattggtaacacctcttccaccaagtgtggaatggagtgatggtttttctgggaagaagccaaaggcagacagtgtggttttggacatagatattcttgtgagtggcttaactgctttctgatcttgtgtggctattatcaaaggagtctctagatttcctcaaccttccattcaagcattatcacgaaaaccctagtgtattagactctactagattttgtggtcaagccaaaagaccgttatttgggaaccaccaccacttaagagatgaaagaaacatttgcagtctttccttggaacctttatatgatttataatttgtacctaagagaggaaatccgtatttgagcattggtaataaggacaagggattctctgtaaatgtgttttaattggttaagatttaaaaatcttcctgtggttgcagtgaaaaatccagcattgtactgtgaagtgagtggccaggaattaccaatttggggcatcagcctttgacctttgcttgtgaagatctcagaagtaacactttccacataactgaaataggcttcacaacagcttgtggcctgaaatatattacatgaaaatgcaactggaccccaggaagtatgtgtgggaaactatacaaggctcattttgtatgtcttagagatgtacattcccccagaaaattgcctggtggtagaatgttagcttttcttctttcctcctaggataaaaattaaaaatctctgacattttaaaagtcagtgacttgaaagagcaatcaaaatttataaacacacacatcattagaccccacaaacacttccaggaatttattcaacaaatatttgcatattaattggagtattgcttgtagtagcaaaagattggtaatatcctaagggtcaatcaagaatattgaagacactgatagttttggaacacgcatgaccaagcaggtagagggtgagagggagacttttcactacataaacttttacgtatgtgttttgaattttaagcaatgtgaatatattttcttattttaaaagttaaatacattttttaaagagatgatatatagtgatgcaaaattccatagactcctatccgagttgacctgatcagagctattcctgttcaaaaaaaatctagccagtttttccccctagaaatgcctcacgatagtgtacttctgaatttttaactataattctgccttttccagaatatcacatgagtggaatcatgcaatatgtagcctttttttggtcttgcttttagtggattcatccatattatgtgaatgaatagcctgttccttttcattactgaatactattccattgtatggatgtaccacagtttgttcattcacctgtcgaaggacgacttagttgttaccagttttttggtggttttcaatagagctgtggtaaacattagtgtacagatctctgtgtggacataagtttgcagtttattggggtaaatacgtaggaatgggattagtggatttttctttgacagaaattaccaaactatgttccaaagtggttctaccattttatattctcctgccatgaatgtgattccacgtatggatgtctagttgtcccagcaccacttgttgaaaagactaccctttctccattgaattgcctttgcatatgtgtcaaaaatcagttgactatccttctgtggatctatttctgggctctctgttgcattgatctatatatctatcatttctccattaacacacagtcttgattattatagctttataataagcctagaaatcaggtaatagagtactctggctttttaaaatctttctctcagggtatgcttaagttactttttaaaaaaatttttttatagaaacagggtctcactgtattggccaggctagtctcaaactcttggtcttaagcagtcttcccactttggcttcccaaagtgctgagattacaggcatgagccaccacgtctggctttttttgctttttaagagacagggtcttgctctgtcacctaggctagagtgcagtggccccatcatagctcactgcagccttgaactcctgggctcaagtgatcctcctgcctcagcgtcttgagtagatggggctatgggcacatgccactatgcccacctatttttaaatattttttgtgcagagataaggtcttgctatgttccccgggctggtcttgaactcctgcctcaagtgatcctcctgctttggcttcccaaagtgttggaattacaggcgtcagccactgcacctggcctggcttttttcttctttttcagagttgtagtggtgagagaggacatccttaacttgttccaatcttggaaagcattccatctctcaccatcaagtatgatgttgtaggatttttttttaatatactgtgttgtgcagaaaagagttaacatagcagacctgaggctgctgtctttagaaggccaacgtgcacgattggcccttagctggtgtttgggaaattggcttttcaaatgtttaaaaagaaaagattatattctaccttcatttattccttttccaatgcttttcatttctttatggtaatccaggtttcctaccttgatcacagtctttctgcttaaagaatcccctttaacctatcttttgagggcagatctgctggcagtaaattctctgtttttggttgtctgagaaagttttcattttccttcacttttgaaaggacacttttgtgggttgacagttgtttttcctctttcaacatagtactccaccattgcctggcttacgtgatttctgatgagaaggctgctgtaatccttttttttttttttaataccttaagttctgggatacatgtacagaatgtgcaggtctgccacataggtatatatgtgtcatggtggcccgctgcacccatcaacccgtcacccacttcaggcacctctcccaatgctatccctcccccagtcccccatcccccaacagactccagtgtgtgatgctcccctccctgcgtcgatatgttcccattgttcgactctcccacccatgaatgagaacatgtggtgtttggctgtctgttcccgcgttagtttgaggctgctttaattcttatccttgttcctccatagttaatgtgtcttttttcctctgactactttgaagattttctttttgtctttggttttcagcagcttgaatatgatatgcctaattgtggcttttaaaattttttcatttttgtcctgctttgtgttctctaaactttattatatctgtggtttgttgcctgtcactaattttggaaagtttctcagccattatttcttcaaataattctatcttgttcttttttttttctctttctgggattctaattacaagtgtgttatactgtttgttattgccccacagttcttgagtgctcttcagtattttcattcgtctctttttaatttttattgactgatcaataaccttgatcttcaagctcactgagtctttccttggctatgtcaagtctactgttcagcccattgtttttcttactgttttttttttaatttctagcatttccctttgattcattcttacagtttctatctctttgctgaaattatctgtctggtcttgcatattgtctattttttacattagagtctttaagatattaatcatagttcttttacatttttttctgatagtctcaacatctgcatttactgagtctggatttagtaattcctttgtcacttggaatgttttcttgccttttgttacgcctcctaaatatgctgaaagctgaacatgggcaggagatgcttaggtaaatatttgatatgtttggagaagaacatatttatggaaatttgtgttaatttggtcaggagttggcctgtgtttttttgtttttgtgtttttgcttttgagataaggtctctctccgttacccaggctggagtgcagtggcatgatcatggctcactgcagcctcgacctcctgggctcaagctatcctcccatctcaggctcccaagtagctgggactataggtgtgctccaccatgtccagctagtttttaagatcttttgtagagatggggtttcaccatgttgcccagagtaggtctggaactcctgggttcaggtgatctgcccgccttgacctctcaaagtgctgggattacaagtgtgagccactgcgcccagcaagagttgacctgtttgatattgggtttgttttgttttgctgtgggtaccagagatttcttttctctctctctctctctcttttttttttttttttttttttttttttgaggcagggtcttcctctgtcacccaaactggagtacagtgacacgatcatggctcactgcagcctcagcctctcaaccttctgggctcaagcagtcctccaacctcagcctcctgagtatctgggaccacaagtgcatgctaccatgcccagctaatttttaaatttttttttgtagggatggggtttccctgtgttgcccagtctggtcttgaatttctaggttcaagcgatcctcctgccttggcttcccaaagtgctgagattacaggcatgagccactgtgctccaccaggcaccagagatttctgatttctctagtgatacattcattttgactcttgcttagctttgggtttttactttgtgctgcttcccaagagctagctctaacagctctcccagttgtattctattgttcttaaccatggagctggtttgccaggttgtggttagtaggggaggagggagttctctgatgatctgattaaaccttacttagacaggtactagagcctgggtcttgagtgtgtccttggcaagatttacttttcctcctcctggactggagcttctttttctttttcccatgttcctttaccctagctgcagtgggtatccaccagtgttctccaaccatgggtttcaagtccttcccccaaagactaagcctttttttctgtattggggataaagggatctgggtaggtttcacagtgggtgctgttttcctcagccagctagccagcaccatggtgggcgctttctctgagatttttccctgatcttccctgtgagagcctggtggaattcctgtaggaaaagcttgtaagagtgtagcaacctcttacaagcttcacactctcatgccagctcatactctggtctccagtaatttgtcagaacttctagtttggtcctcctacaagtttatatgctcggatcctgtgtctccctgcgggtatgagtatttccatatattgggattgtgggacagtggtttgtcctaggacctcagttctgtcatattgaagaaaagtagttgcttttcagtttgtctagcatttttcttttagtgagagtggagatggtagcatcccagtgctttatatccaagctgaaacctggaagttttaatctatataaatgtctaatgcaatgcatggtacatagaaactcagtacaggttagttttcctttatgtttctttttcttactctcttgaattttatggttttatgactagggagccaggaataattgattctagtttggtttctccctgttttaggcttaaaaatcctctataccacttaaacattatacgtttgtcttgctttcttccaaaattcaatgtatgcctttgtagtttttgaatatgtcattagcactcagtaatttgcgtcactgaaaattagagcatgattttatctatttagattgtagattttgttagtgaccatgtttttgtcatttttgttatccacatcgccaggtgccattcgcttcagcagacatttgttgagtgcccactgtactatgagtgaggcactaggtattgagtagaatacaaacctgactaggtaagtggaataaccaaggggtccccaagggcagtggaaactccatggagggaaggatattgcaacttgcacagtatctccatttcaatctagaaaggtttaattcttttaagaattctatttttatactaatgatacatgaatgcatcctagcaaaaaattgaaaaattgtagaaagagccatggttgttcttgacatcctcctcctatcacattctccttcccagggttaattttgattactatttctgtttgactgtagaaattgctgtgtgaaatatcatgccatctaataacttagtaaatacttttatttttaagggaataagctctcaaatttatttaacttttaaggaatgcttatttaaagagatgactattatcattcagtggggatgtgtgacctgatgatagttctttgtttcactttatagtatagctattttaattgttaaatcctacgttagtggtcagtggaaatgttgtagtaaatgggaaacacagaaattagtagtgaccaaaaagatgacctattggctgggcgcagtggctcacgcctgtcatcccagcactctgggaggctgaggcagggggatcatgaggtcaggagatcgagaccatcctggctaacacagtgaaacccggtctctactaaaaatacaaaaagaaattagctgggcgtggtggcaggcgcctgtagtcccagctacctgggaggctgaggcaggagaatggcgtgaacccgggaggcagagcttgcagtgagccgagatcacagtactgcactccagcctgggcaacagagcaagactccgtctaaaaaaaaaaaaaaaaaagatgacctattgacttttttttttcttttttgagagtcagggtcttactccatcacccaggctggagtgcactggccctatcatagctgactgcagcctcaaactcctgggctcaagtaatcttcccacctcagcttcctgagtagctaggactacaggtgtacaccaccatgcccagctaattttattttattttattttattttattttattttattttattttattttattttaagagatgggaccttactgtgttgcccaggctggtcttgaactcctgggctcaagcaatccttctgcctcagcttcccaaagtgctgggattgtaggcctgaggcactacacctggcctattgacttaaaaaaattatacagtaggttggacttttttggggttatttatggttctgtggattttttttttaagacagggtgtcactttgttgcccaagctggagtgtcacagttgtcactcactgtagcttcgaactcctgggctcaagcaatcctcctaccttagcctcctgagtagctaggcctacaggcacgcattaccacacctagctaatgttttagtttttttgtagagacgaggtctcactatgttgcccaggctagtcttgaactcctgggctcaagtgatcctcccaccttggcctcccaaagtgctgggattacaggcgtgagccaccacacctgaccccgttctgtggatttttaacacataaatagatcagtgcaaccaccaccacaatccaccacaatcaaggtgcagaacagttctattacccaaaaaattcctttgtgctgactctttagtcatactctctttccatcctaaactctggcagccactgatctgtgttctatcactacagttttgttattttgagagtatcacataaatggagtcaaactgtaatcttttgagtctcattttcctctctcagggtaatgcttttgagattcatccaagttgtatatatcaatggtttgttcctttttattgctgagtagtattccattgtccaaatataccacagcttgtttaatcattcaccattgaaaggcatttgagttgtttccagtttttgttgattgagtagagccgctataaaaattcatgtacatgtgtttgtgtgcatataagtttgcatttctctaggataaatacctgggagtatgatggctagaattgtactaccattcatggtaaaactagttagctagagtttgaatgctaggatggatagagtagcagagacccaagtttgaatcctgctttttctttttactagctctgcaaccttgagtcagtttaacctctttgtgcctcagtttcctcgtttgtaaaatgaagttaaccactggtattgtgtgaaataaatgacatattaaggataaaatgctgagcaatgtatgacatactgaatatattattatctcatgtttaatagaaccctttttgtgagaaacattcatctttgatgaattaaaatggagaaattaagtaatctataagtgtggcgtgtttggtaggcaagccttcaaaatatgttgtccctggggaaaatttcagaagtcctcagtggtgaaaaggtttaggaacatagatgtatgagagtcttgtataacatccaaaggttggaccagatgcccaagtttggtggtttgacttgccctgtcaacactgaagaatcagattcaccaaaaattgagtacattgctatatttcatgtaagaagctgcaaaaagtagctcagaatcagtgaacacttattgagctcaggagatccacctgctttggcctcagaaagtgctgggattacaggtgggagccaccacctggcttaatctccccagttttgagaaacacattgaggtcggaattacagaaatactcagcaagtcttgccctagagcactataccattagaaaatgcagtggagaccctttcttgcataactgccacatagtatggtctggctcagtctgagcaggcaccaagggcagagaggatatgttttcccctggagaattttcccgtatcctatgaggtgcgcacagaagactacccattcactcaccaggcagtggatgaaattcagcatttgcaataaggaacctaaatgttcttttattgtctgttcatcattttgtaatgttttcacatggtacagtccatcaactgtgacagttctttatctgggatttcagcagaactgggtggaacaaaaagtcttgagcacacaatcttaagagatgtcacctctggactgtttctgcactgccttccctctcccgtaccatcaacaatccaacactcatgtttacctgcacctttcctcacagctgggaaatccttccctctttgccctgccaatcctgcctgggccaattcttccaaattcctgtaaattctatctcagcgagagattttccactatccccaactctattcttttggatgccatcccctactacatatttcctcattaagtcctgtcttttctattcactttggccctaatgccatacttccttactctgtgacctatttgtgtacatgtgacttgcaggtatacagctagacagagtgatagaaaaccttcaggttctctgcatcttatctcccacaaatacctgaaggggacttgctgcctcttattcaattaacaaaccaaatatcgattatcattttgtgtaaaaaaaaattacatgtaacatgttcttatttgtgttttttggtttttcttaaagacaggatttcactctgtcaccgaggctggagtacagtggtgctatcatagctcactgtaaccttgaacttctgggctcaagcaattgttctacctcagcttcctgagtagctaggactacaggtgcacaccaccatgcctagctaattaaatggtgggttttgttttgttttgttttgttttgttttttgtagagacagggtctcactatattgtgcaggctggtcttaaattcctggcctcaagtgattctcctgcctcagcctcccaaagtgctgagattacaaatgtgagccaccctccccagctgcatgtagcgtgatctaatggctatatacttcctgtggaaaacaatagttaggaaaagaaatacacattttgcagattgtcaaaactgctgctttgccatgctaccgttgtgaaaagtgtggctgtacagtctgcctgggtaaagtatggcttcagagtgtagattgcagacagctcttccctggctccagtttggtttctagccttcctcatgattccttgcccacttaaacaatgttaacaccaggaattttgtcttttcaaatatagacaaaactttgactataaacagctgtatcctacttgtctcacatgaaacttatacaggagcggtgtttgtgtatgtgtgtgtgataagcctaaatttagctctctttggaataactaacataaatccagaagaaacttttttctttctttagttgatagtatggattagaaaattaacatgcaagaaggagcttttttagacttctaaataaacttacttgaaagagctccaattatgccccttagcctcttaaggataatccgtgtagacacttgcctttagggtaattgtctctaggctactttcttcccataatctctgtgtcaccatattccaagtccgactcaacttccttctggactgctgtccataaagatgcagactcaaaaggctttttcactatacccttgtttcccaccctcaccactaggctaccactgacctctggctgtgcactgcacagtaagtagtgtgtgtaccctctagaacctgacattcaaggtcccccatacccaatcataatctttcccactacccttgactcctctcaaatacttttctctagccactctgtccaagcatgtattcactagagtctaaacataccatgagtcattctgaccgtctgcctctgcctggagtgttctccatattgctctgagtttgttccatcctgtgtgttcttcaggacccagtgaaaagctcatcttttcactacagtggtttcttccacctctgaagccccacaggactaaatgtgctcaacactcatttacccagatgggatagtgtggtagagtacttactggctacaatgtcctttcatctctgtatgtacacttagagtgtgattttgcagatccttgcaacaagaggtggagtctgtttctctactccttgaatctgggctgtccttgtgactcactttggtcagtaaaacatggcacaggtaactccagatgacttatgagcctaggtctcaagaagtgttgtagcttctttcttactctccattctgaggcaaccatgtgaggaagccccagctaacctgctggaggaagagagatggtatggagagggagagagagatccagtcatcaaccagccatcagatatgtgagtgaagccatcttagaacattcagccccagtcacattggcagatgactgtaaccatatgaaggaccacagaaaagaccagcagaacaaccacctagctgattctagccgaaattgctaatccacagaattgtgagctaataaaatggttattattttaagctactaagttttggggtgaattacatagcaataaataactgaaagggcagggtttgtactgctatatccccagggcctagagggcatgaccatggcaggttttcagtaaaagactgttgtggattactgtcattgtggtgtcactcctctctttgcttaatagacaaccaaacttcccagtcctcttggctctcacaaaagttcaaagcttgacttcaacacattcttccagaataacaccttgaagttcttctttgccccactgcaccagcatccatccatttgcccccatcacagccctatgacagacagttcattacaccccacctcagctccatgttgcgtccctcctacttacccttattctctaaccctgtggggtcaacccattgaccacctcagtgccataaagctcttctcaacttcccagccccccatccataccctgaacgcgcactacctgaatcacatgtgcttataattaggaggaaccttagaaattgagacagccccttctagttatgaatgaggaaaggaaggcccagataagaaataataataaatggcttattcaaagtcacatggaggcaatgtcaaaagtagagcccacatctcacacagatgattacctagtggattgcctgtgttttcctgcatctggtgcttggtttatgtgtaggacaatgcctttaatgattaaactatgggaattctttggaggcaggcataataccttttacttatgccttttctcattgccagcatatctccacttaaagactaaccagcgactactagacacatcagtagtcaataaatacctgttgattaattgacattttaaaaacaattatgcctggaactttttaatatattgtttgtggtagtgattacaatagtatacatttgtcaaaactttaactgtacgttaaaaagggtaaattagagtatatgtaaatttttttttttttatttgagacagagtcttgctcttgttgcccaggctggaatgcaatggcacgatctcagctcactgcaacctctgcctcccgggttcaagcgattctcctgcctcagcctcctgagtagctgggattacaggtgcccgccaccatgcccagctaattttttgtatttttagtagagacgggggtttcactatgttggccaggctggtcttgaactcctaacctcaggcgatccacctgcctcggcctcccaaagtgctgcgattacaggcatgagccactacgcccagcctatataaatttttttaaattaaagcgtaatcaaagcaattatgctgaagaaatccatttatttgataaatgtggctaaatatataggtaacatgttactatgtgaaaagaagtttggccctttgaaaataaacttgcatataataggcactcaatgttagtttccttcttccttgtataccaatgcttcatgatcacctgtcaaggctactaaagaaagcattcttgtactagaagatagctggatctgatctgacttctaagattctatgatttgtttaaaaggtaaataaatgactgttttgaaatgcctgtgtaaagtaaaaatacgtaagcactacaacactgttctaaaaggtggccccctaggaccttaattttactttcaaagacttagttacaaaataactagtcccctgttaatagaagttacttaaagcaaaaggatgtctgaatatcctttcagtgtcgtactggagcattggctgacgggcccacccaagaattacttagttctctaggggattgcatctttgtttggctcactgttcactaatgattagagtcgagaccttttcaagcaacatgttaacttatagatttttgcctggtagagatgtaaaattttctgtttggtagaagaaattatcctaaagactacagattaattttcctatagggcataaccacttttctaatttagcaattttattcgagcattctttcaaggcctatatatagcaagtctctcaaatattctttgaataagctttaaatcctgttagttccctaataagttaaatgtctttgacatgtgttcagtctacatttgtatgagtcatgtttttaattttgaaaattatatttcgatacccaaacattctacaacattgcctgtgggtcatgacccatcctgtacagagtccctgaaatccattactgactgttggttttgatgctgtgctagcaccttcaaatacctttgtgatcatgctagtacttgaagaggtcttcacaggaataattttggatacctctgcaggtactcaagaacactgcagaaagactttctgggacttctctcacaaaatgagaaactaatgttccttcctatcatgttattgttctgtctataagctgagaggatgacattaagagcctttgttttaggagatccatggcaaacagactcacagggtctttcttgttaaacaatatttctataatctggctttcctagtaatggccataaaataactatatcatagcaataaaaattgataaactatcagctgcctcaaaaatctaatagctttggcaaaatatactatagctcatgtatatcctctttttctctaacagattttaatacttttccttttcatactactgaacagcataatcaaatcaacaaattcagctaatggccattgtgttgtgggcactgtgcttggccctgcacatccccatgttccctctcccctttgtcaaaaactagctccactggttgttaatgtcaatcactgatttgcggttgtccagaataaaaatggagagcagagcccaaacggagggtggcagtcggccttgtcattacccaaagaactaaaaatggagtaatgcaaaagagtggaactccttcacattaacaaaagcttagttatatacagtataagaccactgaatattaaacacacaaatttgaaatatgcagagaaccaggaagaacaggttaaaacatggttcactaattctggtatttataagtattctgagtcagcttgacaactttattgaaagaagcatgaaacatcttacaataaaaattcaaactcagaagtaatccaggtgtgattcccattcatacaaaaggatcaaagtgccaacttcgtatgcagtatagggaatcctctgcagaggaagtgtgaaccaaacttttaaaataccagggaggatgaggtggagtggattgagaacaggagtggaagaaaaaatttcaacccacttttcctggtgattatttaaaaacaaaaaatctactatttaatgtttcacaataaagtgttttagaaaaagtaattagctcggccagcttctgccccaggatgtagaaagctggaagcagtgttgttcacatccttaaaattaaaaaaaaaaaaatgctgggctaatttcaaattcatgacttttgtcaaacccatcagagagaagtattttgcccaagtattagttcagagaagtatttgttcaagtgtttcttatttaagttgggttgtttcttactgttgtttttgaggttttttccctaatagtctgggtaaaaatcctttggttatttgatttatcagcaaatattttttgtatgtaacttggcttttcattgtcttaatggtgtcattcactaagcaagattttcattttgttttttttaagacggagtctcggctctgtcacccaagctggagtgcagtggtacaatcttggctcactgcaacctctgcctcccagattcaagcaattctcatgcctcagcctcccgagtaggtgggactacaggcgcacaccaccacgcctggcaaattttttttttttttgagacggagtctccctctgtcacccaggctggagtacagtggcgcgatctcggctcactgcaagctccgcctcccgggttcaagcgattctcctgcctcagcctcccgagtagctgggactacaggtgcctgccaccacgcctggctaattttttatatttttagtagagacggggtttcactgtgttagccaggatggtctcgatctcctgacctcgtgatctgcccgcctcggcctcccaaagtgctgggattacaggcgtgagtcaccgcgcccggcctttttttttgtatttttagtagatgtgaggttttaccatgttggccaggctggtctccaactcctgatctcaagcgatccaactacctcggcctcccaaagtgctgggattacaagcctgagccaccgtgcccggccttcttctatgtttataagaaaaacttgcttataaaagttttataattttacatttatgtctattttgagttaatctttgtaaatggagtgaggtttaggtgaaggtctatttttgtgtatatggatgtctttaatttacttttgcatctttgttgaaaatcagttgcctatatttatgagggtcagtttctggtctctcttttgttctgttggtttattctcagtctcactctggctcccaggctggcgtgtacagtggtgcgatctcagcacactgcaacctccacctcccaggttcaagccattctcgtgcctcagcctcccgagtagctggtattataggtgcccaccaccatgcccagctaatttttgtatttttagtagagacggggttttgccatgttggccaggctggtctcaaactcctgacctcaagtgattcacctgcttcaacctcccaaagtgctgggattacagacatgagccactgtgcccagcttgctggtctgtttttaatcactttgccaataccactatcttgattactatagctttatagtaagttttaaattcaattgttattattcctccaattttattcttctttttaaaaagcgtttttggctcttctagttcttttgctgttctttataaattttagaagctgcttgtctctctctacaaaaaataggctgtggactcttaccagtctgtggcctgttaggaaccaggccacacaggaggaggtgaacagtgggcaagcaaacattcctgcctgagctccacctcctatcagatcagtggttgcattagattctcataggagcacaaaccctgttgtgaaccgctaatgtgagggatctaggttgcacactccttatgagaatctaatacctgatgatctgagatggaacagtttcatctggaaaatcatcctcccttcccccgtccgtggaaaattgaaacctgtccctggtgccaaaaaggttggggactgctgccttattgtacaggctgatacttccagtatgacattgaataggagtcatgagaaagggcatctttttcttgtttcaactttaagtctttcacttttttttttttttttttttttgaggcaaggtttctctctgtcacccaggctggagtgcagtggcgtgaacacggctcactgcagccttgatctcctgggctaaagcctcgacctcctgagattacaggtatgagccaccacgcctggctgatttttctttttttagatttaacgtggttgaatacattgatttttttttttttttttttgagatagagtctcactctgtcacccaggctggagtgcagtggcacgatcttggctcactgaaacctccgcttcctgggttcaagcaattctcctgcctcagcctcctgagtagctgggattacaggcgcctgctaccatacccagctaatttttgtatttttagtagaaacggggtttcgccatgttggccaagctggtcttgaattcctgatctcaggtgatccgcccatctcagcctcccaagaatacattgatttttgaacactgaacccaacctgccttacattcctagggtaaaccccacttggttgaggggtattattatttttacatattgctgttagatttgctaatattttgttggaggtgtttgtttctatgttcatgagggatattggtctgtagttttctctttttgtatgtattgtctgtgtttggtatcaaggcttcataaaatgagttgggaaagcttccctccttgcccatattctggaagagatcttgtagattttttttttatgtttgttggaatttgccagtaaaactatctgggtctgggcatttcttttttaaaaggttttaaactttgaattcagtttccttagtagttatgggagtattcaggttatttattttattttcaatgagttttagtagtttgttatttacaggggattgctccatttcatttaagttgtctatgtgtgcagttgttcatagtgtccatttattatccttttaatatctgcaggacctgtagtaatatcccctctttcattcttgatattagtaatttgagtgttcttttttgcttttcaattgtgctagaggtttatcaattttgttgatcttttcaaagaaccaacttttggcttcatcgatttttctctgttgtttttctgtttagtcctttatcttgactgtttcctaatcatcttgctttggatttattttgctcttcttttcatagttccctaaggtaaaagtgtaggttgtttttttgagaccttttttcctcctaaaagagaatttaatcctataaatttctctctaagcactgtttccactgtagtccacaaaatgggttatatttttggttttcttgagttcaaaatattttataatttatcttgaaagtttctctttgattcgtggattatttaaatatatgctgtctaatatccaagtgtttggagatcttcctcttatgtctctgttgttgattcttaattcctttatggtcagggaacatgctctttatgatttccatattttatattttggaaggtttgttttatgatctaggatatggtctatcttattgaaagaacacgtattctgctattttggggtgaagtgttctgtacatgtcaggtaatgacggttgatgatggtgttcagttcttgtatatttttgctgattttctgtctactagttctgtatattaattagagtgttgaaacctccaagtgtaattggatttttctattattttagatcttagagttttgcttcacgtattttgaaacactattgtaaatgtttacacatttaggattgttaagtcttttgggtatgttaacccttttaacattatgtcatgtccctctgcatccctcttctatcttggtaattttctttgctctaaattactccttttggccaggcgtggtggctcacgcctgtaatcccagcactttgggaggccgaggcgggcagatcacctgaggtcaggagtttgaaaccagcctgaccaacatggtgaaaccccatctctattaaaaatacaaaaagtagccgggcatggtggtgggcgcctataattccagctgcttgggagctgaggcaggagaatcatttgaacctgggaggtggaggttgcagtgagctgagatcacgccactgcactccatcctgggcgatgagcaaaactgcatctcaaataaataaacaaataaataaattgtttcttttaatcagtgtttgcatcacatatctttttccatccttttgcttttcacttacttatatcattgtatttgaagtgattttcttacagatagtgtgtagttgggtcatgttttaaaaatccattctaaaaatctgtctttaaattgtaatgtttagaccactacatttaatgtaattattgatatgattgttttacatctgtcgttttttatttttgatacctgtttttatttcctcttttttcccattttcctgtcttcttttggttatgtgaacatttttagtgctactacatttttatttacctactgtgattttttagttatctctttgttttttgtggttgttctagggattataatatacatagttttatacagtctacttagagtaagtgctttaccacttcaagaggaatgcagaaaccttaccaccctataggtccctttatcctcctttctttatgtcatagttgtcttatatattacacctatacctgttgaaaattccttcacacattgttaccatttttgctgtcagccaccaaacatattttaaagaactcaagaaaaggatagtatattgtatttatccaaatattcaccatttatgttgctcttttcattcctaatattctaagtttccttctggtatcatttaccaattgtctgaagaacatcctctagcagttcgtttagagtaggtctgctggctataaattctcatttctgaaggacatttttgctgagtatagaattctgtgttgacattttttttacccccagcacttcaaacgtgttgtgccacttccttctgacctccatggtttcttttttgagacggagtctcgctctgttgcccaggccggtgtgcagtagcatgatctcagctcactgcaacctccgcctccctggttcaagtgattctcctgtctctgcctcctgagtaagtgggactacaggcacgtgccaccatgcagctaattttttgtatctttagtagagatgaggtttcaccatgtttgccaggctggtctcaaactcctgacctcaagtgatccactcaccttggcctcccaaagtactggggttacaggcgtgagccaccacacccagcctggcctccatggtttctgattaaaaatccactgtcattctaaatgttgtacccccataaggtaatgtaatagctgctgctttcaagatttttttctttgtattactttcagcagtttgatttaggtatgcctggacgtgggttaattttttttttttctgttgggatttttcactgctcaggctattgaaagtataagtcagctctagattttataatagactggaataatattgataaaagacttcttttgaaagtggcttggcatcatagggaattgcacagtgaaatatataagtatttactatacatctcagacagaatttaacgttagtaaattctagttgtaactcctgctctctttcaatgatgtggaagattgttaaaaacggactagaatggaaggaattaagccccagaaaaaataagtgagttttgtagctttacatacctagtaagttgcaggtcttattttcaggtactgtttccactgtaatgtattgctgtgtacttacagaattttcgcctccctcaagctgaaactttaacataggtttatggtgagatactggtttgaaatatctactttttatcaggaaaagtctaaattttcagtttcttcagtgaggcatcaagtcttagttaagagcacgattggcaccctgtggcctgccagccaaatctagtctgctacctgtttttgtacagtccataagctaagaatgggcttttcatttttaaatggttgggaaaaaactcagaatagttcatgacatgtaaaaattatatgaaattcaaatttcagtgtccataagtcaaattttattggaacccaaccacatcagtttgtttacatattgcccatggtttattttacactacaatggcagaattgattaggacacagaccaaatagcctgcaaagcaaaaaatatttactgattagccctttacagaaaaagttcgctaactcctggtttacaataatgttgagtgaattaggttagagtgtcagtaatctgaactgtgtgaaaagggtagctaggattcaaactttactctttgaataagtatcttagatgtgagaaaattagaagatgagagttaactgattataatcctagtctattaacatatattaaacattatcagtcctacagcaatattccacattatctgtactttttaaattagcccatcagatcaggagaggttgataggaggaaaagttggagttgtttctacctaggtatttgaaaattgttggaggcattgagactcatgcataagggacttaggaagcctttactggctggaggagataaaggctcttatttaaaattctgtgttttcctggttatatttctgttttcctagagttgggctttttataggtctagttagttacctagttgcctttctgcaggcttcttttgtgagggtgtttctctatggctagtgggaggaaatggctggtcatttttaaatgaagaggaaagcccaactcttaccaggacctcagcctgacattgtcccttacccctatagaggcctttcttctgagcctatagacccaccttgccagctgacatcagaagcctattgagatgtccatagcctgttgttcccaacctcttcccgttttctccccttcttttcaaagaccaaatgagctacatctacactacgtatacatttaaggattttttttaaggcacaaatcatcttgttacccactgaaatttaagcttagttgggtcacctaagaaacaacctagaaactgccaattttattttttcatttaaaaatataatttcagcttttattttagattgagaagatacatgtgcaggtctgtcacgtgggtttgttgcatgacatcgaggtttagggcacagatggtcctgtcacccaggcagtgagcatagtacctgataggtagtgtttcagcccttcctcttccctctctccccatctagtagtccccatctttatgtctgtgtgtacccagtgtttagctcctgcttatagacgacaacatgcggtatttggttttctgtattaattcacttaggataatggcctccagctgcatccatgttgctgcagagaacatgatttcattcttttttatggctacatagtattctatggtatataagtaccatattttctttatccagtcctcctaggttgataccgtgtctttgctattgtgaatagtgctgtgatgaacatatgagtgcatgtgtctttatggtagaataatttattttcctttgggtgatatacctagtagtggaattgctgggttgaatagtggtttgatttcacattctttgagaactccccaaaccactttccacagtggctggactaatttacattcccatcaacagtgtctaagttcctttttctctgcagcctcaccagcatctgttactttttgactttttaataatagccattctgactggagtgagatggtatctcattgtggttttgatttgcatttctctgacaattagttttgttgagcatttttttcatatgtctgttggccacttgtatatgacttcttttaagaagtgtccatgtcctttgcccacattttttttttttttggatacagggactcactctgttgcccaggctggagtgcagttgtacagtcagtctcagctcactgcagactcaagctcccaggctcaggtgatccccctgcctcagcccctcgagtagctgggactataggcaggtgccaccatgcctggctaattttttttttttttttttgtagaggcagggtttcaccatgttgcccaggctagtcttgaactcctggtctcaagcaatctgcccactttaacctcccaaaagtgctgggattacaggcgtgagccattgtgcctggccttttgtccaccttttaatggggttgttttttcacttgttgaattttttaagttccttatagattctagatattagacctttgttggatgcacagtttgtgaatatttttctcccatttgttagggtgtctgtttactctgttgatggtttcttttgctgtgcagaagctcttattaggtcccactggtcaatttttggttttgttgcagttgcttttgaagacttaaccataaattctttggcaaggctgatgtccagaaggtatttcctagattttcttcttgtatatttatagtttgaggtcttacatttaaatctttaatccagcttgagttaatttttgtatatggtgaaaggtaagggttcagtttcttcggcatatggctagctaattatcccagcaccatttattgagtagggagtcctttccccgttgcttatttttaactttgtcaaagatcagatagttgtaggtgtgtggctttatttctgggttttctgttttgttccattggtctatttgtcttttcgtaccagtaccatcctgttttggttattgtagccttatgttttgaagttgggtgatgtgatgtctccagctttgttctttttgactaggattgctttggctatttaggctcttttttgttgttgttgttccatatgaattttagaatatttttctaattctgtgaaaaatgatgttgctaatttgataggaacagtgttgaatccgtaaattgctttgggcattatggccattttaatgatattgattcttccaatccatgagcatggcatgttttttcatttgtttatgtcattgtgatttctttcagcagtgttttgtagttctccttgtaaagatctttaacctccttggttagatgtattctaggtattttatttttgtgtgtctggctattgtaaatgggattgcattcttgatttatttctcagtttgaatgttattggtgtatagaaatgctactgattttcatatattgattatcctaaaactttactgaattcatttacagaatctaagagtcttttggagaattctttagggttttctagacataagatcatataatcagaaaacagataatttggcttcctcttttccaatttggatgccttttatttttttctcttgcctaatggctctggctaagactcctggtactatgttgaataatagtggtgagaatgggcatccttgtcttgttcctgttcttaaggggaatgcttccagcttttgcccattgattatggtgttggctttgggtttgtcataggtggctcttattattttgaggtattttttttgatgcctagtttattgaaggtttttatcatgaagagatgttggattttatcaaaagcttttgctgcatctatttggcataaatgcatctatttagatgatcatatggtttttgtttttaattgtttatgtggtgaatcacatttattgaattgcatatgttgaactaacctagtatcccaggaataaagcctacttgatcatggtgaattaactttttaatgtgttgctggatttggtttgctagtattttgttgaggatttttgtctaccttcatcagggattttggcctatagttttcttttgttttgcctttgcctgatttggttatcaggatgatgttggcttcatagaatgcattagggaggagcccctcctcctcaatttttttggaataatttcagtaggattggtactagttcttctttgtatatctggtggaatttggctgtgaatacatctgttccagagcgttttttggttggtagattttttttattattgatttagttttagaacttgatctgtttagggtttaaatttcttcatgattcaatcctgggaggttgtatttttccaggaattcatccgtttcctctagattttttagtttgtgtgcatagaggtgtttataatagtctctgaggatctcttgtatttctgtggggtcagtgtaatgttacccttgtcatttctgattgtgcttatttggatcttctctcctttttgttagtctagtaagcagtctatcagtcttatttagcctttcaaataaccaactttttgttaattctgtgtgtggatttccgggtctcagtttcatttggttctgctctgattttagttattttcttctgctagtttttggggttcttgtttttctagttcttctaggtgggctgttagatcattgaattgagatctttctcacttctttttttttttttttgagactgagtattgctgttgtcgcccaggctggagtgcaatggtgtgatcttggctcactgcaacctccgcctcctgggttcaagcgattctcctacctcagcctcccaagtagctaggattacaggtgcccaccaccatgcccaactaatgtttttgtatttttagtagagatggggtttcaccatattgtccaggctgatctcgaactcctgacctcagatgatccacccgccttggcctcccaaagttctgggattacaggagtgagccaccacgcctggccttttctcacttcttgatataggcatttagtactgtaaactttcctcttaacactgccttttttacatcccagagattttggtataccgtgtctctggaaaccaccaattttaaatgttctgtacacattaatttttaggctaataaaaatgttactctcttgatttggaaacttatcttttaggtgacagaaaaacaaattttgtactattcatgcatatgtattttcaatacatatgtgtgttctttttgtttaagaccgggtctcactctgtcagccaggttggagtgcagtggcataattatggctcagtacagcctcgacctcctgggctcaagcaatcctcccacttcagcctcccaagtagctgagactacaggcgcacaccaccacacctggctgaatttttttttttttttgataatttttgtaaagatgagatttcaccatgttgcccaggctagtctcaaactcctaggctcaaacagttcctcccaccttgacctcccaaagtgctgggaggtgcccagtccatatgtgtattttatagctattcactcttggatctgttactaccatgaaatacagctgtcctaaatgccctgggccacatcatccaggagggtaaaaccagagtctggatgatagtcactcatagactttagctgttatagttctccagcttccagagcagtcttcagctatacccattttgccctggaggtatctgctatgttttcctgactaggtactttatagcacctaatgtcccttctctcttctttcctcttagcacttttggtgacctcttgggcagggtctttcctggactactattgatttcaacctctggaagcttctcttctattaatatgtttgcacagcccccagtgctgctgctaccactgacttgcttgacttcccatttggctgacccactcatgcagtactcaactaagggtactagtgtctgtgctaaggttcttggctctctcatctttctgctgtagctgggactcctggagctgtgggagctgcatgtcagcttgtttaggtttctgtgaagagcctctcactaggattctgaactgagtccttgcaagctagctgagctaaagaatgaacctgagtaacacacttcacacagttttatgaattactgctccctcacgccttggaatattgccaccagattcagttggtgagctaccattttctcttggggccccttctttaacaggagattcctgttccctcaataatacaaatttctggtaggataggccgctcctaggcactccctaacaggtgagaatcctcctggtgtgttcatctccttatgcttaagtagggcatatgtgaggatttgtgtatgtattgatagtatattccttatagtgcatacattcctgttggaaagcaagacttcagagtagcaggtaaagaattacgattactaaccttgcaaaagagaagatcaagagggtgccctttcagtacttggaacattttaaatgaaaataggtagtagccagttataattatgggtactgagaataatataaagactttcttgctatgataggtttaagaaaataaggaagtatttctgacaactgttgaaatgggtcccaaaggaatatagtagaatttcctggctaggcctgagaaaaaaatgtccatattctcccttttggaagttaaggtaaatgtagaggacttaagaggcagttggcaggatgggggtgggggtgtgttcttacgtcatcacccagccctcccatggaggtagcataatgtagtggaaagatgtgtctttgggaatcagtccatgggttcagatctcagctccctgaagctgttctgtgtaaatagatactatcatgtggcatgtatgattaaatgaattaaaatagtgcctccatgagtatatcctcctgtacttggggagggacttgaggtcacctagctcttgagatctgatctgtatgagctaagatggcagtttattgatatatagtgaagattcaactgtgattgcattttcatatgatggagccacctcacaccggattgcaagagccgatttgcgtgcatggctttcaaattccatgatgagtgacatcatcttagtagcttgaaattgaccatcttgggagtatctatatcacaggaatcagtaaactacaaatcagggctttttctccctcttgaagagcctgatgataaacatttatcagcatatcactgatactatctctctgtctttgggtgagttgtgtggtaggccaagccatcttcacaagattacatcccaagtgtggacttggaccagggactttagttccatgattctcatgtttgatgccatcagcatgagagttgcttttggtccttttcttttctcttcttttcttttcttttctctttgagacggagtctcactctgtcacccaggctggagtgcagtggcacaatctcagctcactgcaacctccccctcccaggctcaagtgattctcatgtctcagcctcctgagtagctgggattataggtgcgcgccaccatgcccggctaatttttgtgttttttgtagagacagggtttcaccatgttggccaggctagtcttgaactcctggcctcaagtgatcacctacctcagcctcctaaggtgctgggattacaggcatgagccaccgcgcctggccttttggtctttttctgaaactgcggtgttcttgtccttgagcccggaggggtagatacttggacatggactgtatctcctctggaccatgcttacataggaatttcaagctgtgtaactttcgtttttgtactccttcagactgatcccccttttatttttagtctttttccatcctaagtagaatataaactacagttgcttgtttttactaaactgtagtcatattctaatcctgcctccctgaaatgaagtcagacgtaactgttttttgtatccatgccattcccaaattaatttggagttttggatattgatgagcttttttggctcctatataggcaatatcagggtttgtccccttagctgtccaattacatctgaatgcagattttaccagtttatctttcataataaaaatctgcattttgctcatccccagcatgagaggtaccgtgccgtttggtccatgtcctgataatgtgtcacttccaacatggagcctccatgccgtctctggacagatttagtcaatattctatcatgcccccaggaaatttggagccttcctttcttcctctgttatacaacctgttactctgggttctggtaatttgttttcctttcttccttatccctccaccagagcccacgttcctggagattacagacctgcaattatctgtccctggtatctgataccacaactgtatcaggcctctagatgaatttggcatgtggatagattaataaaattatgtgaaattaaagggtcggtgaaagttgttagcctgtgggagtttttaagattaagatcactgtctaaattcaagttgtgtactgtcagttaagaatcaattcctgggcagctttttgcctcctttataatatttctcagctttgataattgctaaagtatgtgaaagtgcctttggacagattccctatataggaaggagcacgcaaaggaatgtcactcctgacctacacctttgtcctggaattatgtggataaataaactaatccttctatttaaaggatggtttcccttctatggatagacaggccagattgtttgatgctaactcatgaaattctgcctgtgtaaaggatgcctgtattctccctgcattcattttgtgggctcgctttatttgcatcagttttgacttaagtgttcctaatcattggcaatgaagatacaggttaaatacaatatattattgatagttcagcagacaagaatgtagagagagaatgcaaagaaggataaagatagtgtcaaagagggaaagccttaaatatatgtacatagagcataaaggaaagtatatagcatataagtagaagtataatatacctgaagaaaaagtgaacaagtcataagggtacaacgctattaataatctcaaagtgaacttacacattcaaccagtgccccagtcaagaagaacattataagcacctcagaggccttcttcctgagtacccctttcttctaccgcaggggttaccaggttactgctatcttgaattctgtcactatagactaatgtcattttcacactttgtgtagatggacaatacacatacacaaacatatcacaattttttaaaaaaactctacttttttttttgagacagggtctttgtcacccagactggaatgcagtggcacaatcatggcccactgcagccttgactcactggacttaagtgatcctcccacctcaacttccagagtagttgggactacaggtacatgccaccatgcccggctaatttttgtattttttttttggtagagatggggtttcgccatgttgcccaggctggtctcaaactcctgggcttaagtgatctgcctgccttggcctcccaaagagctgggattataggcatgagccaccatgcccagccaaatctactctactagtgatgaacatttctgggttgtttctagcttggggctgttacatatagtgcttatctgagcattctcatacatgtcttcaggaacatttgtgtacatttctgttgtatatataattaggagtaaagtagctgggtcatagggtgtgcacatgttaagtaagcttcagtagctattgtaaaacagctttccgaagattttatcctaatttacattctcaccagcagcataaagaggcactttgccaacaacacttgtattgttgatgtttcgaattttagccattttgatgagtagtagtggtgacttccttatttctcttttattgaggcataatttacgtatagtaaaatgcagagattttaagagtacagtttgagttttgacaaatgtatgtacccacatagcccacaccctaatcaagatataaaacatttctatgtccctgaaagtatcattgtgtctcttttcagtcagtcccctctaagcggaggtagctactcctattctgatttctgtcaccatatagtttttcctatgactgaacttcatgtaaatgaaataatatagtatatatattcttgtatctggcttatttttggtttattttcctcaatataatgtttctgagattcatccatgatgtagaggaatattcatatcagctatatttctaataaccaaagactggaaacaacccaaatgccctccagtaagtaaatggttaaactgtggtgcattcataaaatgtaataaaagaaacaaactattcataagtggatcaacttgggtggctctcaaaagcattatgctgaatgaaaaatagcctatctcaaaagtttacatactgtatagtttcacttatgtaaaattattaaaatgacaactttattgaagtataatttatataccacaaaattcacctgcataagtatataattcaatgccttttaatgaatttactaagttgtgcaaccatctccataactcagttttagaatatttccatcacgctaataaaatcccttgtactcatttgcagtcactccactcttctcccctcagccctaagcaactactaatctactttctgccattgtagatgtggacatttcatataaatagaagcgtataacatatggtcttgtgtgtccagattctttcacgtagtataatgttttgggggtttatctgtggtggtacaacatatcaataattcattcctttttgttgctgaataatattccatcatgtggatgtaccacatcgtggttattcctttgctagcagatgggtatttgggatagttccagcttttggttctcatgaacagtgctgcagtgagcattcatgtacatatccttgtgtagacataagttttcatttctcttgggtagaattttaggagtagaattgctgggctgtatgttaaatttatatttaattttttaaagaaactgccagttttccaaggtggctgaacccttttatagtcctaccaataattcctgggaaatatagcttgtgtacttgaaaagcatgtatattttgcttttcttggagtgttttgtagataccagttaggtcaatttttaaaatagttcttgtttaggttttgtatattctttatttttttctagttctatttattaccaagagtggaatgttaaactctgttagtgtccaattgtctgtttcttcagttctttgtctttagttttcagcagtttgatcatgatgtgcctaggtgtagattcctttgtatttattctgtttggtgttcttagtgtcttggcagttttaaacttttttttatttttattttttatttttatttatttttttgagacagagtctcgctctgttgcccaggctgtagtgcagtggcacagtctcggctcactgcaacctccgcctcccgggttcaagcgatttctggctaacttttgtgtttttaatagagacggagtttcaccatgttggccaggctggtctcgaactcctgacgtcccagctacttgggaggctgaggcatgagaattgcttgaaccccggaggttgaggttgcggtgagcggagattgccccactgcctccatcctggcaacagagtgagactccgtctctactaaaaatacaaaaattagctgggcatggtggcagtcgcctgtaatcccacttactcgggaggctgaggctggagaattgcttgaacccaggaggcagaggttgcagtgagccgagatcgcgccattgcactccagcctgggcaacaatagtgaaactccgtttcaaaaaaaaaaaaaaaaaaaaaatttcaactacccagataagtcaacttggtatcttaagaataaaaagatatatacatgtacaaaacaagtccctttaagataaaataccatttgcagataagacctcttaagagtaaagtaaatcaataagagatgcttttactatgaaatacacaattctttctccagatagaaactcaaacgatttaaaaaaacgatttcccattgttttatctgctgctgtgagttgtttccacactgaaatttttacccacatgtacccattatacatttacaataacgttcatgtgatttaaagtaatcatcccaatttattagaaggaaaaacaacctttatcccaggttttcgtaacaacgtaacatgccttatatgtgaggcatgtaaacctcacatataaggttaaacacacagaaatgaccccaaacttactgagcaagttcaaatccactgcacaccaacttttaatactgtgctaacagagggcaggcactgtactggccaccagaaagaggacagacaaggaaaaaactgagaaaccaagtcctttggctcccacagagccagggtcacaggaccaggtgcaccaaacactgtggcttgggtgatcacagcctaaaactgttaaccaatgatgtgtgacaaaccaattagaggggggtttgagttaatcccaagatcaatcaaataggatatgggtgtgacatgaaggagggttactgttaaaccctcacctctggtcagatcaatgcccatggcaaaggagcagtcagacatggaagttaacatacaagtcagtactgactttgaaggcaacaaaaaatgagggaaaatgaaatggcaacaaatttccctggggagaaatcaaagggtctggtagataaatgccaatacatgttaaatcccaaaaaaatgtatttggcctccccagcagaggttctcaacccccattacacatgggaatcatatggagaacttacaaaaatcccaatgtccaaattgcacccattaccaattaagtcagaatctctcttttggaagaaccagtttttagatggattgctttttctgtttttctgtttttgattacattgacttttgttcttttattatttccttccttcacttactttgggtttatcttgctcttctttttctagttaaagtgggagcttagattattcatttgaggcctttcatcttttcctcatataagcattcagtgctctaaatttccttcttagcactcatttaagttacaccccacaagtttttctttttgagatggagtttcgctcttgtcacccaggctggagtgcagtggagcgatcttggctcactgcaacctctgcctcccgggttcgagcaattcttgtgcctcagcctcctgagtagctgggtgcctgccaccacactcacctaatttttgtattttaagtagagacagggtttcgccatgttggccaggctggtcttgaactcctgacctcaggtgatctgtccgccttggcctcccaaagtgctgggattacaggcgtgagccactgcgccctgccacgagttttgatatggtatattttcatctacattcaggcattcaagccactgtactgatgagaagtgtgacgcttagtttccaagtgtttggagaacttcttgtagtctttctgttttgttttgtttttttccttttttgagacagagtctcactctgttgcccaggctggagggcagtggcacgatctcagctcactgcaacctccgcctcctgggttaaagcaattctcgtgcctcagcctcctgagcagctgggattacaggcatgtgccaccacgcccggctgatttttgtatttttagtagagaggggatttcaccatgttggccaggctggtctcgaactcctgaccttaagtgatctgtccgccttggcctcccaaagtgctaggattagaggcgtgagccaccacacccagccgtctttctgtttttgatttctactttgattctattatggtctgagaatatactctatatgatttcacttcttttccatttgttgaggtttgttttatgacctgggatgtagtcaaccttggtgaatgttgcttgtgcacttgaaaagtaagtatattatgctgttgttgggtgaagcattctataaatgtcaattaaatctggttgactggtggtgttatttcttctatatctttgctgattttctgtctactggttctatcaattactgaaagaggggtattaacattctcaagcataattgtgggtttgggtttgtctatttctcaattcaggtctgttgggttttgctttgtgttctttgaagctctgttatgtggtgcatacacatttaaaattgctatgccttcttggtggatcgaccctttgtatcattcttttagtccctggtaattttctttgctgtgatatctaattatctgatattagtatagccactccagttttcttttgattggtgtttgcatgatattttttttccatccatttactttttattttgagatacggtcttgctctgtcacacaggctggagtgcagtggcacaatcgtagctcaccataacctccaattcctgggctcaagcaatcctcctgcctcagcctcccaggtagctaggactacaggtgtgcactactgtgcctggttaattttccatttacctttaaactcactgtatcattactttgaattggaatagactgaaatgtgtctactccatcctgtctggaatgggaagtttgctctctgcactatttttgcaactcctgtctaaatttattatctcaaaatctcttaactcaaaataaaaaattaactcaaaatttaaaaattaactattaaaaaagcaagtatatgataaaaagagcagtttattaatgttcctacatatctggaaagtattaatttgagaaagagaaagaatcaacctatcattttgtgagattttcacttactgtactcttccagagtgaggaaacaaacaggctaagaaacgggtaaaacttacaagcctggggataattgggaggctgaccccctatctgtgggcccagaagaaagcaagtcactttgtaacaaggaagtatatctatttttcctcaaaagataaatattcaccacacctggtattcctggttttgccttgggagcggggagctgttttctcagtccttgcattttctagtctccctgcctggattttagtcatttcactacttattagcattctgaaaggttaacagaatttaaaatgtgtaactcgagaagaaataaaaggctaatcagttagttacaacacttgttagttctgtaaaagcaatgatgagtgagaaagctggaaagtactgactaaaatatggctttctgagaattagttgagttcagtcatttttgctgttcatgctccagtagccgccccaggaagccagatttggaaacagtacctgagtcatttgagacaaaacaacaagttacccctgaattgttttaaatgttaacgaaagagatcactaaaagatctaagtcatggatggaacctaattacctccccttggccctagaaaaccaaaaacatccagataggaatatgaaacacagaagaaagcaggtttttcctttctattcatttctcctattatcttagccctattttaattattctgagttaacgccattttacaaaaatggacagataaaaaattaaactcaaaattttgaaacaaagactctttgttgctgtgtgtggaaagtgaccatcttgtcaaaaaaatacctgtgagcctacagcatgattgattgttcaatgtgatgaaactttcctggaccctaagcctcaatattttgttatctgaaaatctgcagtttaatttcatccttcaagatcaaaggcaaataaattaacttggtctagtgattccacaaatctctagagagctgccaggcaaggcagatccacagaataactcattaacttataatgcttaaagcaactttgggaaaactgttaggaattgaacacaggctaaaactcctgaaggcactcaccaatgtatctttctacacagttgaccagaaaacagctaagctctgcttgactactccagtgaccaggagctcactatctaacaagcaatttattctaatgtctagacagctctaaacatatggatgattttctatgaacagaaaaaatctgccttttaacttccaaattctgcctttatgctggatttctttctgttaacaggttccaacctctctacctttattcccaaaccatctcttgaccctacttcatttttctctagctaatatccactttctttctttctttgccttctcttgcaaactcctcaaaaagtagtttacagtctgtaactccttccttactctcaatctctccttaattgcttctatctcaccagaattcttggaaaaatgtgcatacttcccaaccctcatctttaagtatctgtatgctgcatttgacacgctgatcactctggccttcttgaaactactcctttggcttccagaagcttttttcaagttccctgtgttgctaacactttttttcttcctctaaccatcttgtaggtgatggtggttccctgaagtgccctacccacatgcttatggctcccaaaacaaggtcctctggtccagagctggagatagaaaggaaaggcgaaagagacaggaaggtaggagggaaaagcaaagcaaagaaggaaggaagaaagaataggaaagatacatcaacaaaaagaaaaaagtcctgacaaccagatacatcaagctggaagacgatcaacactgaggaaactatgttctgttttccactagttcttcctaccttctaactggtctcagttggcaccttcctctatgccatcacaaaatctagaaaaatctctgaactctttcctatatcttaccctggaacatccaatcaattattaagccctgtcagttaacctctaaaataatcttccaaatcaatgttcctttcccatctcagctgtcattttcttagtttaggacctatctatttcctcaaacctagaatgcaagagcagtttcctaactggctttaaaagtcctaatcttgttgtccccaaatttaccctccacccaactgccagagacctatctaaaacacaaattggatcatgtgcctccacggtcaagagatttcaatggctgtcctttgctcctaggatctttattaaggtcctcatcaaggccaacacagccctccacaatcaagccatgtctacttctgcagctttatccctcaccacattctgccccagttttatgctcaaacaatgctgaacctctgcagttcctacctctaggctttataccatcccttctcccaggaggaccctcttcttgcttcctcacttttaaaacatataaactaattcttataaggctcagcaaacaggagccttatccttataaggcacagcaaatctcttctaggatgcctcccctactatgactcacccacactttgacaatcaacagcagtatgctctcagagtggcctgtgtatagtaccatcactaacttaaagtatttttaaccactaatattatcaaatctccgagaatgagttcctaccaggtatggactggactttaaaaattttgtaatggatgttattcttcctttatctctttgaaaatcttccagatttagacagtgagccaataatacatttgtccctggtcctaagtctctctctgctctcctgcctgccactctgaacagaagcaacatctttttactgtctctgttcatgggcaatctctgacttcacagtcagggatcatttcctccattcactgaatgttttaatcccattatctacagaaatacaattcccagccatctctacctttttctggacctaagagtccagaatgtccataactataggcctgtaactaataatcctcacttattgtctgatctgtttctggtccagagatttatactttcttgaccacagatatgtctaattttttactttattatcacttttaaagaaaggagatatgaatttaaagtatgaaatcagagccatcttgacgagaagccctcaagtttaaattttatgactattacacaaccttttagatcggggtcagcaaactacagcccatgggccaaatctagcatactgcttatttttagtatggcctggaggctaagaatggtttttacatttttaaatggttgaaaacaatttaaaaaatattttgtgacatataaaaattatgtgaaattcatatttcagtgtccataaacttttattggaacacacccatgaccattcacttatgctgttccagttactgactgttgtgcaacaaacaactgcaaaatttagtggcataaaaccaccaccactttatcacttcatgaattttgtgggtcaggaattcagataggcacagcagtgatgacttttttctactccacaatgtatgggacctcagttgggaagattcaaacagctggatcatctggagacgtcttcactcatctggcatctttgactgggatggctgggcttagcagagactacctccagagtgcctatctaaggcctctctggcataggtggcttctcaatagtcaaacttcttacatggcagctcaggagtcctagtatgagtgttccaatgaacaaggcagattgccttttatgatttagcctcagaagtctcatactctattgtattgaagtagtcacaagctcacccagatttaagtggaaggaggcacagatcctacctcccgaggagaagagaataaaaaaatttgcagctgtgttttaaaccttcatttatgggtttcacatcattttattgcaaggatccaggattaatgactgatttaaaatgtgatacacatccaggtctcagagcatccaagcttcaaaacaatttagcttcacaagaggaccatcatcagggtcatgacatgtgaacaattttaatactttcctatttgcttctggtcagtctttaattccaaacacatagaacacatgtgtttttaagtgttataggagtagactggtgccttaaaaaagagtaatttgtatctgtgtgatagatagcaaaaatggccccaattctttatccatgccctttccttatggatgctccttgaatctggactggctttgtggcttgcttagggcaatcgagtacagtatgaggtgatggtgtgccagttcagagcctaggcctcaagaggccttgctgcttctattcactcttagaaacctgaccaactaccatgagaacaagtctgggctagcctgctgcaggatgagagatgcatagctctgtgctcctacctcctaccactgccccagttgacagccgttggacttcaaaagcagagctccctgctgacctgtagttgaccataggcataaggggagaccagctgagaacagcagaactgctcagctgaacccagcccaaatgactgacccatagaatgaactaagtaattactattttaagccactaacttttgaagtggtcgttatacagcaatagttaactgacagaatttgaaacacagcttttaatgattaactgtagagtggaaatttcatcacaaacctcagtcgtactacactaaatcactttgggtactaattttccaaagtaggcattactgctgggatccacagaggaaggcactgtagctaatgccaagatcacagatgggtcaagcacttgacccaaaagaagtacataacagcagccatacgagtagcaaatgtcactctatctggaagtttctaatcctgtctgatgccaaggcagccataaggtacctcccctgtccagagataagcgtggcacctgcaaccagtggttaactatttaactggaatgtcagagtaacacatcagagcacccctataatcccagcactttgggaggccgaggcgggtggaccacaaggtcaggagttcgagaccagcctggccaacatggtgaaaccccgtctctactaacaatacaaaaattagctgggcgtggcggcaggcacgcataatcccagctacttgggaggcttaggcaggagaatcgtttgaacctgggaggcagaggttgcagtgagcggagactgagccagtgcacttcagcctgggagacagggcaagactctttctccaaaaaaaaaaaaaaaattagtttatattaggttgaaccatatgaaactgccattgttgcaagtcaaaatgtttgcatatcagcaatttcatagggttcaatctaatactgcaggatttggctcatgaacaaaaataagcaaaaaataaaagcttccttcctttgcttctcttagtctccaaagccctcacatattctagagaagtttaattcctatgaacttttaaggacatatattaagaaatacataaagcctcgcttataaatacatttttttttctcaattcaaaacacctagtttcctttaggagttgtattccacttaccagacttaaggtaattagcctgtgggtccccagtggagtattaggtctctctacctacatctcaaatttctagatcagatctgagcaccctcttttcatgtgccatttgtacacggcgaaccaggattccagaatgttgtttaacacaagaggaggttgttgacaaaaaagtattctgattattactatcagtgtgtgcttggtgtcagtggggggaggatatatttgattttattctagtttctgctttttctgccccagagttgcaaccagatggctagactatcatctctgggtctcttgtcagtcagagcaggagaagcctaagaggcaggattcctacccctgcatatgtgactagagtggtgaggcagttttcctccatcttcctgggcagccacaacaagaccctgtgaggaggcgcaggtgcttcgaataactggcactctcccaggccacagccgaagccacatgctcagaacagaggctcaattttaatccttctgagacaccatttcagggattggccaatatacaaacatgtaatcaatgtaatgcttttgtgtgctcgtgtgggtcttgagcttgtgaattttttgcattaacggttttagaattttctgcctagaaatttttagaattacccaagtataaacgcagtcttttttatggtaaatgttatttcatgagaaacactgcatacataatttcagcttcaatggtcagaagatcctgtgctttcaagcttactgttagaaatgcaaaacagggacaccaaaactccatcatcccacctcagttccctcagtacaggatgtttccctccttcaaaggttttttataagatctttcgtccagtgtattttacataaccagctttctctatttcccaaagaaaattattgcacagtctaattaagttttcccttaggaaacaccactcctgacacacaaaggaagacaaaacaatggtggcagactgtggaaacagaaatatttcatttttaccagctgaaaaactataaaaattaaaactacccctaagctattaatatgcaacgatttgaaatatcagcaattcacaggagactggtaaaaagtcctttgttcatttactgtttttatcaagttctgaattcagaaccccacataactactttgacaactgatagcatcacaaccacctaaaaacaagttcagagcgttccgttgtagacagtataaatgatgcttgtttttgcatgatctgtctcagaagtacagccaaggaggaactaagtctcacatgttcactctcacagggcccatcaaagaactcaataaagatctgatgaaggaacttaggctggaatttggaaaatgtggataacaccaatttctagtccattatcatattatttttattataatggctttgtagtaagttttaatttgataaagcaaactcccctcacaaattttcctgcttctggggcatttattctttccaaaatgcaaacctgattatgatacttgatgtaaaacccttctgttgcttcccagtgctcacagactcccttttaggcccctgcagaactgcggtttagtagagtggagagtgcgagtttagggtgaaatctgactgctcaacaggagagtcactgccaccatcagagaacctctctctctgacctggttccttaccaggctcactctctcctttaaatatgcattgaacaaataatggtttttgcaagggtgctgtgtaaggggttcccaagatcacccctaggttcagtgattcacaaggaagactcacaggattcggcatataatcatactcatggctatgatttattacactgtaaggatacaaagcaaaattagcaaagggaaaaggctcatgggatgcagtgcaggggagacaaggcacaagcttctaagagtcctctcctagtgcatacacagaacacaatttccctagcaacaagttgtgatgatacatgtgaaatgttgtctactagggaagcccactagagactctgccccagggtttttattggtgactggtcacataggcaccctctgactggtacagaccaaaattttagacttcaagaaataaagcaggtattcagcataaaccatattacttgtataaacaattccggcacaatgagccacccttatccgttctgggaaggtcaagaaccatccccaaaataaagttcttattcgccagcccagagtcaaccttgtaagcaggccttttcaaagtcaggtctgctatgataacatttttttttttttttgttgcacagatgccaatcattagcttggctgggcacctacacattctgcccagacctggatggggtaaacaaaactgtgacagtactctgagcaggggactaagggaacaggaatagaggaacacccatccttttccagtggcttgaaagaaggggcaatgaggactgcttcttgggagaggcaatgcctgagcccagtttgaacatgatagatattgtggtgtccatagatttaaatgctaaccaggtaagtgagcttggtaaattaatgagactaagctgtatctcagaaagtgagttacccatatggaccagggctattaatcactttgattccctgctttaaactttgtatggcttctaaatctcctgcaaagcatgcagctctgtcagaggtggtgccaacctaattttccagtcctacctgtgatactctgccccttcagtctctgtggtcccaacatccggtattcttttcagtgcctggagtatgttcctttctacctccaatactatcctaccccctactctggactgctcatcatcaccctatcctacttcacatggctatctcctagtcatgtcagatttcaatccaaacaacatttcctcaggatagccttctgtcccctaccccagagtaggtagggacccatgtcatttgcttcccagcaccaagtaacttctcctttatcactgtgggcacattaaagtccatttccttacacattgacacttcaagagggcagagactatgcctgtgttgttcactgtgataaccacagagcctaacacggtgcctggtacatactgggcactcatcaaacatatgaatgaagaatgaatcagggctcactccccttccccaacactacacacctcctgtgtctaaggcacatggcctaagctaggtcgacaagtcagccaagtgttttgacagaggtattgggaaagaggcactgcattgctacagatacagtctgcctgagagtgaaactaaatcacaggaacacacaggtgagaaaaggagatttggggctgcaataacagcctggatgttgccattcctaaagtcagcagcctgtggacttcatttaccagtaaaccctctttctgttacttaggctaatttaagtcaggactctgagatgtataactaagaatccttatagaaaaatagtaactggaattaggcacgtggttggtcctaaagaacaagagaaagactaccaggaagcctaacttgtgatgtcccaagctactggcctagggagtccttacagttccttaaattataaaaagggttggttattgttcagggagaaaagatgccctggctgggaagtagagcacaagcatcctggctggtcattatcctaaaaactactttatttgtggaaactcaaaccagatctcccaataggctacagagagacaaaaatctcccttattttcaatgggggtagatataattattgcaaataaaaagcttgaatatcacttcaaactagattctaaaccacattaataaagcattggctggataagcacttgaaaaagaaaacagtcactagcagccagcataggctctctaagaacatgacacacccaacttactttaggctcttttctgttccagtcactcatttattgagaaaattgtttataggtacagtaatacgtggaggcagctgacaggattttcctgctgatagattaaaaaaaatgcaggctgcaggcaggtaatcctgaaggtaggagtcttctggtgggacacagagctatgcccttggccctatcttgatcaaaactttgatgagtaacatagatgaatttagggttattgaccctaagagggataacattcatcaaagaaaagaggagaattcaaaagcaaatattataagcaaaaacaggatgaaatttaactagaacatatgtaaagtcactgcaattaaattgtttcccaaatacaggatgatagcagtttcagcttttgatgtcagtaaacaccacagtttagtgatgcagctactaaactcgggctgaattcagaaacataatgtctacctcagttggacaacaactggacaaccatgttccaatctgagtaccattaatggtgaccaatgaaagtgcatccagagaggggaaccaagactagaaaaagtttggggatcatatcacataaatgaccattgaaagggtgagagatggtgtagccgcctgggaaagcaaagacagaatcctataaaactgaaaatatccaaaccctatgacccagcaatcctatttctaaacatatatctggagaaactctcacaaatttgcacaatgatcaacatagaactgtttataaaagcaaaattcagaaagtagttaggtttccatcaatagaacggctagacagaataaggttcattcatactctggaatactttgcagcagttaaaaacaatgaagtgggtctataatcaatcaggatagactaagtttgccaaggtaacaaaaggaacctaaaatctgagtggcttaacacaaccaaagtctgtttattccgtatgctacatatttaaagtgagttggtaggagagcttattgtagttattcttgacctaagctgtcagaagctccatctctaccggccaggggaatggaatgtggcaaatctcatattagctcttaaaatttccatttggaagtgcattcattacttttactgacatttcaatgaccaaagcaagtcacagggccacgcctaacctcaaaagggacaggaactacaatcctaccacatgcccaaatggcagacagccaaaaacatcatgtgacatataataatacatactatgcaaagattaatagaaaacatatgaaaagatctaagatattttgctgtgtagaaaaaacagacacattcataataccaccatttatgtaaattaaaacatagatccaaaacaaatctatatatcgtttatatctatctatctatctatctatctatctatctatctatctatctaatctatctgaaactgaggagggaggaggatgacattagaagaggtgaccaaaggagaaataagcatttctgtaatgttttagtccctttatttaaaaatggtggctcatgcctataatcccggcactttgggaggctgaggcaggtggactgcttgagctcaggagtttgagatcagccttggcaacatggagaaacctcatttctaccaaaaattaaaaaaaaattagctggaagtggtggtgcacatctgtggtcccagctactcaggaggctgaggtgggaggctcactggagcccgggaggcagaggtttcagtgagccgagatcatgccactgcactccagcctgggcaacagagaccctgagaaagaaaagaaaagaaaaaagaaaggaaaggggaggggaggggaaggggaaggggagaaaacaaaggggaaaaggaaaaggaaagaaaagaaagaaaaaaaagaaaaaaggaaggaaggaaagaaagaaaggaaaggaagggaaggaagaaagtagctgggcatagtgatgcacacctgcagtaccagctacttgggagtctgaggtgggaggatcgcttgagcccaggagttcgaggctgcactgagccatgattgcgccaccgcactccagcctgggtgacagagtgaaaccctgtctctaaaataaacaagcaagaaaaaaagaaaaaaagatattacaaaatcttaattgttgataattctggctggtagagaatatgagtatttatcatattattctttgaatttttccattatattaaaatccttgaaataagttgttacatgaatcagaaatgttttagcttaaaaggccacgggggccaagcgcggtggctcagcctgtaatcccagcactttgggaggccgaggcaggtggatcacttgaggtcacgagttcaaggccagcctggccaacatggtgaaaccccttgtctactaaaaatacaaaaattagccaggtgtggtggtgtgtgcctctaatcccagctacttgggaggctgaggcaggagaatcacttgaacccgggaggcagaggtttcagtgagccaagatggcaccactacactccagcctgggcaacagagcgagactctgtctcaaacaaaacaaaacaaaacacacaaaaaaaggccacgggtgggagaaaggggaatgggaagtaggaaaatagatagctttaaatattttggacaaaagagatttgctgtgtgtgactatggagaggagagccaggaatgatactgacagttcctgaaaggcagattttggcttgggaataaagaaccaccaatctattaaggtttttggtcttattttttttagtagcctcaaaactgtatggaggaaaaatatgtattctttggggtaaaaaataatgttgtcaagagtcagacaaccacctgtctgacaaatactgtggcaaggattcctgcactgggaaggaatttggatttggtaatctccaagttccctacaattctcaggttccatcaaccttggactggaacctctcagtttctaaattctagttcacaggctctgggaaatgcaccacagttatcccaaggaaaacttcaaaagataatgcaacagtctgaacacaatacaaatctgaattgtgttacctgggaatatttcacaatcaataaggaataaatcacttaattgggactaatagttattataggcaagagagtcacaagaattatactggccttgaataaagctagctttaattctcacaccccgatcaaccttatgcacataattaaatcagtattatttggagaactattgcctgtttaattactgtttctgtgacttgttatttgttctcccagtaccaaaggcaaattgctcccacagctaaagagatctccacagaaacatcccactgaaataaacattcctttataaaatggaagagtaagaataatgaatgtgttttcttttaaactagttgctttggctgctgtcaaaagaaaaaataaaagtcttagcaatggaaaacaagtatcacttctatgaggagggccagtctggcataaagatagtgaggtaaaaactcaagcagctctctgctgctaccctgctcccagccaagaagataagggatttcaataggagtaaatgagacaacatgttatagctgaggattttctttcaaaaaggtaccataccttttaaaccagtaaggttctttgctgtacacagttaatatatgcctagaaggttataagttgagcagcctttgcatgcctggaacctgacagatctcaacagacacctgggaagcccactgtggcttttaaagaatgcatatttctggctgggtgcggtggctcacacctataatcctagcactttgggaggccaaggtgggcagatcacttgaggtcaggagtttgagaccagcctggccaacatggcgaaactttgtctctattaaaaatataaaaattagctgggtgtggtggtgcatgcctgtaatcccagctactcaggaggctgaggtaggagaatagcttgaacccgggaggcagaggctgcagcgagccgagatcgcaccactgcactccagcctgggcaacaaagtgagactccatctcaaaaaataaaaataaaaataaaaaataaagaatgcatatttctaccacaaaaatactgaaagcatgctgcaacataaaaacatgtgctctgcccatgtgtttttgctcgtttaggatttccttccttcagtgattctgtaccacataactaacaataggaaatactttcataaaagtgactgttatttagtagtttcttctattaactttcaaaactaaaaccaaaccaaacaaaaccaaaaaacagcccacaaagctcttaaatattcccaagttaatgaggttagtatggcttaaatataccttctttctagacccacattcctgactgtgctggagtttcatgtgtcctggtctctgttacccaccagaaataccatgtgaggcagaaagccccaatatgctggaaaagcagctgcctagaccaccacaatgccttgcagagacacagttggggccctaatctatgagcaaaacctgattcccacccccctccaggtttctccatccttcaaatgcaagcacttaacatcctaaaatgtcacaaagcagtgcatttatccttgggagatagaatttggtgataaaatgcaagactgtaatgttaggaaggacagagtgtggggaaagccagagacaaacaggagagggaggaggagaaaggggttgaggaatgaagttctgcagggcaaaggttactggaaaacagcaggacagaagcaagagactacgacagagaggcagggccaaggaaaacaacgaggtcaatgatatgctacacaaagacaaagaactgtgcttccagatgagattaccacatatgcctttagagaagtggttctgtttttcagggggtcattatgtattcagccaatagtgcagctaatctgcttactcttagcaacttttgtccacctaactgcaccaaacactacatatctgaaactattatttcagagatataaatactttaagggggagggaaagcaacccaaaacatccattaaaatatcagtgaagacttccggttccaagtaagatggtataaacacacacgtaacctttctgttgaccaaatgcaactataaaatctgtaaagaaaatatgggcaactattagagaactcttaaaagtatataacagcaggcgatcaagaaagaatgccagaatgcggagtacaactgaactggcagtgacttaaccactttttttcttccagtattcactggcctgaattcaacacaatgaaatctgaaagtgagcactgtggttagagcacatgttctggttcaaggtgcttttttggaaaagggaactactaatgctcagagaaactggagtggtgaggtggcggtggggggcggtggggggggaatcccctgggtttttctctcctttttctcccctttctaatgtctagaaaatcccatggtagaggctgtggcagcagcaacaaaaagtaactggcatagggagactgtacgagctaaaactctgaaagagagagaagaaacttctgtccatttggtggaactatggctccaaaagggcaaagccaaatcccattgctttttttttttttgagacagtctcgctctgtcacccaggctggactgcagcgatattggctcactgccacctctgcctcctgggctcaagagattctcctgcctcagcctcctgagtagctgggattacaggcacacaccaccatgcccggctaaattttatattttcagtagagatggggtttcaccatgttggccaggctggtctcaaactcctgacctcacgtgatccatacgcctcggcctcccaaagtgctgggattacaggcgtgagccaccgcacctggcctcccattgatttttcctactttttttctctctgtttgcctgccccttgtgccctagaggcagtgtattgtgaaagtgtgtagtttctcactggaggactaaaaaggaaagccctggaaaagtagaaagtaccagagaaataacaacgaaggaagagctcaggaaaacaaactcacaaaaagttgcttacaaactcctgggaaggcctccacttcctcacaggtggatctgattctaattagcatatcaaagacttggagaaatgagttaacacacacttaggtccctgactgacaggtgggtggcacacacacgacagaggtgaacagcactgcaaagccattgaatactgaactgatatttgaactacaccccacagaaagtgagatggaacttgcagtctgaacctaaccagaccaactgctgctgaaacaaatacattgacattctccatggggttgaaacaagatccagagtctcataacataatatccaaaacatccaggataaaatccaaaattatgcgatatacaaagaaccatgaaaatgccagctcacatgagaaaagacaacagatgccaacaatgagatgacacaaatgttgaaattatctaacaaggactttaaagcagctactctaaaaatgctcagattgccatgcatggtggtctgcacctatagtttcagctacccaggaggctgaggtgggcagatcacttgagcccaggagtttgagtccagcctgggcaatagaacaagatcttgcttctaaaacaaccaccaccacacactcaaacaggcaatcaccaaacctgaacactcttgaaagaatgttaaaatagaaaatatcagtaaaaagaagatataatgataaccaaatggaaactctagaactgaaaaaacaaccgaaataaaaattaactggaagaacacaacagcagaatggaggaggcaggcaacctgaagacagataaactggccaatctaaacgaaaaaaagattggaaaaaaaaaataacaaagcctcagggacctgtgggataacaataaaggatctaacatctaacatttgtataactagaatctaacacagagacgaaaaagagtgtgatgataattttttttttttttttttttgagacggagtctcactctgttgccaggctggagtgcagtggtgcaatctccgctcaccgcaacctccacctcccgggttcaagcaattctcctgcctcagcctcccaagtagctgggactacaggcgcatgccaccatgcctggctaatttttgtatttttagtagagacggggtttcaccatgttggccaggctggtctgaaactcctgacctcaagtgatccgctagcctcacctcccaacgtggtgggataaacaggggaaaactcccgcgccagttgtaatttttggatatatgtacttaaatttaggaatgtgctgcaaaatttttaaaagttattggaactggggctttttttttaaaagacataaagctggccgggcaaatttggtcacgcctttaatcccagcattttggacggttttggcgggcagatcacgaggtcaggaggttgagaccctcttggctaaaacggtgaaaccttgtttttactaaaaaagacaaaaaatttcccgggggtggtggcgggcgcctgtagtcccagttaattgggaggctgaggcaggagaatggcgtgaacctgggaggcggggtttgcagtgagctgagattgggcatttgcactcccccctggggtacagtgggtgtcttctttttaaaaaaaaaaaaaaagacataaagcagattttaatttagaaagggctagcaccattaaaatctgtcaagataacattatagagttgaccaccgagtgaggtctatagcagccaaacagtgagctgagaaattagggattggggtggggagtgttaggagagtgataattcaattgtattcttcaaattttcaatattctttctttcagtaaacattttttttagtttagaccggaggttgacaaatcagcgtgtgagctaaatctagcttgtcacttattttgatatggcctacaagcatacagaatggtttttacatttttaaatcattgaaaaataatgaaaggaagaataatatttcataacacatgaaaattatatgaaattcaaatagtataataaagtttttttttcttttttgagacagagtctcactctgttgcccaggctggagtgcagtgcatgatcttggctcactgcgacctccacctcctgggttcaagcaattctcatgcctcagcttcctgaatagctgggattataggcattcaccaccacgcctggctaatttttgtattttaagtagagatgtggttttgccgtgttgtccaggctgatctcgaactcctgacctcaggttatctgtctgcctcggcctcccaaaatgctgggattacaggcgtgagccactgcacccggccacaagttttgatatgctgtattttcatctacattcaggcattcaagtcactgtattgagagaagtgtgatgtttagtttccaagtgtttggagaacttgtagtctttctgtttttttctttttttgagacagtctcactctgtcgcccaggctggagtgcagtggcacgatctcggctcactgcaatctccgcctcccaggttaaagcatttcttgtgcctcagcctcccgagcagctgggattacaggcatgtgccccatgcctggctaatttttgtatttttagtagagaggggatttcaccatgttggccaggctggtctcaaacccctgatctcaggtgatccactgcctcagtgtcccaaagtgctaggattataggcgtgagccaccgcgcccggctggaataaagttttattccgaagagagttgtgttcatttgtttatgtactgtctatggctgccttcatgctacaatggcagatttgagtagttgtgacagagaccatgtggccctcaaagccaaagatatttcctatctggtcctttacagaaaaagttgggtgacccctggtttagacacacttcccaacctggccttctcatgcaaggtgatttctactcacagagtttgaaattcccaaataatttgctaacaagtctttatattaaagagggtaagcctggttcctggtgacagagataattgtggttgacaaagaaatacttgtctgtggcaggaatctgcctaggtaaatttgtatgttcttcctttatttttccttggatgttttttgagggctttggaaaagagttgacctccagactcctcatctggtcacaagattcatgagtcatatggtatatcttaattttaaaaaataagctttgaaatgctgagataaagtcttcatttagaaaagttcattatcccaacttctgctatctctttcaaagatttgttaggggtgaggagaagcagtgacatatgtagaatatgttctcttcttattttttgtttattcaatctctagatagatgtttatggctttaattactggactactgagaagtggtagaaatgaaagatacacaagatgaacagatttgaaggatagagttttgtttccatgacattgaagcagggatagaattgttttgtagagaggggtgaattctgaattaaagcacaggcacttaaactgtcttactatagaggttaggattgtttgccccaaagcagaggataatcagctcaagaaacacatttatagcattcatgacttctatttaagaaatagttggccggacgtggtggcttatgcctgtaatcccagcactttgggaggccgaagtgggtggatcacctgaggtcaggagttcgagaccagcctgaccaacatgacaaaaccccatctctactaaaaatacaaaattaaccaggtatggtggtgcatgcctgcaatcccagctactagggaggctgaggcaggacaatcgcttgaaccagggaggcggaggttgcagtgagccaagattgcgctattgcactccagcctgggcaacaagagcgaaactccatctcagaaaacaaaacaaaacaaaacaaaacaaagaaatagtttgggccgggtgcagtagctcacgcctgtaatcccagcactttgggaggcccaggcgggcggatcatttgaggtcaggagttcgagaccagcctgaccaacatggtgaaaccccgtctctactaaaaatacaaaaaaattagctgggtgtggtggcgcatgcctgtagtcccagtcctcgggaggctgagacaggagaattgcttgaacctgggaggcggaggttgcagtgagccaagatcgcgccactgtactccagcttgggcgacagagtgagactctgtctcaaaaaaaaaaagtttgggaggttctttgaccacatgggcaggaattcacccttcgggatataagaaacatgctgctctggtctgaccagtggcttaactgaaatgtctgtctctgataatggctctgaatattttcctgaaagcctaagggagctagactttcagatgtttctttccttaaggattacttccaaataccatcacagatttattctgatttttatctcagtccttcttgaacttgtttacattttcattttgtttcacttcttgaactgatgagttctctaagttagttccctaagcatggctgaaagtcctgttttccttttgataaaattgcctttaggtttcagggaatacccctttgttatttaattctataattggatgaataaaatcaagctgatcatttctacactcttcttaatagctcattgatttctgtttcatccctttagagcaagatttctcagccttggcactgttgacattttgagccagataagtctgcacattgtaggggactatttctgtgccttgtaggatgtttaacggcatccctcctgacctctatccctagatgccagtaacatcaattattgtgataaccgataaatgtctccagatattgccaaatgtcccctgggggggcaaaattgtcttcagttaagaatcactgcttagatctttggcttttccaaaatgcaaagtctgtgcgactgtcttgatgacacagagatgtctctgtttaattgattatattgcacttttctggatttctttcagctctggttaatgtccatcttgaatgacagtgatggccacttttatagtttcaatgtttcaagtcagctgaatcatttgggagtgacatgggaacagatatcttgaaatcttagaaaagtattttttccggttgtaaacgtcctatatgtttactctaaaactgtggggaatggaaaaattcagaaagaatgtttttatcaaccagaaatctgtcacttcagtgcaactaatgttagtaaattggtttatggtttttgctttctatatattttatttcatacatgtatagtaatttcactgtaaaaccaatttttatacattttaaaacaacttagcataaatgtttccctgtataccatgtttaaatgactggatgaaataccataatattaatgtaccttaattattcctcttttgtgtgataggtcggttttatttttattataaagttttaatggacattttggttcataaatcattttccgtgtttcaaattatttttctttcttttttctttttcttttttttttttttttttttttttgggacagagtctcgctctgtcacccaggctggtgtgcagtggcatgatctcagctcactgcaacctccgcctcccaggttcaagcgattctcatgcctcagcctcctgagtggctgggattacaggcacctgccaccacacccagctaatttttgtatttttagtagagacgcggtttcaccatgttggccaggctggtctcgaagttatctgatcctggcctcaagtgatctgcccacctcgaccttccaaagttctgggattataggcgtgaaccaccgtgcccagcctgtattaattttcaaggacgaatgttagaaatagaattcctaggtcaaacggtgtgaatatgtttaaagtagagcattattttttaaactgctacatggccctgcagagggcagtgaataggggccccttgcactgaccatgcatttcaaaagtatgtctcatgggtatatagtaggaaaggaaagggctatgtttgagctaatcacttttcctttccttggcctgcatgttcttccgtgggaatattaatggggagtcaagtagccaccaaaccgcaggcttaggttccagtcccaaataatcccagttgggttgacttccagacagtcctcctttaaaagggtattttactcaaggaagacatttactccagacatttgtattttgcctggtttgcagtcactgttaaaccactgtgctgttaattattgtacttgagatgatagtaggaataagatctgaaaactgccatcaaattactgttcccagtggtgcaaggtgaggtctagtgtacattttgtttctgccaaaatgaaggtaaggaagaaaagaatgcctttataaagtctgtgctctgatctgaggactagaaaataaacagctgaataatataaccaagtgtaagacatcgagatatatcacagttactctaggattacactatactgatttatggttttgtttaacaaaacattttattctaaggtaatttttttcatggtacaaataaatttatttgcttgttttatgttccttattcctcttttcttcccaagaagttactttgacaatcacagaccttattgggcctctttcccttctagttcttaaatgaatattcatgacagggacatcacagaaaacaattgtttgccgtatgctttcaggtgtcatcaagcatcatgctcagcccctgggctgctgtgactttgagatctgcctggtcaactaaagagggctagtccttctatggggcttttctttcttaaaaaaatttttttgacatacaaaaagctgtacatagttaatatatacaactagatgagtttggctgggtgtggtggctcacgcctgcaatcccagcactttgggaggccaaggtgggtgaatcacttgaggtcaggagttggagaccagcctggccagcatggtgaaaccccatctctactaaaaatacaaaaactagccaggtgtggcagagcatgcctgtaattccagctactcaggggctgaggcatgagaatcgcctgaattcgggaggcagaggttgcagtgagctgagattgcaccactgcactctagcctgggtgacggagtgagactctgtctcaaaaacaacaacagctactaaatgagtttggagataagtatatacctataaactatcatcacaatctatgccataaacctatctatcacccccaaaagtttccctttgctctattcttctgtcgtggtaagaacacaatataaaggcctatcctgttagcaaacttttaggtatacaatatagtattgttaactatagcactctgctgtacaaaagatctctaggacttaccttaaattaagtagtacattcttaaaattaccacttaataaggattcacatgttaagtaggggtgcctagaagcagaacctgagacagtattcaaatgcacatgatttattgaggagtgttctcaggagaaacctgtaaggggaagagggtaaccgggtaaggaaggagcagccagttagggtcttaagaaaatctagccatagcctgtttgaggtgatggcagaacaattattgactgcaggctgcctctgggagggagactggaagagtgtaatccccagttcttgggaagagaggggccattgtgagccattagcagccaacaagaagtagctggaaaatgggtacagtatgctagctaggtaaacaggattgggtgggggcagcacagtgtgttattcctttgcctgtttattttgtgcaggatactgtgctaagagctaggggtaaaaaatgaatgtgacacagtccctgctttcaagatgcttgtggtctagtgacaacagggctgaccatgtaaagcagcagtgtccaatcttttggctgccctaggccacattggaagaattctcttgggtcacacataaaatgcactaacacctaacgatagctgatgagctttaaagaatcacaaaaaaaatctcagtgtttaaagaaagtttatgaatgtgtgtttggtggcattcacagccgtcctgtgccacatgcaggctgcgggttggacaagcttgatgtaaagaatattgatggtgcaagtgaggtgcttctttgcatgtacttggatggaaagcaaaggagtgaataattgtgggggagggacgtctgggaagcttcatcgaggacatccaatgaatgaatagaaccagggttggggaaaatgggctggtcaaggaaaacatggggaggaattgtaggtagaaggaagagccctgtgcaaaggctggcaagcaagtatgaaacaagacgaacgtgttcccggaatcacatggggcatagtatatgccaaacaattggagtggattggggggaacagcagttgatgaggcctgagagactgggagccagaactgggcctcgcaagccatgctgaggagattgggcttagaaggggcaccattcttgctgtcatccctccagcctgtcctctggcttctggatcaacttggagtgctcattgtcaatgtacctgactgccccctggtggccatgttgctctaagcatgtcgctttaatgcttctgagccccaatttcctcatctgtaaaatggctgctgctgctatgtgtaggactgttgttgtgcttagaaataataaatagagatataaagatttaccatcattgaattattctgctgatatttattgttttctgtcattttcctacaataattaaaacagcagtatgtcacagaaatggacagacaaatcactggactttaaacagcccatacccaaaaattaacttgctttgttttcttttctaaaagtcattgatgactcattttcttatttcccaggactggtgtaactcgtattagataatctgtttcctaggctttttactgataatacaagattttttgtttccatctataataaaaaatagttgttactgtaattgttttaaaaatgccaaattttgcctattctttaaaatctccctctgtcaagaacagtttgataactcttttacttaaagaacagaatattatagaaaatggagaaactgttttatccaaagtacacatacccagaacttcagatgagaggagtatccatctcacaagaagtcttaggtcttctgaaactctcagggaggtgaggagagagggtccatggtcagttggctttcttcactgagatttttagagaataaaactgttttttctatgacatttgttgcccttgatcccatcatgagtcatccatatggaggttatattcagtgggaacataaactttcatttctctgggataaatgcccaggagtgcaattgctgagtcatagttgcatatttaatttttaaagaaatgaccgaaatattttctagaatagctatactattttacattcccacaagccatgtacgagtgatatagtttctctacactttctccatgatttgatattttcactatttctttatttcagctattgtaataataagtatgtaataatatcttgtggttttaactggcatttccctaatggctggtgatactgaatgtcttttcacgggcttaaatgccatttgcgttcctctttggtaaaatgtctgctgattttttttttttttttttttttttttgagacagagtctcgctgtcacccaggctggagtacagtgatgcaatctaggctcactgcaacctccgcctcccaggttcaagcaattctcatgcctcagcctcccgagtagctgggattacaggtgcatgccaccacacccagctaatttttgtatttttagtacagacggggtttcaccatgttggccaggctggtctcgaactcctgacctcaaatgatccgtccgccttagcctcccaaagtgctgggattacaggtgcgagccaccatgcccggcccatctcttgatttttaattaggtcatttgtttccttactgttgaatttttagagttccttatgcattctgtaatataagttcattgtcagatatgtgttttataataaatattacatgtataatatttctaagaaatgaccaaaatattttctagaatagcgattcctttttacattcccaccagcaatgtatgagtgatagtttcttcacatcttctccagcatttgatattacacgtgtgtgtaatatgtgtaaatattctgtcccattctgcttgcttttgcgtcttcttaacaggggctttctcagagcagaagtttttttaaaaatataagtagatagtttatttgggccaagtttgaagaccacaacccagcagcatagattcaagttgccctggatatgcttctgagagcaaaagtctttaattttgatgaaaacacatttttctttgccaatcatgctttaggtatcaagtctgagaactctttgcttagccctagatcctgaagactttctcttatgctttttgtaaatattttataattttacatttttcatttaagtctgtgatccattttgagttacattttgtatattaggttgtggtaggcagagatgtccgtgtcctaatctctgcaacctatgaatatgttaagattgctatttagctgactataaaatagggacattatcctggattatctgggtgggtccaatgtaattacatgggttcttaaaagtggaagagggaagcagaacagaagggtcagagaatgagatgcgatgacagaaacaggatcagagagattcagtgttgtttgccttgaagatggaagaagacagccgagatcaagggagtaagagtgtcctctaaaagctgtaataggcaaggaaatgagttctcccctgtagcctctagaaaggaacgcagtcctgatgacatcttgattttagctcggtgagacctgtgtcaaaatcctgacccactaaactataagatagtaaatttatgtagttttaagccactgagtttgtgataatttgttactgtaacgttagaaaactaataggtgttttagaaaagcttctattaaaataggattttatacatttgggtatactgtgtatctgaacaatttttatatatgcaacatccccatgatatcagataaatgaagtgctactctaagtagatctgtgcattcagtggggaatagttagaaaatgtattacttttatttctgcttaaatttctacattcattgtgactttaaattccccactactactttttaataggaagtgtcttgttgttactgttggttttgtttgcgtttcagaagagatttgaatgaaattttgcaccagagagccaaatgtagccccaaaaatttatgtgatgggaggctcttttttaaaaatattcaattgactttgactataggacaaacagaaccttagttaatggttctgattcttgtactaattttattagttttttaaatgacagctttgagatataatttgtataccatgcagcttacccacttaaagtatacaattcagttattttaatatattcacagatatgtgcaaccaatcaccaaaggacacaatatgttttcacactgtcttctaattttgtttctgagaaattagctgttaattttattggagttctcttgtaagtgatgagttgttttttttcccgggctgctttcaagattttctccttgtctttggctttcagtaattttactatgaggaatctctttctggatctctttgcatttatcctacttggagttctttgagtttcctgaatatgtaaattaatgtttttcagtaaatttggggagtttttctaatattttttctgctcctttctcattcacttttccttttggtactcccattatgtatatgttgatgaacttaatgatgttctacatttctctgaggctgtttcttcttcttttttccatctgttcttcaacttgcctaatcactgttgacctacttcaagttcattaattcttttttctgcttgttcaatctactgttgaggcccttcagtgaatttttcatttcaattgtgctttcatcaccagaatttctatttggttattttttatacttcctatttctttattgatagtctctgttttgtaaaatattgtcatcataccttcctttacttctttaatcatggttttctttagttcttcgaacatatttatatggctaatttgaaggttttgcctgttaaatctgacatgtggttgtatgggtcatactttcctgtttctttgcatatctcttaagtttttgttggaaactgggcattttggataatatattgtaacaattgtgggtactacccctccaccagggttctttattattatttgcttgtttactgctttagtaactgcctggattattttattgaagtctatttcctcaacccccattctcaccctgcagtatgaagcctctaatgttgctcttcgggggtacaagcttgtgtatgcccacagtcaccctgggatgacagtgggtttggtgaggctctccttggctgtctctttacttgaccacaccatgctgttatggtctactaattgttgactggttgctcttgttttgtttttgtttttttgagatggagtttcactcttgtcgcccaggctggagtgcagtggcgcgatctcagctcactgcaacctccacctcccgggttcaagcagttctcctgactcagcctcccgagtagctgagattacaggcgcctgccaccattcccagctgctctgttgttttaatcatgtcctggaatataaattgctccacaaactgatccaatcaaattagggctcctttgaagatagttcctgagatctgtgtttgagatttcttctgaccgcaagaggctctttccctgctgtctctttctctggttctctctggcatattaggcagcctaggcttgaacttctgtacactcagttgcaaatgaagtcagtttcattgcaggagaattgaagccccctattctatgccctgcctctctccctgggaaaaatctttgagccacagctctggcgcagtggatggagataaatggtgagcttccctctgagtgtcagccccaggtctcccaggtttgcctcttctggtatagaacccccaccccacaaggtaacgccagagcaatcaaggctctggtattcttggtggcacaacacccaaggcatagcctccatcccatgagttgggggctaggtggaagaagggagcccccacctctcagccacattctcctggaacgtagcctcagcaaaagtagctgggaacgggataagagatgccgacatcctgttcttcccaggaagaaaggagcttggagctggggtagaaggaaccctgtgttcttggctactgtactctggcatgagatctttgctgggagggaagatggaggaagtggttctagatccaaatactgcagactttgactttactttatgaattttagtagattttctcgaataagtacttcatttgctgtatgcccttaaaaccatttccagagactttaaatggttgggttttttttaattgaaataactttcaccaattttgctgggaagagggtcgtccatggagctgctcacactgttatgccagaagtggaactctgtgagctttttaatgtaaaattttgttgctgctattcttaattgctcagagtggccttgtatttggatttctacctcctcagtagattgtaaatagcttgaaggcagtagccctgacctttattcattatggaatcatgatagcccctggtagcatgttgtatgttgtggcacataaaagaatgtcagtcactggctatattgctgtcttttcaagtttacattttcagcacttcgtttgtgacttaaagtgcttaactgtgtcttccttttttcttacactccagtgctagtgtgttcccagaagggtgatgcttcttttttatctgtcattggccatactcagggaagtacacttgaaccgttggaagttttagtccaaagcatttttatttacccttcacaatataggagctttgtttaacattccttgtagtgtatatataattttgactttaggctacttatttgggatatggggacaggaagagagtgagagagggataaagggcaggcagaaaatcagtgtggtcgtgttcttaaaggtggatgtgcctcacttgttctttcttcagccaactatgtctcatgcttttcaaccttggctcttgatggccctgccctcatgactgattttttctttcctgttcgtctcttattggggatcactggctggttatggccccatggctgccccaccctttgttttggtggacagtggccatgtggccacatctgaggctccagttagtgctgtaccactcatttgtggcttgggcttcctcctaaggctaatgtggcctttcttagtctttgacatgctttgtattgaaagatctggtagtactcttctgtcattattctaagtcatttgagaatattcttgacaaaaatcattcagtttgtatgatttgcttgctgctatttctgggatccatgggacagtgttgactgccctctgggatgggtgtgtgtgaactgttttattcagtgtttttctttttcccaggatgctccaggatgaaacgccataggcctgtcagcagcagtgacagttcagacgaaagtgagtagaaccggctggcagctggtaacctttctatctatatcccttgaggatttttcctttcatttgaggataaaccatttcatgcttttttcaatggttgaaaaatgtttctgagaaggaaaattcagggcaccattatcttatttaaatttcattagagatagataaattagaagaattgattgtgtgtggcatataacttttcacttttcatttacctaaataacaaaagccagatctagtaatgctttaacagagcttctctagaaagaagaaaagtacaagagcataaattgtaggccctgattctaattgtagcttaggtactaagtgtttgactgtgagtcaatcatcatttgtaaaaggcagtaaccttattagcaatagcctttggggaagtgctgaaggatacacagattacttgctccacatttgtagtttttccagttgtttttggagatactttttcttcaagtggaatatgaattgtgttattgcagaacattatgaggtgtgattataccaaatcagataatctcatccttagcattgttgaagcttttgcactgtaggagatcatctataaatgtcactaaactccattatgaggcactcttcagtgcagtttgactgttttcttcagtggtatgagctctctggtttctccatcatatttttcatattctcttgggtgacatttagttttatgacatttagttatattagtaggtaatgtgtctcagtatttttttctaattatctttcacaggtccttccacttcctttacttctggctcaatgtataggatcaagtcaaaaattccaaatgaacacaagaaacctgctgaggtgagatcgtattctcaatttttagacttaagctatagtttggatgcttgtcttccaaaacctcatgttgaaattatatcccaatgttggaggtgcaggcctaatgggagatgtttggatcatgggaatatatccctcataaatagattaatgccctcccagagcaggggggtaagtgagtttttcactccgttagttcccttcagagctggttgttacaaagagtctggcacctcctcccattctctcttgcttcgtctctggccatgtgatcacatatgctagctctcctttgccttccaccatgagtagaagcagcctgaggcccttaccagctgcccagtcttgaaccttccagccagcagaaccataagctaaataaacctcttttctttataaatacttagcctcaggtattcctttatagcaatactaaataaactaagacaacttttaaaaatataaatgtctgcctcctaactatataccaacaatacccagaatctgaagatgtgaagaataaagaatgtgtcagtgggtaggcttgttttctgatgaacttatttgttttccaagaaagatttcattttctatctcctttaggagaacaataatcttcacactgtgatttcattttgtgatttcaatcatcttcacactgtgatgacacatagtgcctggctttagaatattcctcccctaaccaggaagtcaaagagagccagactaggggaactgggaaggacctagagatctcctggcctatgattgggaaaagctaagttagcaggtgaggagagatagtacagaaaggtataggtgagtaggttgtagatggactacattaaagatcatatgggtcatggtctgtgaagctgtgatgggtccttacagcctttggatcactgctggcccagaaagagtaggtcaatccttatcaggctggtcatcttttccacaaagggcagcaaagtgccagcgttcctcttggacttgataatggtttagtggatcctacagactttcctctgtgataattaaatgataaaatgactttgtatatcttcacttctactatgagtagacttccttagctgtaaaggaacagagaatatattagttatgtattgctacattacaaattatcacaaaattcgtgtcttaaagcagcacacacttatatctcagtttctgtgggtcagtaatctgggcatgatgtgactagattctttgttcaggatctttcagggctgaaatcactgtggaaaatgggatgtgttctcacctggaggcttgcctagggaagaatttgccaccaagctcatgttgtaggcagaatttgtctccttggagctgaaggactgaggtttctgttttccttcttgcttttggcagagagcactctcagtttctaaaagccacttgtagtttcttgccacatggccttttccatagatcctctcacaacatggtagcgtacttattcagcgccagcaaggagagtctttccctccagtcagctaagatgtagtgttacataacataatataatcatgggagtggcatccccaccacatttgctatataatgtgacctaatcaaaggaatgacatcccatcatgtttgccatattctgttgtttagaagcaagtcacaggtcccactgccttagtagaaagggagtgactctttgtgggttacttttgggtgtgtccaccagagagcatttctctcttccttggaggtcacttttcatttgtttcttttgccagggatttttctgggcacaatagaatgtaagagtttatttatatatgtccatgtcatacagaaagacttagggaatataacacacataaacaggagtggaagaaatttcccacctgtctagaggagactttgactacagaatggtgagaaagaaacctcactacctacccttttaggacgacagctggttctaggacataaggcaattcaagggctttgggttttgaggcctactgcctcccaggcagtggtaatagtagtcttttttgttgcaagggataggggacctgggctgctgaaagcaaattgttttcgtttatatttaatattctgttataaaaaggaaaacctggtgatattgtaggacaaaactagcctttgcattagaagagcttgatcccatgttctgctttgctggcttatttcatctctctgagataatttgtcagcataacatggacattatcatacctatctctcatacctatcatttattgaagttttatgtgccaaaagctttacattaaatagtttgtttcccaaatttaaacaattatgagactctccttggatgcctgtttaaaataatgattccagacttaccccaccctgtgacactactgaattagtatttccaagaaaagtgcctgggatctggattttaaaaagtgactcaggtgatttttataatcaagcacgtcggggaagtaatatactcttgttctattcctccagtaacactataaagtaggtactttccggttttttgtttgtttgttttgcaggtgatgaggctcagagaagttacttgcccagggtcattaaaaaaaagcagaactgacattcaagtttttattcatcctgaatcttgttttattaaccagtatgcattggacatattatgtagggtacaataagtatatagtaaacatttgttgaaactttggcagttaagaaatatgggacagcaccagtgttttctcatgagtagttataatcaaagtttccataatggagtgagagcaaaactcaagattagagagaacaaacctggaattgaacaggggctgggaacccaggcagcaaggagaatatggtaggaacccttggtaaaagaagaaaagtaaaagttaagtgggaattggcaaaggtgacaagcacacactactcacaggtgagtctgaaggcagcctttgaggaatcagatggaaccactgtgaattctttcttcctatttggcccctgaaactgaagcaatattgccattggctgctttttatttatttacttattttgagacggagtctcgctctgtcgctcaggctagagtgcagtggtgcgatctcagctcactgcaacctccgcctcccaggttcaagcgattttcctgcctcagcctcccaagtagctgggagtacaggtgcctgccaccgtgcctgggtaatttttgtgtttttagtagagacagggttttaccatcttggtcaggctgttcttgaactcctgacctcgtgatccacccaccttggcctcccaaagtgctgggattacagacgtgagccactgcgccctgccgccattggctgcttttttcaaagcgtcagtttatgccctatttctgatagcagactatcacttttctctcaatttctgattttcctggccttacttgctgcacctgtttgcttcaaacagttgttttaaggttcacttaagaaatatgacatatttgtatgcttctttatttctgatgttcccatttttcttttttgttcatttgtttctgtttgaagaatttcctttagctgttattttaggataggtctgctggtgataaattcgcttagttttccttcatttgaggatgtcttgatttctccttcattcctgaaggatattttcacttgatatagaattctggtttcacagtacttttctttcagcacttggaaaatgttgtgctacttccttctggcctccatggtttctgatgagaaatctgcccccattcaaataggttgttctcctctaggtagtcatttctttcccagttgtttttgagatttttctttgtctttagtttttaaaagttagattatgatgtacctgggcatggatttcttttggcttatcctcttcgggctttagtcagcttcttgaatctgtagatttatatcttccactaagtttgggaaattttcagccattatttcttcaaatatttttcaactccaccttctttttcccctccttttggggcttcagttgcatgaatggtagatcttttgttattttcccacaggtccctcaggcacttttcttttttttttcagtgtatattctgttgaacagattgaataatttctcttgttcattggttccatcttctgtttgttaattccattcattagttgagcctatcttatgagtttgttatttcagtaattgcattattccatcctaaaatttccatttggttattctttatatatatattccatttcttcactgagactttctgtttttttgtttcaaaagtgtttgtaatttcttgttgaaacatttttatcatggatgttttaaaatccttgtcagataattctaacatctgtggatctcagtgttgatgcctgttgattgtctcttctcgttcccagttcttagtatgatgagtgattttcagttgtatcctggacttttttagtattatgtcattagacactgagtcttatttaaatcttctgttttagtagtcctctgctataaccaggcaagtggggaagaggggtcctgactctctactacctgttgtagaattcctgagctccccatcctagctctttcactctctgggaagcagcactggggagtctctactgcttcatagaggtggaaattcccaccactttgttgcccccactgatgatggagggtatggtggtagtgaaggtaccaccttattgatcagtgatggtgacagcccaggctccctacccagtctgccaacatcacattgaggaggagaggtgcctcattattgctgggagagagtgaacatcaagacctctcatgtggtgtacattgataccccaataatcaccctcttttaaaaaccatttttaacatcttttcttgaaatataattcttgtagcatacaattcacccattttaagtgtataattcagtgggttttagtatgttcagagttgtgtaaccattacaatcataatttagaacattttcatcatctcagaaagaaaccccttacccattagcagttactccccaatctccctacctgcaacccctggcaaccactaatttaccttccttctctatggatttgcctattctagacatttcatataaatggaatcatacaatacgtgccctttgtgtctggcttctttcactgaacatagtgttttcacctctcatgttgtaacatgtattagttccttccttccttctttccttccttccctccctccctccctcactccctccctcccccccccccccccactttctttctttcttttggcagagtttcactcttgttgcccaggctggagtgcaatggcgcaatctcggctcactgcaacctccgcctcctacgttcaagcgattctcctgtctcagcctcctgagtagctgggattacaggcatgcaccaccatgcctggctaattttgtatttttaatagagacggagtttctccatgttggtcaggctggtcttgaactcccgacctcaggtgatccacccacctcagcctcccaaagtgctgggattacaggtgtgagtcactgcacctggccacttcatttctttttatgactgaatgatattacattttatcagtacaccacattttgtttatccgttcatcagttggtggacatttgggttgtttccacttttggagtattatgagtaattctgctatgaacattcaggtacaagtttttatgttgacgtacgttttcagttgtcttgactatacacataggagtggaattgttgggtcatatagtaactctacttaaccatttaactacttaaagaactacgagtctgttttccaaaggggctcatcatttttcagtcacaccagcaatatatgagagtgttagaaatttgttattgctgtaacagagacttcaaattcttctagtgacactgtttttgtctctcctcttggctcaaggtctctttgtgcttgtcctcataggaattttgtttcttgcagctctcccaagctgttagccagtgttattatccctggagtctttagcgtagtagagggtatgggggaggggcagtattcgctaatcttctcattaactctttcttagtctttagggtgcatagtggtcctgtttctgggggtggaagtggtggtagggaaggtagtcttcaggtagagcctttttgccactgccccctgttccctcattggcctgtagcaggtatcttctgatgttctcagcctttgtccttgaggttctctctcctgtagattacctttttgcccgttaggtaacacagggaggctgaggctggatgcttttcccttctcccagcagtaatgaaactacaccattgtcctgacttgatacccttcccctgcagatgaagccttttgtttggtaagggaaccagggcactaagcaccaagtacccagacagcaccactctggtgctttctccaggtaccgccccctgccccggccctgcccccaccccagcttccctgtgtgagcctaattgggttcctgaagaaaaagcttgcaagcgggtgggaccccccccccataactacagcccccaagaacttcatattctcatatcagtccccacgcagcatccagcgattcaaaatttctagtttaatgttcctgctgtggcttctgccacaggtaaccaaatgctctgccctgtgtctccctgcaggcacctgtctctctgaattgggtatttgtgctgtgattcacttctctgatgggttcatgaaaatttgttaatttgctgcctgtcctgccatttgcttcttataaaaacgggaggttgttttgttttgttttttgttttctgactacaggtctgagacaaaaccagaattcttgagccttatgattttactgggaattagtcactgacatgcaatataaattaccccttttgcagaggattaattggctgcattaaaagatacatatttttctttgatatttagtgtatcagtgagattcttgtgcaaatctccctctaatttatcctgtagagaagagtttcctagggatatgtgaatcccctgtatggttcaggggctttgtgtaccttctggaaattgtatacagatttttaagggtatgttctttgttaatttttttttctgagatagtagccttatctgattcttaaaagggcccatactcgtaaagttgttgttgttgtttttaatccctagaaaaagtacatagtaactggctgggtgctgtggctcatgcctataatcccagcactttgggagactattaaaaagtcttccattctttatcaaaagctaggatatttttgactactagtctggtgtgtaaaacatatcaacctatcttaaaacattgactgcatatcatctgtaggcctggagtctcattattatccaagactttcatagcaacagaatgaaagctcatatattttaattcagtggagagcactacatactctctagtaaagcctgtttacatcattgtacctatatttctaacaagcttaattacttggttttctgacctacagcagataaaaagcactgagctacaagtgcatacttattacacaaaaagggacattgagggaagggagaataatttgcaaagcagccttcaaatgttatttcttgtgctgaaattgctcagatctctaaatcagactttgttgctcccccttctccgttatacctctgtttgatatgggggaaagggaataatccaacttaagcaacccaaaggtacattgctttatggtaattgatgttgcagttggtgttagcccatagccatcaaaacgttctgtttattctttataagaaacctgagagttattttaaactatttgaaaaatatttccatgggttttaaagtttcaaatttagaaattacataagctttttgattcattgaaaaaaatcaatgtgggatgcaatgtcttgacaaaacaagaacagagtttttaagggttttaggcacagtgttctttgctaagttttctctgctattgattttctggataacctgacaactttttttgcctaaagattgtataattataattaattccttttgcttaaatataattaccagtttgtagctgttttatgcttttggggtgacatgttagtttgtggtcagttatgtgtagcttcagatttcagtgactgaatcaaaattgatcaatctctctgctttattcacacggaccagacagtgttactctttgtgtcatacaggaagttaatgttttgacttttcctatgaaaaatgtcacacaaatgttcagaggagctgtgctttaaaaaactgccaactgagagatgttaatgagagcaataaaagccagagttgtctgcaaagggcattttcattttgtggctctggcaggttaagcattgatgttctaattgaattcatagtgaggcctcctttgtttctgcaagcatctgacaggccagatgtgcacacagtgttgggcttggcatagcttctggactgtatgttagccagtgaatcccctctttgaccataaatgaacagttatctggtaagtacaaagcctttttgtttcaggaacttttgggaaaactaccagtgcatataaaatagacacactattaagaacttgtaaaacttctcaacttcattacctagaaaggtcagggtcagcatctagatccctccttcattatctttaatttagcaacaaatggctgtgttttattttgtgaagtttctacattaccttgtggcctttggaacgttagttaaagttcttgttggggctcttgcttgggaactgtgtctttgggagccaaaccatgcacattttaactgagctgtgaactcatatctctcttaccccatcaacaattactttgtggactatagagaagaactcagttatatacttgtttctgattttagaaggaatgctatggtgatgataataaaataacaccatctagcatttatttggaaattactgtgagctccatactgtgctaagtcctttatacaagttcacccatttaatctttacaacaacccctatgaggtgagtgttattatccccattttatagataagttgagacgcagaatttggataacttgctgaaagctacagtagtgaaatcagtataccaatccaggtggtctgtcccagacccatattcctttaagattttttttttttttttttgagatggagtcttgctctgtcgcccaggctggagtgcagtggtgtgatctcagctcactgcaagctccgcctcctgggttcatgccattctcctgcctcagtctccctagtagctgggtctacaggcacccgccaccacacccagctaattttttgtatttttagtagagacgtggtttcaccgtgttaaccaggatggtctcgatctcctgacctcgtaatccacccgccttggcctcccaaagtgctgggattacaggtgtgagccaccacgcctggcctaagattttttaattatataaagtatttgcctgcttcagactttaaactgtaaaacaaaatatattgagagatccagctagattcagctcaactattttggtaacttttctataagtctctctcccctccctgttttctcctcactctgcagagttaaccttttttgttacgtttttggtttattcttttattgtttctttatgaaaatatatacaaatatgtatgtatgtgtgtgccacttctgtatataaaattctcctcactaatcgggatttgctatagttattttgttttcagttcaaaaactttaaaaatgccttttcttatcaaaagcgggttaatgagaccagtctggtaaatatgttttatatcactttgcagatatcttctgcctgagtactgaactgacattcccatccactcagcattttatgttctgtctcatgcttgagattgacttccatagcaaaataaggcagcctctcacactctgccttaagtaaaaatgcttctctagaaaacttagatctgatgctctttaatctggctagcttgtaaaattgaaatcaggcttatcatatgcctgtttttctctaaaggggaaggaaaaattataatagtcattggattcagttttcatttgcttaagaaaaacaggtatgaattggttggtggtttcccagacttcaccttcgtggaggtttgagtatttctctcttttttttgaggcagagtctcgctctgtcgcccaggctggagtgcagtgacgcgatctcggctcactgcagcctccgcctcctgggttcaagcaattctcctgcctcagcctcccaagtagctgggactacaggcatgcaccgccacacctggctaatttttgtatttttagtagagacgaggtttcaccatgttggccaggatggtcttgatctcctgacctcgtgatccacccacctcggactcccaaagtgctgggattacaggcgtgagccactgcacccggccaggtttgagtatttctgaagccatagacaaggaccacatttcattggcctctgcttttgtatacctttgtctgtagtcttcaagttactcttctgtttggtaaacatgtatattagtttcctagggctataataaattaacataaacgaggtagcttaaaacagtaggaatttattctttcacagtatgaaggccaaaagtaaaaaatcagccagtctgtgctccctccgtaggttttaagggcgattcattctttgcctcttccagcttttggtggatgtcagcattgattgatttgtggatcaatgaatcactctaatctctgcctccatgatcacactaccttctcctcttccatctcaaatctccctccacctttctcttgtaaggacacttgtcaatggacttagagcccacttggatattccagaatgatatcttcacctgaagattcttaacttaattacatctgcaaagaccctttttccaaataaggtaatatccatagtttctgggaactaggatgtggacatatctttttggaggccaccattcaatccactgcaatatgttttcaggttaggaaactatgtagagcagatttcataagcagttatggcaagtatgaaggtacggcttatgctttgtaattagatcatttggcattattcattattagtcaagcccaaagcatgatcttgtaatcaattgatatattttataaagactatcacttggaaaataatgaaatattttaggatgttgacacatactttccagaactaaggaaggatttcccacagcaccatctttcccaaagatagtagtttagcaaattggaaattgccaccactacttaaccactgcctcattaaagatactctgaggccaggcaccgtgcctcacgcctataatcccagcactttgagaggccaaggcgggcagatcacttgagtttagcagtttgagaccagcctgggcaacctgtcgaaaccctgcctctacaaaaattacaaaaaaaaaaattacaaaaattagctgggcatggtggtatgtgcctgtagtcccagctactcaggaggctgaggtgggaggatcgcttgagcctgggaggcagaggttgcagtgagccaaagtcacgctatcgcactccagcctaggtaacatagtgagaccctgtctcaaaaaaataaaattaaattctggaacagaaagacattagggagaaaaatagtgaaaatttgaatgaattctatacattagttaatagtattatagcattgctactttcctggtttaggtaattgaactctggttatataaactgtaaacaattagaggaaactaagtgaaggatatatggaaactttactatttgataacttttctttaagtctaaaattatttctaaataaattttaaaatgaaatgatgcccaaataattattaactatcagtggatacttgttacttaatttaagaaagttaaggattgttttatacaaactgttttgagtaacctgtattgttggtttaaatttagagaacccaagaaaataattcaggaaggactgcattaccctttattaaatcccaaataagctggcttccttgtcagtacttcaaacctttccaaacagaagttgatctggccatttaggaagttagagatgtttctcttgttggaagcagagtggatggggatggtctttttaaaaggagaacattgaatggtatcagttgcatagtgatggtcttctcaagatatgtgcaatatctttccaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggtatttgcatgcttgcacctttgacttagggaatgaatgctctcatgtttgtctgctgcttggggagaaacttagagtggctaattatgcatttatagtacaaagtcacataccattttcaccaattcactcagaccagtggcagattttaccaggctataataagcaataaagtcaggctcatgtatttagggacatagtatgtgcccattattcataggataaaaccatttgaagtccaatctgaaattatgataaaattttggagacaagaatttccaagtcttgactcaacagtcagtagcatttattagtcttctgagagaaacagaattaattacataatgcctgtcttagtctgtttactgttgttataacaatacctgagtctgttttatttatttatttgtttgtttgtttgtttatttattttgagatggagtcttactctgtcacccaggctggagtgcagtggcaccatcttggctcactgcaacctctgcctcccgggttcaagagattctcctgccttaccctcccaagtagttggaattacaggcgtgcaccaccttgcccagctaatttttttggtatttgttttaatagagacagggtttcatcatgctggccaggccgttcttgaactcctgacttcatgatctgcccaccttggcctcccaaagtgctgggattacaggcctgagccaccgcgcctggccgagtctgtataatttataaagaaatatttggctcacagttctaaagactgggaagtccaagggcatggcagcagcttctgaagggcttttatactgtgttataacatgtgagaaaagaagaaggacaagtgaacatgtgtttaagagatcacaagagtgagccaagctcacttttatgatgacccactcttgtgagaattaattcactcctgcaggaactcattcccacaagaactaactgctgctataacagcattagtcaattcatgagcactccaccctcaatacccaattatctcttaaagaccccacctcccaacaccatcacattgggaattaaggttccaatacacaaacttttggtgacacattcaaactatagaaacacctgtgggaagttttatatatatatatataacatatatatacatatataacatatatatatatatataacatatatatacatatataacatatatatatataaaatagggtcttaaagtaatggtatctataaatagagggtcaaaaacatagagtaatggtacctgtaaatagagggccaaaaacatagagtttgtaaatgcataaacccaaataaaaggggattactgaatgattgagttgactctaagcacatggccttcatttgcattagacctgagaagaaaattgaaataggagagggctttggttttagaaagaggagagaaggacttttctgccagaggaagtaataagtaataagttcagttaaagagtagcgactggttttggaagccattttttctttctggtctttgtgtttccaatactttacacaaaggttggcattaaacaaaatgctgagtaaaagtttgagtgaatgaatgaatgggtagaatgtagagtgccaaataaaggggctagtgggacctactggttactgtgagaaattgcagatcttattgtacacccatcaatttctgttacatattagatttttttaagggcagagataacatccttgaattctctgctcctagtactaggtttttaagacctagtcatgctccagaaatgcttgttggaatcatttctagaaacccaggctgtcctacccacagaggctgtcctacccacagagaggctgcctatgctctgttaaggaaagctccacagccttgctcagcacatgtcccaaaactcactggttcatcatcaacaccatctcctgccccctaaaaatcagagtagcatcatgaatgaacatatgagttgagtgttttcatgtccttgttgtcagtatttttatacaaatatagcagccctggtgctgagttgaccatcaccattccattgatactccgaggattattgagtgtgactagcatcttgactttagtctcgttggtaagtcagtatcaattatctacttattggaggtgattttaatcttttaggttgagtggaaaatgtcccctgtaccactttaaaaatgttatctgataagtgagccatgggtaagtagggtagcaagaatggagcaacagtttaagaacagtaatttattttcatttttttaattttttgagatagggtctcgctctgtcactcaggctggagtgcagtggcatgttgtcagctcactgcaacctccgcctcctgagttcaagtgattctcatgcctcagccacttgaatagctggggttacaggcatgtgccaccatgcctggatatttttgtatttttaatagagacggggtttcaccatgttggccaggctggtctcaaactcctagcctcgagtaatttgtccgccttggcctcccaagtgctagaattaaatgtgtgagcccccgccctcagcctaagaacaacagtaattttagaaactaaaagagtttaacttgttttcaaatatagggatgtgcgttcctaattcatgtgtggcttcagtgctctattatttgttccgagggcttcacatatttaccattataagtgctgtgaattgttggtaaatctcttctgtttcccatagttctttgcctatcatacgaaactcttaattttaatggaacaacaaggcagactattaaattattgatcatattgaattccttaatgaaatccttaactggttgctcttggtaggtatatcagtttctgttttttagaaaatatcaataagacttgtactgtagtatgtagcctttcctatggaacagtaattctcaaattttagggtgcatcagaatcatttggagggcttgttagaacagatttcttaacctcacccctagtttttgattcagtagatctgaggtgtgaggtctgagaatttgcatttctaacaactcctgacatgatactgatgccactagtctggggatgacactttgagaacaattttgttatgaaatatgtttatctcatttcctgaatttaatggaaatctccatacttttatcatcttccttggatttctcttttggctttcaatataagccagccatattggaggctcaacctatttaggatttggttggagtacctaaactttgtttggagtacctaatttcctcaaccacagctgcttatcacagcaacccttaactatcatcattttgcatgggtcaaactatgtcttgtgatttttactttctgaattttgtaagtcaccttaaaaattaaatctttgtgatatgaaattatattggaacattaataaataatttgttttcatgtccttcaacagattttcaaaatcaaatgacttcaattaacatttttaagtactatataaattcaggcctatttagataccccatggtatgaagttactctcagacttgccttttaactaggaactagtcttaaggttttttggcagagctttctatttgccatccatatacccttttcagtgaaatatatctttgtcttttgcctgttttctaatcagattctttgtttttttactattgagtgttgagaattacttataaatttgagatatgaatccattgtcaaatatgtggtttgcaaatattttctcccagtctatttatagattgacttttcgtccagttaagagggtcgttcacaaagtataagtttgtgattttgatgaagttcaatttattgattttttttttcttctggatcatgcttttaatgtcatgctgtgaacttttcacttagctctatgtctcaaaaatattcttctatgttttcttttaagagttttatagttttacatttaaatgcgtgaaccattttgaattaattttgtgtaagatatgaggcatagatcaaagttcaaaatcaggtaagttgattcttcccactttattcatttttcaaaattgctgtggctattccactttctttgtctttccattcaaattttataataagctttccatatgtacaaaaaatcttgctggattttcataaggattatattaaacctttatcacttgggaagaattgacatctgtacaagtcctgtacacattttgctaaatttatgcttaagtgttaaaattttttgagcagttgttaatggtattatatttataatttaggtttccacatggtcattgctagtacatacaaatacaaccaatttttgtgtgttgatgttgtgttttctataaccctgctgaattacttagttctggcagttttatttaaaaaaaaaaaaaaaaaagaggttccttaggattttctgtgtagaccatcatgttacctgcaaataaagatggttttatttcttcctttccaatctgtttactttttatttcttttcttgccttattctagtagctaaaatgtcttgtagtatgtcaaatagcagtggagagagcagacatcattgtcttgttcccaatcttaggcggaaggctttcagtctttcaatatattaagtatgatattaactatagggtttttcatagatattctttgtcaagttgaggaagttcacctctactcctaatgtgtggtagtttttttcataaatgggtattgaattttgtcaactgaaatgatccctatcaaatgatatgatcaggtgattttttttcttcttcagcctgttaatgttatagattacattgattgattttttttaatattgaacaagccttgcattgcttgagcaaacctgagtattagtcagcttgggctgccataacaaaatatcacaggctggatagcttaaacaacagaaatttatttctcaaagttctggagtctgaaagtcctagatcaaggtcttgcagagttcagttttggtgagggctctcttccttgcttgctaccttctcactgtgtgctcacatggcctttcccttatgaccttatttaagcttaattacctcctgtaggccttgtctccaaatacagtcacattgggggttaaattttgggggtgacacaattcagtccataacaccaagttgatcagggattatattatatttttatactgcttgatttgacttgcaaatatcttgttggaaatttttatgtctatgtatttttatgtcttatttttatgttcccgaggaatattgacctgtagtcttatatatataaaaataattatatataattaatgtatatatataaatttatatatttatatagatataaatttatatatatattaattatatattataattaatgtatatgttatatataattaatgtatatataaaaattacaaattataattaaatttgtaatttatatataatttatatataaaataattatatataatttatatatgttttatatataattttggtgacatacaccaaaattataaatttatatatatttataaatttatatatataaatttatttttatatatttatatttttatatataaatttattatatatataaatttataaattatttatatatataaataatgtgagagacagggtctcgctctgttgcccaggctggagtgcagtggcaccacctcaagctcagtacaacttccacctcctaggctcaagtgatcctcctgcctcagcctcctgagtagctgggattacaagtgttcatcgccacgcccagctgatttttgtattttttgtagagacagggtttcaccatgttgcccaggctggtctcaagctcctgacctcaagcagccctccagcattggcctcccaaagtgctgggattacaggcaggagccagtgcacccaacctctcatgatatttatatctgtattgtatcagggtagtactggtcttataaaattagttgggaaatattccttcctcttctagtttttggaagaaatggtatagaactggggttaattcttattaaaatgtttgatggaattctccaatgaaacactccagacctggaggcttctctttggggatttgcttaagtataaatttgagttcttttttttgtttgtttgtttgaggccttgctctgtcacccaggctgcagtgaaatggcacaatcacggctcactgcagcctcaacctcctaagcccaagcaatcttcccacctcagcctcccaagagctgggaccacaggcctgtgccgccatatgcggctaattttttaagaattttttgtagagatgaagtcttcctatgttggccagtctggtctgaaactcctgggctcaagtgatcctcccgcctcagcctaccaaaatgttgggattacgggcgtgagccactgcacatggcaaatttgagtcctttaatagataatttgaatagccctgtaactatttcatgttgagtgactttggttagtttgtagtttaaggtactggtttgtttcatctaagttgttgaatttacatgtatagaatggctcatagtattccctgtgttgctttcattttaaaattcaatcttggctagacttctacttccaaaaagatggagtaggtatgcttttccctatgcctcccactaagtacaattaaaaaccctgagcattttatataatgcaaacataagactttgaaagatcaggagaagaaagcagaacagctagagtccttgagacctgaggaacaacccagttttatgttccctgggatttctttttgttcccagagttggtgctggagaagctagcaacccagaagcacaaaccagcaaaaacaaaaaacaaaaactaagaaaagcctgtcctctctagccaaatgaccaggaaagggaccgcctatcagacaggaaaccttttttttattattttattatttttttgagactgaatctctgtcgcccaggctggagtgcaatggtgccatctctgcttactgcaaccttcgcctccctggttaaaatgattctcctgcctcagcctcccaagtagctgggattgcaggtgcacaccatcacacccagctaatttttgtatttttagtagaggtggggtttcaccacgttggccgggctggtctcaaactcttgacctcaagtgatccacccacttcggcctcccaaagggctgggattacaggtgtcaatcactgtgcctggccaacatggaaaacttttagacagaaaactcttctccagtcaaacaccacagaaaaatactttgggccaccccaaccttctccagcaaagatggagtagggagcttagacagcaatgatgtaccccatttggggttgtgttagaggagactgagtggacagtcaggattttcacctctgttcagcagtgtcagtggaggccatgcaggaaacaatagcaaggcattctcaccaatcccagtgatggaggtatccatggaagcctagtggggggctgaaactctcagccccacccaacagtaacagggatgttgacacaggccaaatggtgaactaggtcttatacaaccacctggtggtaacaaggcaatgcccccaaccctgatctccagccagatagtgtcataggaagccagccaaaatcgaaggtttgcataagatccagagtctcataatgccccaaatgtctaggttttagtaaaaaattactcatcaagaatcaggaaggtctcaacttgaccaaagacagatgccgacatcaagatgccagatattagaatagtttaacgaagattttaaaacagccaacataaaaatgcttcagtgaacaattgtgaacatacttgaaataagttaaaaaaaaatagtatccctctttcattcctattattggcaatttttgtattatctttttttcttgctataggttggtcagttatcttgatcatttcacagaacactcttcttatttttgtttgtttttagagacagggtcttactctgtcactcacgctggagtacagtggcatgatcacagctcactacagcctggaccttttgggctcaagtgatcctcctgcctcagcctcctaagtagctgggactacaggcgcatgccaccacgccaggctaatttttgtagttttttttttttttttttttttagagacaggggtttcgccatgttgcccaggctggtcttgaactcccgggctcaagcaatccgaccacctcggcctcccaaagtgctgggattacaagtgtgagccaatgcgcccagcccattacttttctgtttttaatctcattgattcctggtctttattatttttatccttctgcttactttgggtttattttgcttttttctcgtttctagtgttgagaacttaatttattgatttgaagctgtttctcttatctaatgtaagcatgtagtactataaattttcctctcagcacctgctttaactgtgtctcataaattttgatatgttgaatttcattttcgttctcttaagtatatatttttttaacttctcttgaaatttcttctttcacccatggattatttcaaagtgtgatttttggtttccaggtgtttggaggttttcttgttatctttctgttgctgatttctagttttctttttttttttcttttcttttaagagatgagatctcactatattgtccaggctggtctcgaactcctgggctcaagcaatcctcccaccttgacctcccaaagtgctgggattatgggtgtgagccactgcgcgtggccagtttctagttttgattccactgtgatcagaaaacacactctatataattccagttatttaaatttgttgaggtttattttatggcccaggatatggtctgtcatggtacatgttccatgggtgcttaaaaataagtgtatgctgctcttgttgggtagagtattccataaatgtcaattcgttcaactctgttagttggtggtagtgttgagttcttctgtacccttgttgattttctgtttgttggttctatcaattattgagagaggttgaggtctatagctataatcatggatttgtccatttccactttgagttcagttcatttttgcttcacgttttggagcactgttgtttggtgcacacacatttatgattgctatgtcttcttgatgacacttttatcattatataatattcctcttcatctctggtaattttctttactatgcagtctactttatctgatgttagtatagtcacttttgctttcttttgagtgatgtttgcatcatatgtctttctccattattttactttcaacctacttatatccttatattttaagtatgttttatttagacagcatatatttggatcatatttttaaatctgctgtatcaatctgtcttttaattggtttagaccacttatatttgatgcaattattaatatgttaggacttcagcgtgtccttttattttgtgtgtgtgtgtgtgtgtgtgtgtgtgtgtgtgtgtgtgtgtgtgtgttctctgtttttcatttctctgttttatttttcctaccttccttggaggttccctgaacaaactaccaaactcgatccatgtgaaatagatcatttgaatagccccaaagctattagtaacattgaatttgtaattaaaaacttcccctaaaaatacctccaggcccagatggtttcactgagaattctaccaaacattgaaagaaataacaagtgataacagtagaagagaaatttgaatcaaagatgaatagagttataaaagaaatagctaaccatgggaatatggggatatgctgctgttttagaagctctaggtttacagccaaaaagaacttagtgaaggcaaacttatcaacataaatgaagaaaatggttatggtgaaaagaatgaagatgtcccagaggaagtgatactagtgaaaaagtgcacattaaaggaattcttggaagtattttacaacattgaaggtacaaagaacaaaatgttgaaaactaatccacacttagaagggaatatgacaatttgccaaggggtagaaaaggtgcttgctccatgttgtaagttatgcaatgaaaaggagttaagcattgtaatcttgataagtttttacaaataaataaaagtgtaattctcaatgtttctagtgtttcaaattatattatattaaatacatattggttttattattttttatttcactatatgtttatagtcaatgggaagatagctttttaatgttttgacaaaatttttaaaggtcattaatgacagttttccccattgtttattaagattgcttttcacagttttagcttgcacagtcatttttacagtatcataccaccatgcaaagcaaggactatctgtaatctttagtgacagaaagcagatcattggttttctgggaggagacagggaagcaggaggatacaaggaaacttttgggggtgatggacacattatcttggttgtgatgctagttgtacaaatgtatgtagatgtgtgtgtcaaaactttatacatttaagatatatacagtttattgtatacccaaatcatgtatatgatgaatataatacttttatattcatatatacacatagatacattataagtatatgaacaatcatcacaagtagagatgagtatatgtatagatgggtaagaaaatgtgatagtggggtcgagtgtagtggctcacacctgtaatcccagcactttgggaagccaaggcgggaggattacttgagcccaggagttcaagaccagcttgggcaacatagtgagacctcgtctctacaaaaagtaaaaaaattagctgggcatggtggcatgcgcctgtagtggagctgctcgggaggccgagttggaaggatcgcttgagcctaggaggttgaggctgcagtgagccactgcaggctgcagagagtaccactacactccagcctagataacagagcaagaccctgtctcaaaaagaaatgtgatagtggctacatgaagacacaatcatgggtggttagaaaaggagaaagacaagatgtgactgtaaactacctaagggcagaacccctactgttcagataaaaaggttttcagtaaatatgtgttgtaaggagaataggaaaagaaaacaaagaggaaaatggtggatgttaattaagaaaatttgagaagggccaaaatataagtcagaaaaacaaagatgagaacaggaggaaactaagccttccattttcaccatttgcattcctttcttttttttttttttcttttcatttttgagacaggatcttactctcttgcccaggctggagcatggtggcacaatcacagctcactgcagcctcgacctcccaggttcaagggatcctctcacctcagccttccaagtagctaggactacaggcgcacaccaccgtacctggctaatttttgtatcttttgtagagatgggatctccttgtgttgcccaggctggtctcgaactcccaggctcaagcaattctcccacctcggcctcccaaaataccgggattacaggtgtgaaccactatgcctggcccacttgcctttcttatactaaaataaaaagatttttttggccgggcatctcaaaaaaaaaaaagattttttcactttctcaagtgcttgattgaaagagtttaatgtaagtagacataacattacaactaataagtgatgttttaaatcaaaataggggaatgggaggtagggaaattttactaagttcctcagtcagatcaagttttaagtttgtcacatgacctctgtggttttcataaatgtgcagcttgcttttcttagatttttttaagtgagataattcacctattataaatttttatttttatttatttattttgagacggagtttcgctcttgttgcccaggctggagtgcaatggtgcgatctaggctcaccacaacctccgtctccccagttcaaccgattctcctgcctcagcctcccgagtagctgagattacaggcatgtgccaccacaactggctaattttgtagttttagtagagacagggtttctccatgttggtcaggctggtctcgaactcccgacctcaggtgatccgcctggcttggctgggattacaggcgtgagccaccgcgcccggccatgtaaatttttaaatcaagatagaattcacataccataaaattcacccttttaaattatatggtggtttttagtatattcacagagttatacaatcatcatccctgtgtaattccaaaacgtttttatcaccctagaaagaaatcccacatctgttagcagttactagtcattctccgcttcccccagcccctggcaaccactgtattagtctgctagggctgccataacaaaataccacagactgggtggcttaaagaacaaaaatttggactttttcagacgtttctctttctctctctctccctctctttctctctcaaaaaaaaattattttttcatagttctagagtctagaaatccaagatcaaggtgtcatcagggttgacgtctggtgaggcctctcttcctagtgtgtaaacagccaccttctcactgtgtcctcacatggcctttcttctgtacgtgcacagtttgtgggggtggagctctggggtgtctccttctaaggacaccagccctatcagactaaggccccatccttatgacctctcataacctttattacctacttataggccctgtctccaaataaagtcacatcatgggttaggtcttcaacatgaatttgagaagggcctattgagttcataacaaccactagtctgctttctgttcttatggaactgcccactctggacatttcatataaatggaatcatacaatgtatggcattttgagtctgacttttttcatgtagcataatgttttggaagttcatccgtgttatatgtatcagtattcattacttttatgaccaaataatattctgttatatggatacaccacattttgttaatcctttcagcagttgatggatatttgggttgtttccacatatgggctgttacgaataatggtgctataaacatcctcatacagtttttttttaaattttaatcaggtcctctagaagaaaattcatacaggtttttgagtgcacatatgttttcatttctcttgggtacatacctaggaatagaattattgagtcatatggtaactctatctttaacattttgaggaattgtcaaactattttttatagcatctgcaacattttacattcctgtcagtaatgtgtgaaggttacattttctccacatcctcaccaatacttgttattgtctgtctttttgttatagcctttctagtgggtatgaagtgtatttcactgtgattatgatttgcatttgtctaatggctaatgatgttgaacagcttttctcgatgtccttcttagccatttatatatcttttgaagagaccttttctactttatcacacaaaaaagcctttatgaggtcagaaaacacaagattttatctttgtcttctatgaaatgctgctgttcacacagccagaatgagtcgtcttaagtcccatcacattcatttgagtatgtatgtccttggctgctgaaaatctgaccctttaatgaatagggcagcaaagttccctgaccatcagtgttctagaatgtcccattttttaatactgcatccatgcacacctcctatgttgtctttggagaaattattcagatccttaactcaatttttttaaacgggcagtctttttattgagtcataagagttctttacatattctggatacaagtctcttatcagaaatatgatttgcaaatattttctcccattctattgattctctttttactttcctcatggtgtcctttgaggaacgacagtttttaattttgggccaggtgcagtgactcacacctgtaatcccaacactttgggaggctgaggtgggaggatggcttgaaaccaggatctcaaggccatactaggcaacatagcaagtcctcatctctacaaaaaataaaaaattagctagccatggtggcgcatacctatagtcccagctgttcaagagacttacgtggaaggattgcttgagcccaggagtttaaggctgcagtgacctatgatcacaccactgcactccagcctgggtgacagagtgagaccctgcctcaaaaaaaaaagtttttaattgtgatgaagtccagtttatctgtttttttttttgttgttgttgttgttgcttgtccttttgatgttatatccaagaaatagcaaatattgcctaagccaaggtcaagaagttttatacctatattttcttctaagaattttatagtttggctattacatttaggtctttgatccatttgaattcatttttgtatctggcttgaggtattaggggtccaagttcatttttttttatgtgtggatatctagttgtcacaacaccatttgttgggtagcttcctttttgaaaatgatgaacactgtaccccaaacccacctaccttggttccatgtattccttataagtcaggctgctatgaaagaaagcatagttattgaattagcaagaaatcctagttttatattttgaaatcttagttcttttttcagagacagcgtctcgttctctgttgcccagcctggaatgcagtggcacaatcatagctcactgtaatcttgaactcctgggctcaagcaatcctcctgccttagcctccccaattagttgggactacaggcacatgccactgtacccagttattttttattatttttttagagatgggatctcgctatgttgcccaggctggtctcaaactcctggcctcaagcagttatcccatcttggcttcccaaagtgctaagattacaaacatgagccactgcacccagccagttttatttttttaatctcctgtttcacagatctaccaaagtgacttaaaatttttttatctagtttgagatgctaatttctgtactttatgcttcactctgtccaaatataagggaactttttaaaagttaatggaataatggaattaagtgatgaaaattaaaaatataaacttcatttctcaacgtaagctccatcaaggtcaagacacttttgtaagcaatgataccagccatttagttcttccctagagaactgagcgtcctgggaatttaaccatgtcagtgcagtcttttttgcattattaactgaaggaaaatgggtacccttaaagattttttaatattaggacacaaaaagaagtcagaaggaggcaaaacaggaccgtaaggtggatgcttaatgatttcccattgaaactctcacaaaattactcttgtttgatgagaagaatgaactggagcattgttgtgatagcaaaagacgttctggtaaagctttcttgagcagttttctgtaaagctttggctaactctctcaaaacactcataataagcagatgttatcattctttggccctccaaaaagtcaacaagcaaaatgccttgaacatccccaaaaactgttgccatgacctttactcttgactgacccacttttgctttgactgggccactgccgcctcttggtagccattgttttgaatgtgctttgtcttcaggattgtactcataaagccatgtttcatctcctattataattcttcaaagaaatgcttcaggatcttgatcccacttgtttaaaatttccattgaaagctctgcacttgtctgtagctgatctggctgtaaccagtttcagcacccattgagtgaaaggtttgcttaactttaatttttcagtcagaattgtgactgaagaactgtgactgtatgctgaaccagttgagatgtctgtggtgttggctgttgtttgtgctgttaatcatcagtcctctttaattagggcatgaacaagatgaattttttccttgcaaattgatgagatgtaaaaatgatgtgaatgtgggctttatcttcaactttgtctcttcccttcttaaaacaagctatccatttgtaaactgctgatttctttggggcattgtccccatgaactttttgtaaaacagcgatttctcctttcttctacccagatttcaccataaatttgatgtttgttcttgcttcagttttagccaaattcctattgctctaataggggcccttttcaaactgatgtcttatccttcttagtgcctgtaaaagttagtatgaatttatttttgtgtaaatttttgaaatctacatatagttttttattttccatgaactttttgaagacctcttatatgttactgttttcccaccctacatgacaaaacagcattatgttaatttttattggttaattttataacttttgtgttagttttccttttgtgtattttaaacagtttttgaaattaaaaatagctttattctcaaaaaccataaataaaaatgttctcttccaatgtaattgccaagtttaaataaatgtaagtgttctataacaaacccttgcaataattatttttagatttaaaactcttatcttcagtgattatgtattactatgttaataattgttgaattgtaaaaattatctccaccttccaaattttaaaaattgtaagtcagagtgcattgaaagcatgatgacattccttaattctgcactgaaggtttttaataaagaatgttatagcaattcacaataacatgtggaaagtatcagaatgtaaaaacaaaaaattatgaatatattattttgggcttgctacttcatattagttttggtaaaattaaaacccaattggttagtttctgctgatggaaatctcacttctatggagaaaatattacaaaatgtaaatctgttagagaaatttaagaatgaatctggccgggtgtggtggctcacgcctgtaatcccagcactttgggaggccaaggtgagtggatcgcttgagatcaggagttcgagaccagcctggccaacatggtaaaaccccatctctaccaaaaatacaaaaaaattagctgggtgtggtggcttatgcctgtaatcccagctactcgggaggctgaggcatgagaatcgcttgaacctgggaaacagaggttgcagtgagccaagattgtgccactgcactccaccctgagtgacagagcaagactgtctcaaaaaaaaaaaaaaggaattgatctaatgtaatacaatagtaaattaagttaaaatgtacttgaaaatatttggaaataattattatgtattgggatacgccatttgttatagcaaacatcctcaaaagtctcagcatctttttttttttttttttttttgagacaggatctctgtcacttgggctggagtgcagtggcatgatcatagctcactgcagcctcgatctcccaggctcaagagatcctcctatctcagcctcctgagtagctgggactacagacgtgagccactgcacccaaccagtctcagcatcttaatacaatgaagtctttatttttcgcacatgtctccatccaatgtgggtttgaatgtggatcccctctgccccacacagttatttagggacacaagctctttttatgaatggcgcttttatttactacccattctcttttctactctctaacttctcaatccagtcagcatgaaaagagtggagggttatacagttggggtttttttctggtgggggcagcgggggtaggctttgaagtgacttacctacctacatatcattagccagaactcactcctgtggcccacctaacagcaaagggggctggagaacgcagtcttgctatgtgtgcaggtggaaatggaaatagggtttggtgaacacctcgcacttctctgctgctctttgatagtggcattacaaagtcaaagctatgagatcacaggaaccttattggttttattcaccactgtaaccctgtagttgatgctatggtctacactgcacagatttccatatagtcttaggatctttccacctagtgtctcagcaggatagtctgacttcttacagacagttcaggactccaagagtgaatgttttaagaggtaagaagtggaaggtgctcatttcaaagcctaggctcagaaactgacacagtattacttgcactatattttattagagcagttgcagagggcttccaaattgaaggaaaggaaaataggccccatttctcaataaaaggcatatcaaaggatttgtggccgtctttgatctaccacgtcataatatttttaatgtttgtctttttttttttttttaagagacagatcttgctatgttgctcaggctagattcaaactcctgggctcaagctatcctcccgcctcagcctcgtgatgagctggaactacaggcacaagctaccatgcctgtcttgagttacttgttttgttgcctatagacagattagtcagctagagaaactttactaataagactaaagtacactcttgctttttatttattaactaatttataaggttatcaaaatgctttagcatcttatttcctaatggacttagagcagtaattttggatatatgtataaattaattgacatgatccttgggtgctagaattactctactcgagctatagtaactgaaaatggatgagggagaaataagaatagatagagcacatcctttcagaatctttgttctggctttcagatgaggttttcccatctgtttcactgtcctttctgcagtttccctgttagttcagtatagtgtatatatgtggtgattgaggggaggggtacagagattacagagccatcttgcactgtaagttatagctgcttaggtaagtactgatgaccaaaagaaatttttcgacagtgagttcaacaaataaagatggtgttaaccctatttacatgtctctaggtagactgaaggattttgagtcattaacagtgagcttcagatatttctttttgggtattcatttatatattttaatcagtttctattgcagtaagattccaatagaaggaaaacaatgcttcattttttgttgaaagcaaacatacattataagttgtataatacacaatgattaatgaagttttactgtgtgtgtgtgcatgtgtgtatgtttttaaaattacggatgaactatcatacaaataaaaacaatcagaatacaaaaaaattaactgtgtagtgtatgcttatacacatgcatatatgtatatataaatgggattgttctataacttgcttttttcacttaatatatacttctgcatcgttaataaaactgaaagaggaaatgattggatatagataggtccctatttccccttgcaatgtaaactctggacttactgggctatggagatcagtgctttctttactaaactctagactcaaatatacaactgtcaattcaacagttccacttggatgtccagtagacatctcagactaaaaatgtcccaaactgaactactgatcttcccaaaccagttctatttgtagttctctagctttagctgatagaaaaatctatccttctagctgtaactctgtcttttcagtttaagccaaaattcttagtcatctttgattcttcattgtcttatatcccatattcaatataacaggatatcccattaactctactttcaaaatatatccatatttcatatagtaaaagaacaacccctaatgataaatggaaacacatgcctgcctcccactccactgctgtatttggtcatctaggcccctcccatctccccttactctcctcaccccatctccttcttcccacacctccttcttcccacacctcctttttcatcccattttaggcagcagcattctatcacttttactttcaattatgagaattcagtaaggagcacaatgtacagagcactttcttttttttttttgagatggagtctcgctctgtcacccaggctggagtgcagtggcgcgatctgggctcactgcaagctccgcctcccgggttcatgccattctcctgcctcagcctcccgagtagctgggactacaggcacctgccaccacgcccagctaattttttgtattttttagtagagacggggtttcactgtgttagccaggatggtctcgatctcctgacctcgtgatccacccgcctcggcctcccaaagtgctgggattacaggtgtgagccgccgcgcccggcccagagcactttcctacacatttatcttatttaaaatttaaaacagtccttttgcagttttccagttactattgctgatgataatttgcccccaaacttagcagcttagagcagctgtgttatacccattgattctgtgggtcaggaaatcagatagggcacagtggagatggcttccctctgctccatgatgtgtctagggcctcatcaaggaagacaaagtttgagagtgacccaacagctgggcactggaatcaactgaaggcttattcactgcgtgtctgtgtaacagcccatccctgggcttggataacatagactacacatggcctttccattagtttggcttcctcatagcctaacaacctcagcatagtcagatttcttacaggagtcaggcacagggctccaagtgcatgcgttcctgcaaaccaggagggagctacattccattttatgacccagccttgcagttctcatggcatcacttctattgatcaaaaaccatcacaagccctcccctatttaaggggaagggagatagacttcactacttgatgaagatgacaaagtcacattgcagaagaatgtgggatttggaaaataccatctgtcgcaggggttatcattgtcctttgttttgagtcatggagacttggagagaagtgattatcccagagtggtaggatgaacaagggtcatcttgggaaatgattcctagagttgttattacagtaactactatctagttagttttatttgtgtgtttagagatagggtcgcactctgtcacccaggctggagtgcagtggtgtaatcatagctctctacagcctcaaattcctgggctcaagtgatcttcctgcctcagcctcctgagtagctgggactataggaacataccaccacacccaactctatctagttcatttttaaggcatttatttcaaacctttacaaaacctatgaggttttggttttatgcagtttctgcagtgttcacaaatgattctaatccacttattaggaaatgtagcatagtctgtacctgccaaatatttagatcaactgaagagacactgaggggtctctgtacataagacactggaggaggccatagatcaggttagagtgactgcagttacctttttattgcctccttagttggcacagcagtatccacaaaggccagaggtagtagtgttccagccactggtctcccctggagagcagatgtgattgtgggtcctttcaccaaaggctagtcatctggaaagttattacaacattcatttacatgcaagcatccaaattgaaagttgaggttacctcatcctaacaaaattgctcatgcttctgggcttgcgagcttttgctgatttggtcaatggtctagtgaccatttaaagagtatcaggccgggcgcggtggctcacgcctgtaatcccaccactttgggaggctgaggcaggtggatcacctgaggtcaggagtttgagaccagcctggccaacatggtgaaaccccatctctgctaaaaatacaaaaattagcctggcatggtggcatgcacctgtaatcccagctacttgggaggctgaggcaggagaatcatttcaacctggtaggcagaggttacagtaagctgtgatcatgccactgcactctagcctgggcaacagagtgagacttggtctcaaaaaaaaaaaaaaagtgtgtctatccatagtacatagccaagaaagaaaatcacccatccagggaggataatcctgggatttcctccagctttagccatgttatatatactcgaagatattgaagctgcatttaaaaaatcccaaacatattttttttcactaattctcacagcccttccccctctatcattataagtacaataatttctccttgtgagtttatattaacttcatcttttacccatgtattttcttgtagttggtgttactgttttagtatataatttattgtcatggtcttggtccttagatgcagacctttagttcaagatacacgaggaaagatgagtgagatgacattgctgtcattatcattattgtaaattttgcatcgaagtataatatccacacagaaaagtacacaaagctgtacagctgaatgaattttcacaaattaaatgcactcatttatctgccacccagatggggaaataaaacatggctgggcacggtggctcatgcctgtaataccagcactttgcaaggccaagatgggagtatcacttgagcccaggagttcaagactagcctgggcaacacagtgagaccccatctctacaaaagattttaaaactagccatcgtggtggtgtgtacctgtagtttcagctacttaggaggctgaggtggcaggatcacttgagcccaggaggttgaggctgcaggagctttggtcatgccactgagaactacctaaaaaaaaaaaagaaaatattaccaacacccaagaacccctccttcttctccctgccagtaactgacctccctcacccaaggtatcagttttgccagtttttgagcttcctatgaatagactcctacagtgtagtcatttgagactgaattgttttgctcatcagtaggattttgccatccatccatcctgttgcatgtagtaattcattaattttcacttctgtgtcatgcattgtgtgaatatgccacattttttattctgctcttgatatatatttgggttgtttccagtttttacctaccataaaaatgctgatatgagcctttttatttatcatttggcatgcatctgtgtacacttttgctaagtatatacctagtgtgggtttgctaggtcatgggtatgtgtacgttcagctataatatctgctgccaaagtggttgttcaaattcacactcccaccagcagcataagagataatctatttgctccatttccttaccaacatttagtattttcaatttttggacagtctttttaagtttaattattctggtagataatagtgattgtaatttcagtttgcatttccgtgataactaatgaggttgagaaccttttaaaagtttatttgccatctggatagccttacttgtgaagtatctctttaagtttttttgcccagcttttaattgggttgtctttttctaattaatttgtaagagtttattatatattgtagatgtaagtcctttgttgtctatgtgcaattgcaaatatcttctcctgtcccatggattgcctttttattctcttaattgtctcttttgataaccagaagttctagtttcatttttcagtctcttcctttatggttaatggcttttgtgtcttatttaaaatatctttgcctgccccaaggtcataaatatattctcctctgttttcttccagaagcttaatgagcatattggtatagaaaaacatttatagcctaccttgttccatgtagaatttgaggcgattgagatgaatagttagcaaaacggtcttccttttagaagaagataactcttgacaaaaaattgggtattctcccttctaggccatgcactaaagaaacatgacatatttaatctcatagtctctaaagaattcatatgtctgtcctaccctttttagttgggtatgtttcagttggaagcaggcctctaacagcaattcccaaaattttagtttcaattagtatttgaggtttctgcatttttcctcaaatatttgttccctttggctttaaaaactccatatagtagaaaaattaaaatgtgcaaatgtgtgtcgttgttattagctttattcaggttcattatttggaatcaggcttttggaagaatgcttattaggaggcagtattctctacatttatagggtggactatgcctgtatatattttatgtttattcattggaatatgtttgtgtttgtaaatccttccatatatgtgatgactctagagtaaagaaactggctctagaagccttccggagaaatgattttcattattttatgatgacatacgtgtgtttatttctttttttagatggaccaccttgttctttaaaattgccacagaataataatccagatttttctcttggttaaattttctgaggcctcatacagtatttaaaccaccaataataacttgttggcatgaaaaaaatttatttttttctctggtttccttgccttgagcccttggatgtcaggaagggtgaggggaaatatcagtctgcttgggcttagatttatggttgctattgtttatggttgggaaatggattgagtgtgcatagctccatggcctcttggctttaactcatttgcataaatagtgaaaataataaggaatataaaaacaataacaatgacgttattgagcatctatttttactgtacactaagccaaacactttctgtttttttctatataattgttataatagtcctacaaatttggcattttttcccttcaacttttaagttcaggggtacatgtgcaggatgtataggtttgttacataaataaacgtgtgccatggtcgtttgctgcacaaatcatcccatcaccaagctgttaagcctagcatgcattagctattcttcctgatgctctccctcccctcactgacaggcagcagtgtgtgttgttccccctaccatgtgttcatgtgttttcatcattcagctcccacttataagtgagaacatgcaggttttggttttctgttcctgcgttagtttgctgaggataatggcttccaactccatccatgtccctgcaaaggacatgatctcatttttttttggctgcctagtattccatggtgaatatgtaccacattttctttatccagtctatcattgatgggcatttaggttaattccatgtctttgctagatattatttttatcatatttaatgattgttatccttacattttagctaagaaaactgaaccttatataaagtaagtggccaggcacagtggctcacgcctgtaatcccagcgctttgggaggccaaggtgggcggatcatgaggtcaggagttcgagaccagcctggccaacatggtgaaaccccttctctactaaaaatacaaaaaattagctgggcgtggtggcacttgcctgtaatcccagctactgggaggctgaggcaggagaatcacttgaacccgggaggcggaggttgcagtgagccgagaccatgccactgcactctaccctgggcaacagagcaagactccatctcaaaataaatgaataaacaaacaaacaaataaagtaatagcctgagatcaccatgtaagtgagtgacagaaaaaaacaagcctctgtgagactaaagcttgttttctttaccaccatccagtattgtctccgtgacagaaaattattaatttggctgaaatatatctttggtatgggatctggctgtgcctttgtgcagatatcgccccctcccaggttggtttcctcttctaaataaacttggtggccattgtaccaagaacacactaatgtgacgacattttattagaatgaatgggccagtcgtggtggctcacgccagtaatcccaacactttaggaggccaagttagaaggattgcttaaggccaggaattcaagaccagcctggacaacatagtgagaccccatctcttacccaaaaaaaaatttttcaaacgttagccaggcatggtggcatgtgcctgtagtctcagctacttgagaagctgaggcaggaggatcactggagcccaggagttcaaggctatggtaagctatgaccttgccactgcattccagcctgggtggttgagcaagagcttgtctctaaaaatttttttaaaaattagaatgttgggaaccaggatccatgagggtgaataaagaatattgtaagcagtcagtgagttaacagcacatgacaaaactaaatttgtaaaaccatttgctttctagaaaggaatctgccatacctcccagagggcatttagccatccattcagtgcctgaaatctgtcatttgttgattgttatcattgtctttctgttgcttttctaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggtaagttcttttctcacaagtaagttgtgacttaattcatgttttttttttaagttatcagaaccctttagcttgtttttatttttgttgcctcctttcttttctggccttttcatttatttttctcattgattttatcttatttcagtgagatatttcttcaaatgcatacatagaaataaagcaataatatttaaatatgaccttttctttcctcattcatagttaatggcacagatcaaggatagcatataggtctcatgaagttgtttcccaattcaggaagtttgagaatggccatagctgattggccatagctgattggacttctggttgagaattctgaggcaggttcctggcctgaaaagcagtgtgatcagtgagcagggccagaggtagaggcccctctggcaggggcttggagagaatctccaacttcagtattgagcagcaccactgcaactgacagattgctgtgacagtaccccttaatgcaggacttgctacctggaagaaaagttgcaggcctagagcaaaacattcacaaagcagttcttagctacttccacggagttctagagttgtcatacaatattcaaaagataaaatgaaacaaaaacaagcaaataaatttatgtttacatatggaagtaaacataattaataattttaaagtaaatgtgtgccatacaataccataccaacaatactgagaaatgctaggctgaaagataactcattttatacttacacacagttcttgttcatctgttttcagtctaagcagtgttcacgtccaagttttcctgtagatctgtgggtagtttttaagactccgtataagatatggtgaaggatacatttgatctcatttttgtttgaatcacattttatttcatttttgtttgaatcacatttgttcattgttagtataaggatcagtggtttttcttttcttcccgccctccctttttcctttctttcttttgaggctagtatctgaatgcacatgaataaaaaactgaaattatattaaagcagtttggcatgggaatgatagttactctgccagtaaccaatccttattccttgatttttaaagctttttgttttatgtcttttcttgctctgccccctaagaggagaggggagtggtaaatttagggtggcaaccacaaagagaagggaatgaaagactgacagagaagtaaaatcagaatatgaggacataatcaaatggattcatggctcaatgtgcgcttgtgttcataatgcatataatatccatagctatcacaatcattgcaaggctgcctttggcatgaaactaccttattatgaggttcctttggtattttgtaattaattctccttgggtgagttttttaaataaactttttattttggaatagtttgatttacagaaaagttgcagttagtacagggagttctcatatacacctcacagtttcagttcccctaatgttaacatcttactttaccatggtacatatgtcaaaactacaaaaccaatactggtacattactgttaacttcagactttattgggatttcaaggtttttttttccacttacaacctttttctgttccaggatcccatcaagtataccacattgcatttaggcttgtaagaattttaaaagaggattgcagtatctcaagcttttctttagggtgaatgatattgcagtgaggtgtctaagagcttaaagtaaactttttaaaaacaatattaagcgtattatgaattaagaactttttaagttgagtgctgactacatattaagcaccatactaagcaatgtaccaatattacttcatctcagcttcacaacaaatcagtgggtttcttattattatactaatttcatagataagaacactaagccctaaagaggataaataacgtgtcaaagtttacatagctaatatgaggtaaggttggaattttaatccaagttttcttgtaaccagacactatattcctttactccaaaaaaaaaatgtgtaacttgtcttggctggaaaaatgaaacataaggcctgggcagtttttggtttcataagtagccacaccttaaaatggtagtttatgtggaattctaaagtttcttaggacatcttatattacaaatgaagtggaatacttgggtacatttgttttggatcatcttgaggattattccggagtttacaagttgttagaataaatacataagtgctgtcacaaaatttgattaataagtgtggaaggctaagataaagttatagctgagaaaaggaatcaggaagcaaagaaggtaattccagaattgaagttagacctttgtgaatattaacaggtttatatgttgttatagtttgccattgaaaaatattattagattttttaaaagtcatatttgaaaaacaaaatattttatatgtgtaatcacctacacatgggacctagaattttcttttatgggcttcatacatttttatatgaaaatttccttgtataatcattagatatgctcattgaagctaacttgctaagaatgaattattatatccaaatagttatgtgattttaattactatgctacaaattatcgtgtccagaattataaagcttggtgaaagtcctcctacagtgagaataagagaaaatatagagatttaagaggagactggcaaggatttggacaagaaatcgaaagggtcagtaatatatcttctaaggaacatggtgaaatatacatctcctttcatgtgtcaaacactaatatatgattataggtaaatgttagagtagcactagcaaaagattttttgaaatctggttgttttagagcaggaaagagatgtttttatcctttagaatcctacccactcctgcactgggctcacagtaggtgttttgggaatgacagctgactgatgggttgattgattgtttgtatttctgtgcaggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggttagtgagagtggagaccgtcatctccctacggtcagcctttctgaagctcagtgatgatctccagcacgcatatctgggtagcagcttgcatttaagggtgaaaataaagatttggcctggttgttcttcagtatttcctctagaaacaatgcttcttatgacccccaagatgacttgctgactaactttaccccatggggctaaacccaggtctttattgtgtcactttatgcccagaccattgggattgccttgttcagcttgcccctaggcccctgccccagggggatctcattgctgcctgtctgaggtctctcctcttccttcaaatctccatggcctcatgaggttacacccatggtcagtaaccttggtgagtttacacttcctacaaatagaagtccagactccttatcctggcacttgtaaccctcccccatcccctaaacatgccactcctaagaatgtccaccccacttttaaagatcacagaattttaggactgcaaaagactgtctaactcctcaattttacacaaataccgggagaggtgaagtgactttacccaagctggttatttgtcattctttctactatactgcctttttaattaataatgatgattatgatatcaaccctcctttcagctctttccattttttcccccacaagcactgtgttccaacaaaataaggttactcaaggtgcagtgatgaatattcctgacactgtcctatctcccatgtttcagccacactccaatttgtaaatgcctcctcctatgtcccagctatcaaaaatctatatatttttcaaggtctagttcaaatcctttcttgaactcccttaccctaagtgatttttcattcttctgaacctgttgtatatttcattcattttgttaatttgtctagcaaataggtacagtactccgtgggccaggattgtgatgcatgctgaggacacagtcagtgatgaagaggcagacatggtctgtgcccccagggagatcatagtctggtgaaagaaatataaggaaactgccaatttagcatcatatgccaagtgtttttatagatataagtccaagctgctgtggaaatgcatctgtgagaaacgagggtcagggacaacttccaggaggtagcacccaagctaaatcttaatgtccaaaaggagatgtcaagtaaaccagcaatgtgtgttcaggcagagaggagaaatgttcagacagggtagtgaaagcaggcaaaatatgtcagaggcaactgaagccttcagaaactgtaaagtggcagagtagagtagggaaggcatggaaagtgagggtagagagggatacaagagacgtgtgtaaaggaccgtctgacaaactaaggaacttcagttctgtcctgtcaaccctggaggatatgatatgtattttagaaagatcattctggctacaaaatgactaaagtaattagaatagataacatagcagatagaaaccagggcttaagattattttaattccctgggcctcttaacctaaccaccctgtatgtaaaaggtactcagaattattctgtgaccaattgggtctttttcttcatttacctttaacaaagtgaattttgaaaatttgtcttcactttaccaattattggcatttatatcagactttaagtgagagcagaaaatctttaccatttaactatgaacttaagtattatatctcacaatacaagcccagagtcctttctctgcaattccaaaattataaagttctgaaaaacgcatgtttttgctgaagtttcacaccagaactgatttgaggacaataccacaacccacccagtatgaggccatttgtagtccttatccattttgtttaaatactcatatattttgttagagaactattaatgtgtttggttatatggtattgcccctggtcccactgggggcttaggtcatatactatatatatatatatactttcctaagatctgagcaattctgaatttcctaatttttcttaccctagaggtttcagataaatgattgtggatctgtagtaggcttaaaaggaatagcataaaggtcatctgtatatatttcctatgtttgtcctttacagttgggacaaaatagtaagtattctcaggttctttaacaaactcaaatgtagcataattatctccaatgctatttattagtcttaaaaacgattccggtaatgaatataaatgatacccctttctcacatagaaagagatgagatggcaataactgaccagaccttgcagtatgtaaactggtatgtattaaagctgggacattggtaccctataaagtttcacataagagattcttccaaagtgagtatatttacttggattctaaagagatacttggcttagagctccctctgttggctgaaaagtgacttaaaataccttggaagatttggtttactccctaacagaatggggacatgttgacatctgaatttattaaacatgatttttcttctttagtgacaccatattacatttcagtgtttgttcctcagtgacaaaaaatacacttatgtgtactttagaagagatgtgtacataagtagcctttagattttaacaatgaatttaacattttttctttaaaaaatgtgaaagttgggccgggcatggtggctcacgcctgtaatcccagcactttgggaggccgaggcgggtggatcacgaggtcaggagttcaataccagcctggccaatatggtgaaaccccgtctctattaaaaatacaaaaatgagctgggtgtggtggcatgcacctgtagtcccagctgctcgggaggctgaggcagaagaattgcttgaacccaggaggtggacattgcagtgagccaagattgcgccactgcactccagcctgggcgacagagtgagactccatctcaaaaaaaaaaaaatgtgaaagttagggccattctaaatccttttacatgtatctatgatcttatgactgtgagtaagtccacaaaagggctcagtaaatgatgttctgccctatagactggccaggagctaaaggatattccaagagccagtcactgacctgacctctcttctgccagtctgaaagagactctattttagggaggaagcttgctttcatttcctagcaaacattctgggcctcagacaaagagctttaaaggttagaaaccttataaaatgatgccttgctcttgtgagaggagcctacctagagtccagcttcagttcttgagctaaatacatttgttttatccaaccacctactcaagctcagcatagggggcattccaggtaaattgatgataacagctctacctctagtgactttaaaatctcattgagttctgtaggccagggttaattaaaagaaaaaaaaatactaaaaatgtcactgaggagaagaaacacaacagcaaatgtagagaaaaagaatacatgatgctggccgggtgctgtgactcacacctgtaattccagcactttgggagaccaaagtgtggatcacttgagcccaggattttgagagtagcctgggcagtattgcaaaacctcgtctctacaaaaattagctgggcagagtggcacatgcctgtgctcctaggtactcgggaggctaaggtaggacgattgcttgagcccaggaggttgaggctacagtgagccaagatcatgccacagcattccagcctgggtgacagagcaagaccctgtctcaaaaaaaataataataaaattaaagaacacatgatgctgactatgtacttggtgagggaaattgcatggagtggaggatgggagtcaggcagtgggacaaacgcaaggggctacagtgacctgagcaggatttttggaggggcctggagtttgaaccgggtctggaagggtgagaaaggtccaactatgcaaacaacagttgaccatgtagagcagggaagctgcttagacacatggatgtgaaaataagaatgaccagttatggagaaaaccaggaggcctgcctgtccaagtcagaagccctgtgtttgggtatagtggggcatgagatcagatagtgaagtacaaggaacaacaggctttagataaggaaccggcaaactttttctttaaggatccgctgtaaatatttcagtctttatagccacatacagtctctgttacatgttcttcttcttctctttacaaccctttaaaaatgtgaaaaccattcttagcttgttggctttataaaacagaccttggaaaatagccaacccctagtttggatagtggggagcaggtaagagcagaaggaatatctaaagggcttgccactgtacaatggtatgaattcttttagtgaggagaatctggcagtcaagtagaagaagggttgaaggcgtgcagggggaaaaagaaaatgtagaaattaatcaatccaggcatggcataatgagaacttggatagagcaagtggtgaggacggagaggaacgtcagagtcttggggccactgtagggagaatagcaagtaccaggtcagcagatgaaagaaagtgagtaatacaagtctaggaatttggatctggaagataggaagtatggtggtgacacggaaagaaggagcttggaaaaggaccaggttgtggggggaccgatattatggtaactgttataacttgaatctgagttgagggtgaatctcctgaggcagacagaaattttgaagctgccatattgaatcagttagtctctaatagagtagagcagtaaggaggaaatgatgggcaaaattggggatagcaaaaagggagtctagaatgtttcccaaactaatctccagtttctcacagtaattatttgtccaacttcattccataaaggatttgaagcaccttccagaactcattatgaattattgtgattagtgtaatattctattcaagattcattcacaagtccctgtttcttcaacccaagcaagcaattgctacgatttactgagtactttttatgcaccaggcgttaataggctttttataaacgtcagttcatttgctcctcagaagtttcattctctttattttctaaaacttttttcttgatcacaacagtgtatgacttttaggaaatgttcaataagtgtttgactaattataatacatagtcattgaagaagctttagaaaacagaccaaaaaatgctgtaatcacaacactcagataacagttgggttaacggttggctgtatctcctcgtcttgttctatcatccttaaagtcagttctcatggacagacatgctgatcttaggagagatgctggaagttgcttttttgagtatttttaaatcactcgatactggatataagcttgttcggctttatttgcctttctcccaaaagcagaggatactctgtgactgtgtatcagaacagataccaaccctggtgagaaggtgctgaccattctcccctctcctcctcatacctccaggcctgctatggcatcctcaaggtcccagaaggcagctggctgtgtcgctcctgtgtcctgggcatttatccgcaatgtgtgttatgtccaaagaaaggtggagccctgaagaccaccaagacagggactaaatgggctcatgtcagctgtgccctgtggatcccagaggtaagaattcatccaggcccgtgagaccatttgctccagggtgtccctgttccccacagcattcagactgactcaggctcagtatggaaatgcttcatgcttgcccatgtttctgaagtaatagtacttccacttgagctacctcagatccttattggatgcacacttgcatgtaagcccatggtgattaatatataggtggtattcccagtggtatttgggataatacccgaatatatacacgatatttgggataatacccaaatatatacatgatatttgggtatatcatgtataaattgataaatttgtatgagaggagagacacaaaagaccagggtgtgagcagcagaattttttaaggtaaaacttatatttagatgccaaattttaagtgtagagttttgtgatattttacacgtttgtatctgtaaccacaactcagaccaagacatgaaataccctaaaaatagacataaagcaccccagaaagatcctctatacccactttccagtctctatcccccaagaataaccaccatttttgtcttgatcatgatagattaattttatctggttttaaacttcatacagtatgtatttttttcggtctggctaacactccatgttgtggtgtatatcaatagtttattcctttctattgctaatattccattgtatggatatactctgatttattcattttcctttgatgggcatttgggttgtttacaggtttaggctattacaaataaagtgagcagtaactctttgtctactgtgatgatgccctttacttttttatttttatttattttattttatttttgagacagagtctcgctctgtcacccaggctggagtgcagtggcgctatctcggctcactgcaaacttcacctctcaggttcacgccattcttctgcctcagcctcccgagtagctgggactacaggtgcccgccaccatgcctggctaattttttttttttttttttggtatttttagtagagacggggtttcaccgtgttagccagcatggtctcgatctcctgacctcacgtgatccacctgtctaggcctcccaaagtgctgggattacaggcgtgagccactgcgcccggccgatgccctttactttttgaagctctttttagggcttacactcaacacctgccaaagaccttctttactcaaaattcaattttttatcattatctagcctggtccttcagttgctggtatttcctgagtggctacatgtacactaacttaattaaaatggggcttgaagacatttcttcttatggctgcctttttttttctttagctgtgtggatatcccactcatgccctctctccccagccactatccaaaccagcaaatttgttaggcagtttaactgcatgacaagagagactgcagaatctagttaatggggagctgacattatatcagtaactcattctcctttaagattttcttgtttttaatcttgttaatattggttccaggggagttattgtctaataaagaagctcagagttacactaaaagtcccatatatatacttttgtattcctatggctatagacatcagtattttaaaaaaatatttgaatagtagtttctttttctcactaagaacatctagacataaaataaactcaggtttctggcttgagaatgactgttttccaacagcaaatccctcagctaatagagtaggctctctcagcttataaaagtccagaacatgactcaggaagagctctttaaaaacaaaatagactttctcagttattgacattctcttatgatttctagttcttggtttccagtgccttctggactactcaagatctgttagtttcctgatgtgggcagaaccagtactagtttggcatccttatttgacagttcttcaccttttaaagctgtatctctcttagaaactcatgtatatatttggcggggtggggggaatgaaaatactttttaccagcagttgcttgaccccttattttcacatggaaaagaatatttccatctttttaaaaaacatccctttctgctgggtgtggtgactcacgcctataatcccagcactttgggaggtcgaggcaggcagatcacttgagtccaggagtttgagaccagcctgggcaacatggcaaaaccccatctctactacaaatacaaaaaattagccaggtgtggtggtgcatgcctgtagtcccagatattcagggggctgaggcggcaggatcacttgagcctgggaggtcgaggctgcagtgagccctgatcctgccactgcactctagcctgggtgacagagtgagaccctgattcaaaaaggaaaacagaaaaagcatcccttttttgatggggttgtttgtttttttcttgtaaatttggttgagttcattgtagattctggatattagccctttgtcagatgagtaggttgtgaaaattttctcccattttgtaggttgcctgttcactcatgaacagacacttctcaaaagaagacatttatgcagccaaaaaacacatgaaaaaatgctcatcatcactggccatcagagaaatgcaaatcaaaaccacgatgagataccatctcacaccagttagaatggcaatcattaaaaaagtcaggaaacaacaggtgctggagaggatgtggagaaataggaacacttttacactgttggtgggactgtaaactagttcaaccattgtggaagtcagtgtggcgattcctcagggatctagaagtagaaataccatttgacccagccatcccattactgggtatatacccaaaggactataaatcttgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtagggggaggggggagggatagcattgggagatatacctaatgctagatgacgagttggtgggtgcagcgcaccagcatggcacatgtatacatctgtaactaacctgcacaatgtgcacatgtaccctaaaacttaaagtataataaaaaaaaaaaggaaaaaaaaaaagcatccctttcttttcagcactctcccaaagacttaatttcactttgaagctactttggctgagggagtagggtaagctcatgatagttatgtggttttaaagacttttgttttaaaatgtcatcctcctcctttctacttacattctgcagtctcttcattacacggatgtgctgtttttcaacaatatcatggttcctttgtaaatcaaatggaaagacttgtcactccctctgttttttatccttagttgattaaatgaaacaacaaggcatgtagcaccatctcttaacataatagatactcgatttagttactttcagtagctttctttggttcctaagtaaaagtgtccattacggtaaccttggctgggcgcagtggctcatgcctgtaatcccagtactttgggaggccaaggcaggaggatcacttgaggccaggagttcaagaccagcctgaggtaacatagcaagacctggtctctacaaaaaaaataataataatttttaattttgtgggtacatattaggtgtatatatttacgggatgcatgagattttgatacaggcatgtaatgcctaataatgacatcatgaaacatggggtattcatccccttcaagcatttatcctttttgtgttacaaacaatccagttatgttcttgtagttatttttatatgtacagttaagttattttgactatagtcaccctgttgtgccatcaaatagtaggtcttattcattctttctgactatcctttttgtacccattaattatcgtcaccctcctcctgccctgttccccccactacccttcccaccctctggtaaccatcctcctacagtctatctccttgagttcagttgtttttatttttagatcccacaaataaatgagaacatgcaatgtgtgtctttctgtgcctggcttatttcacttgacgtaatgacctccagttctgtccacgttgttggaaatgacaggatttcgttcttttatatggttgaatagtactccattgtatatatgtaccacattttctttatccattcgtctgttgatggacacttagcttatttccaaatcttgactatcgtgaacattgctgcaaaaaatatgggagtgcagatacctctttgatataccgttttcctttcttttgggtatatacccaacagtgggattgctggataatatggtagctctattttttgtgttttttttagaatcctccaaactattctccatagtggttgtactaatttacattcccaccaacagtgtataaacatttccttttctccacagtgtttgagggttcccttttctccactcctcaccagcatttgttattgcctgtcatttagataaaagccaaaaatatttttttttaattagccaggtgtggtagaggctgtggtgggaggatcacttgaacccagcagttcaaggctgtagtaagccatgattgcaccactgaactctagcctgagtgacagagggagaccttgtctctaaaaaaaaaaaaaaaaaagaagaaagaaagaaagaaaagtaaaaggtaatcatgcctagtctatactcctgctctctcatcccatatgtgaattatttacattactggaaatgagtgaaggactgagcagtggaaataagttttgtttattcttgattccatattaaccttaagagatgtgacttacctcattgttttgatgttcttagctttatgtaacatcgtttatggtttgtgaaaggtacttctgggatgccttggtacttctgccttatggtggtattttatttgtaggtcagcattgcttgtcctgagaggatggaaccgatcacgaagatctcccacatcccacccagtcggtgggccttagtctgcaacttgtgcaagttgaagacgggggcttgtattcaggtaagtccccatgagaagtggtagagtgggctaacaccaaattagctggactcaccctcccagtgagagtgtcctgtcgactgaaaggtcactcaggagatcgcccacccactcttagggctctgccattgtacggaccatttctggaaatcccttttttggatattgcctctggaccattcagcttattcttttcaatattcgtagtgatagtttatcttcatcctttgctgtcagagctgatgaattaagtgagttctaaagctagttgataccatcctgggtggaaatcggctataattctgaaacaaccaggcccatgttcttttttttttttttaatttcaacttttattttcaattttggggttacatgtgcacatttgttacatgggtatattgtgtaatgctgaggtttgaaatacatttggttgtatcacccatatagtgagcatagtaagtacccaataggtagttttttaacccttgtactctccctcctccctctagtaatccccactgtctatttttcctgtctttatgtctgtgtatacccactgtttagctcccgtttgtaagtgagaacatgtggtatttggttttctgtttctgaattaatttgcttagaataatggcctccagctgcacccatgttgctgcaaaggacatgatttctttttttgttttttctgtctttccaacttttattttctgttcaagggtacatgtccaggtttgttacatgggtaaattgtgtgttgcagaggtttggtgtacagataattttctcacccaggtaatcagcataatacccaacaggtagtttttcaatcctaaccctcaagtaggccccaatgtctgttgttcccttctttgtgtccatgcctactcaatgtttagctccacttataagtgagaacatgcagtatatggttttctgcaattaggggagacgtggatgggattgggaagggccagttacctccagcaaaggcacaaaggttgctttctctttccatgttatttctccttctatcccaaatgtaataagatggctcttctggctagagggatggaagggctgacctttcacctctcagacctcctacatgtgaactgcaagctggttggagttatatttgcctgccgaccttctttggtgaagaggggacattgcacagtgcaggggtccgcaacctgccacagacaggtactggtccatggcctgttaggaaccgggccgcacagcaggagataagtggtgagcaagtgagcattaccacttgaactccgcctcctgtcagatcagcagtggcattagattctcataggagtgtgaaccgtgttgtgaactgcgcatgcgagggatctaggttgagcactccttatgagaatgtaatgcctgatgatctgtcaccgtctcccatcacccccagatgggatcgtctagttgcaggaaaacaagctcagggctcccactgattctacattatggtgagttgtatagttatttcattatatattacaatgtaataataatagaaataaagtgtacaataaatgtaatgtgcttgaatcatcccaaaaccatctccctccagtccatggaaaaattatctttcacaaaactggtccctggtgccaaaaaggctggggaccactggctttagggataatgactctaggtgctttgtgacatttcttgctgtctggcatgataatattttccaggcttatcgtgtagatttcttgctctagacctgggattagctattcttccaaggaacccagggtcttttactgggaagttgtaattgaagaacacaatctggacccccaaaggcccttttaattttttgaattcattcttatatttgacagaattggctacttcttcttttttttaacctttcttggatgattttatttattttaactatggcactttaaaaatcataaaggaaaaatatttaaaggaaaactctttccatggagactactaccctaggacattgcctgtgtgtttatctaagctctctcctggttgctgcccatgtgtgagtcccttgagggccaagattgtgcatcatttttctgtgaatttccctggcacaaagtagagagcctgcccattgttagtacttaattatggtttatcaaataaatacattcatgttttattgtaccatggattcatttgtgatatgcatttccccctctaaaaataatatatttttcatttttcagttattggtcattttatagtagcacattggatttatatccagtaacttattttctttattgtggtcactgtagtttcccccatttttgcttttgttgtgggacagggtctcactctgtcacctaggctggagtgcagtgacacaatcatagctcactgcagccttgaactcccgggctcaaatgatcctcccgagtagctgataccacaggtacacgccactacacctggctcatttaaaaaattttttttttgtagagacaggatttcgctgtgttgtccaggctggtctcgaactcctggcctcaagtgagcctcctgccttggccttccaatccaaagtgctgggattacaggcatgagcactgtgctcttttttttttttggtccgagtctctccttgttgcccaggcttgagtgcaatggcgcaatctcagctcactgcaacctctgcctcctgggttcaagtgattcccctgcctcagcctcccaagtagctgggattacaggcacacaccaccacacccagctaattttttgtatctttagtagagatgagatttcaccatgttggccaggctggtctcgaacctcaggtgatccactcgccttggcctcccaaagtgctgggattacaggcatgagccaccacacctggcctttttttttcttttctttctttttttcttttttttttaaagagagacagagccttgctttgtcacttaggctggagtgcagtggtgagatcatagctcactataaccttgaacttctgagctcaagcaatccttccacctcagtctcccaagtagctaggtctgtaggcacatgccaccatggctggctaatttttttgttttgtagagatagggtcttgctgtgttgcccaggcttatttttttctacaataattagtaattggcaataagactttggtgagagaaaatattggccttgaccttaacagacctggatttgtattacagccctgatgtaccacattctgccactattatggttatttatctatgagttttatctgccctagtagactgtaaacttagactttcatccttagatcccctatacccgaatctagtagacagacaattaatagattgatggatggatgatggatgaacagtttgagagatgaaacattctggtgtaagtttctcatttgcagagcaatgattcttactttcattacttgagttcagcttctttattttataaaggtcttaccaaattgagactcttacaattttgattataaggaatttcattacagagactcctctgcatgaggaaaggggaggaaacgtagaaaggactttgtcatacagcttgggtgccagctcagccacagtagaagaaagcatcagataagattcctaaggttcttgactccaggccttgggtcccagatagtatctctggacccacccaaggccaggaggaattcgccaccctgaaaggaaggacacaagccttgctggatttgccacctactgattgtagagcccttgggatgtgaacgaacataggtagtagccaggcagtgatcactgcaggccttgggcgagacccaatgctgtgctggctttagatctgactgggtgcagtcccagtggtggtggccataggggtgcttgtattagccctcctccatctccaggcaactcagcacagagagagacttcatttgtttagagggaagtaagggagaagaacaagaatctctgcctgttaatccagggagttcttccagatattacccagtaacaccaacgtagtatatctacaagtctgcaagagccatggcattactaggcttgcagtgcctcctaaagcagatatggccgtagtgaccaaagacttagatcacaacacccaagtccctctgaatacctggaaagtcttccgaagaaggatggatacaaacaagcccagactgcaaagactacaataaatgctgactcttcaatgcccagacactgatgaacatccacaagcatcaagaccatccaggaaaacatgacctcacaaaatgaactaaataaggcaacagtgattaatcctggagagacagatatataacctttcagatggaaaattcaatgtagctattttgaggaagctcagcaaaatccaagataacacagagaaggaattcagaatcccatcaggtaaatttaacaaagacattgaagtaatggaaaagaggctgggtgcagtggctcacgcctgtaatcccagcactttgggaggccaaggcgggtggatcgcaaggtcaggagattgagaccatcctggctaacatggtgaaaccccgtctctactaaaaatacaaaaaattagccaggtgtggtggtgggcgcctgtagtcccagctacccgggaggctgaggcaggagaatagtgtgaacctgggaggcggagcttgcagtgagccaagatcatgccactgcactccagcctgggcgacagagtgagactctgtttcaaaaaaaaaaaaaaaagaaagaaataatggaaaagaatcaagcagaaattctggagctgaaaaatgcaattgacagactgaagaatacatcagagtctcttaacagcagacttaagcagaagaattagtgagcctgaagacaagctatttgaaaatgcacaatgagaggtgacaaaaggaaaaagaatgaagcatgcctacaagatgtagaaaatagcctcagaagggcaaatctaagaatgactggccttaaagaggaggtagagagagagatcagagtagaaagtttattcaaagggataataacagagaacttcccaaatgtagagaaatgtatatcaatattcaagtacaagaagattataaaacatcaagcatatttaactgaaataagactacctcaagacatgtaataatcaaactcccaaaggtcaaggataaagaaaggaccctaaaaacagcaagagaaaagaaacaaataacatacaatggagctccaatacatctagcagcagacttttcattggaaaccttacaggccaggagagagtggcatgacatattaaaagttttgaaggagaaaaacttttatcctagaatagtatatccagtgaaaatatcattcaaacgtgaaggagaaataaggactttcccaaataaacaaaagctgagggatttcatcaacaccaggcctgtcctacaaaaaatgttaaagggagttcttcagtcttgaaagaaaaggatgttaatggcaataagaaatcatctgaaggtgcaaaactcactggtaatagtacacagaaaaacatggaatattataatattgtaattgtggtatgaaaactcctatcttgaatagaaagactaaaagattagccagtcaaaaataataattacaacaacttttgaagacatggacagtataataagatgtaagtagaaacagcaaaaagttaaggggatgaagttgaagtgtagagtttttgttttctccttgcttctttgttaatttgtttatgcaatcagtgttaagttgtcatcagtttaaaataatgggttataagatattatccgcaaggcccatggtaaacctcaaatcaaaaacatacaacagatacacacaaaaataaaaagcaagaagttaagacataccacctgagaatatcaccttcactaaaaggaagacaagaacaaaagaaggaaggaagaaaagaccacaagacaaccagaaaacaaataaaatggcaggaataagtccttacttatcaataacattgaatgtaaatggacaaaactctccaaaagacacagagtggctgaatcaatacaaaaaacaaggcccaatgatctgttgcttacaggaaacatgcttcactatacatacacatataggctgaaaataaagggatggaaaaatatattccatgcaaatggaaatcaaaaagcaggagtagctatacttaatagaaaaaaactataaaaggagacaaaaagatcattatataatgataaaggattcagttcagcaagaagatagaacagttgtaaatatatatacacccaattctggagcaaccagaaatataaagcaaatattattagagttaaagagatagacctcaataaaataatagctagagactttaataccttgctttcagcattggacaaatcatccagataaaaaatgaagtatcagacttaatctgtactgtagaccaaatcaaccaagtagatatttacagaacatttcatccaacagctgcagaatatacattcttctcctcagcacatggagtattctcaaggatagaccatgtgtcaggtgccaaaacaagtcttaaaataatttttaaaaattgaaatcatcaattatcttctctggccacagtggaataaaactagaaatcaataacgaagaattttggaaactatacaaacacttagaaattaaacaacatgctcctgaacgaccagtaggtcaatgaaggaattaagaagaaaatttaaaactgtcttgaaacaaaaaaaaaaaaatgggaacacaacataccaaaacctatgggatatagcaaaagcagtactaagaggaaagtttataacaataagcatgtatatcaaaaaagtagaaaaacttcaaccttatgatgcatcttaaagaactagaaaaacgagcaaacaaaaccctaaattagtagaagaaaggaaatataaagatcagagcagaaataagtgaagttgaaatggaaaaaaaagatcaacaaaacaaaaagttggttttttgaaaagataaaatcaccaaacctttagcccaactcactgagaaaaaaaaagagagaaaccccaaataaataaaatcagagatgaaaaaggagacattgctactgatactgcagaaattcaaaggatcattagaggctgctatgagcaactatatatgccaacaaactggaaaacctagaagaagtgaacagattcctagacacatacaacctaccaagattgaaccatgatgaaatttaaaatctgaacggaccagtaacagatggtgagattgaagtcgttataaaaagtttcccttcaaagaaaatcctgggacccagtggcttctctactgaattttacaaaacatttaaagaagaactagtaccagtgttactcaaactattccaaaaaatagaagagaagggaatacttttaaactcattctacaaagccagtattaccctgataccaaaatcagacaaagacacatcaaaaaaagaaaactacaggccagtattctggatgaacattgatgcagaaatcctcaacaaagtactggaacaccaaatttaacaatactttgaaaagatcattcaccatgaccagtttattgagggtttttatcatgaaggatgttgaattttatcaaatgctttttcagcatcagttgaaacgatcatacggtttttgtccctcatgctgaagatacgatttttcacactgcttgatttgcatatgttgagccatccttgcatccctaggataaatcccacttggtcatgatgaatgattgttttaaaataactaaaagggtataattggattgtttgtaacataaaggataaatgcttgaggtgtgggatagaaattgaataacatagagtggctagaataaaaatcttgaaaaagaacaccagagactgatttaggaattaaggcatatcattcctctttgaagaaactttgggttggatgcagtggctcatacctaaaatcccagtgctttgggagcccgaggcaagaggattgtttaaagccagaagttcaagataagcctgggcacggaaactcttcttataaatgtggatttgtaaaaggtagcatttttcctctagtgaaagcatttgaaaaagtatttttcttctacaattcctgaagaatatgtagaaaattgtttttccagctgggcacggttgctcatgcctgtaatcccagcacttcgggaggccaaggtgagcagatcacctgaggccaggagttcaagaccagcctgaccaacttgatgaaactccgtctctactaaaaatacaaaaagtagttgggcatggtggcatgtgcctgtaatcccagctacttgggaggctgagacaggagaatcgcttgaacccaggagaggcagaggttgcggtgagccgagatcgcaccattgcactccagcctgggcaacaagagcgaaactccattacaaaaaaaaaaaaaaagtaaataaaccacagtgagataccatttcatacctactagggtggcagtaataagaaaggcaaacaatcaaggatgtgggaaaattggaaccctcatgcattgttggtggaagtaaaaacgatgcagctgctgtgaaaaaagtttggcagctcctcaaaatgttaaacatagagttaccttataaaccagtaattctactcctaagtatatactgcagtttaagagatcaccaagaccattctcaggttcagtaattcactagaaggactcacagaactcagaagaacagttatactcacagttatagtttattatagtgaaaagatacagatttaaaattagccaaggatagaggcacataaggcatggtccaggagagacctggaatgcagcttccagttacccctgccagtggagtggtgcagatagtgcttatttctcccagcagcaatgtataatacacatagagtattgctagccaggaaagctcacccttggtgttcagcgattttattgagagttggccacgtaggcattgctcaccatccacgtggctgatgttactctccagtccctccagaggtcaggctgatagaaggtgccccaaagtctctaccataaatcacatcgttagcatagactatctcacttggcccaaggacccaaggtaaacaaagacactcttatcaggcaggacattccaggggcttaaaggttacttctaaggagctaaagacaaacagccaaactttttttttagacaaggttatcctttaccgcacaatacccaagagaaacaaaaacatatatccacacaaaaactgctgcatgaattttcatagcaccattatttcataacagacaaaaagttaaaacaacccaaatgtccatcaactcgatgaaatggggtatatccatacaattattttttgcccataaaaaggaatgaagttataatacatgctacaacatagaggaacctgaagaacatgctaagtgaaagaagccagactcacacagccacatattgttgtaattccacttatatgaaatgtccagaataggcacatcaatagagacagaaagtagattagtagttgcttggggctggagttggtaacagggagtaactacaaatggacacaagatttggggttggtggtgatgaaaatatcctgggattaggtagtggcaatggttgcatgactgtaaatatattgaaaaccattgaaatgtacacattaaactggtgaactttatggtatataaaatatatcttaataaagctatttctgtcatttcagtgaatgaatataatgaccatgctgtaatgcacgtagtaaagtgtttaaagacacatgtataaaagatgctttgtacaagtgctatttgcttgccacaatgagaacagtgctatctcaattttttattttaaatttgtaaagataaaaatattttttaaatgggcataataaaacctctctatcaccttccgtggttacagtggaaataagtgagatgtatgcaaaggcattttgtttaatagaatgcgccagacatatgttttagaagaaaacaaataggtatctggtatctgactggcacctttcttcttcttttttttttttttttttttccctgagactgagtcttgctctgtcgcccaggctggagtgcagtggcgcgatctcggctcactgcaacctccacctcccaggttcaagcaattctctgcctcagcctcctgagtagctgggattacaggtgcccgcctgtaatttttagtagggatggggtttcaccatcttggccaggctggtcttgaactcctgacccatgatccaactgcctcagcctcccaaaatgctgggattataggcgtgagccaccgcgcccaaccctttttttttttcagggtctcactcctatcgcccaggccggagtgcagtggcacaatcacggctcactgcagcctcaacttcccaggctcccacctcagcctccctagtagctgagaccacaggtgtgcaccaccacacccagctaatttttgtattttttgtagagacagggtttcgtcatgtttcccaggctggtcttgaactcctggactgtaacagtccttgcgtcttggcctcccaaagtgctgggattataggcgtgagccactgcgcctggctcttcttcttcttttttttttttttttttttttttgagagggagtctcgccctgtcgtccaggctggagtgcaatggcgcgatcttggctcactgcaacctctgcctcctgggttcaagcaattctcctgcctcagcctcccaagtagctgggattacaggcgtgtgtcactgcacccggcactcttcttcttttttttaatggtaatattattgtacgttttttgttgttttacagtctagctggagtgcagtggcacaatcgtggctccttttagcctcgacctcctgagctcaagtaatcctcccacctcagccttccgagtaccacaggcgtgcaccaccacactctgctagtttttttatttttattagagacgaggtctcactatgttacccaggctggtctcaaacctttgagctcaagcgatcctcttgcctcagcctcccaaggtgctgggattataggcatgagccaccatgctcagcccaagttttatcttttaaattgcaatttttattaacacattgtagttgtacatatttgtggggtataatttgatgtctttatatatgttgtatagtcaaatcaggatatttagcatatctgtcatctcatgcgtttatcatttgtttatggtgagaacattcaaaagcctctcttctagctattttgtaaaatataatacccttctgttaactgtcgtcaccctgtgcaatggaacaccagaacttattcctcccaattataacttcgtacccattgaccagcatttttcaccaccaaaatatatagatctccagctataaataccacagaattacctttttttgaaaagagttggattttatggcagtttcctaaaaggtattatatttttcatataagtacccaattcttacctatgcattatcttttattttgagtaatttatgtttatatttgtctctacattctataaacattctataaatttgacctgagaagatctgtttttagcttcccaataatagtagtttgatgtcacttactcattcccttgaatagaaaatcatttgctttttcttcccatatctttaacagttattaaacagcaaaagagtactgtgcccaacactttaaatcttttactaaagaataccttttactttgtttttcaaacgtctgactagtttcttagccaagtgataacaaaaggtacccaggtaaaagtacatcttgaactttcatcatcctcattttcgagaggcttcagtgtaatataacaaacttttctgatagtggtgttaaaagccggggtggaccatcttaggagcttcttatctggaagaattcagtaagtggctagattaccacttaattggaaagtggagggggaggtgtatagagtgggggatggaggcagaaaatcaggtactctcgaggaaattcaagcaataataaatgtaaggctggattagatgatcttagaattatatttcatccctggaattctttatcatatgaaattagtttaaatgaaatatggaatatgcccctttaaaactttgacagttgccagtatcctcttaggtgttgaatttctcaatctaagatgatctattgggcctttgcattctttttgtctttattcatatgtaagaattaacacttggctttaaccataagaattcccaatatttccttagaaacgaatcttcccttactttccccacttcctctacataaacacatagatgcactcatgcattttaaatctttgggcagcagggtgcagtggctcatgcctgtaatcccagcactttgggaggccaaggtgggcggataacttgaggccaggagttcaagaccagaccagcctggccaacatggtgaaaccccgtctctactataaatacaaaaattagccaggcatggtggtgcacacctgtagtcccagctactcgggaggctgaggcaagagaatcgattgaacccaggaggcagaggttacagtgagccgagatcacgccactgcactccagcctgggcaacagagtgagactctgtctcccaaaaaaaaaaaattaggcctggcacagtggcttatgcctgtaatcccagcactttgggaggccgaggtgggcagatcatttgaggtcaggagtttgagaccagcctggctaattggtgaaaccccgtctctactaaaatacaaaaattagcaggacttggtggcgcacgcctataatcccagctactcacaaggctaaggtgggaggatcacttgagcctgggaggcagaggttgcagcgagccaaaatcgcgccactgcactccagcctgggcaacagagtgagacccagtctcaatcaatcagtcagtctttggaaggaaagctgtaacattgtaaccataacaaatagtaattaaggctaactgaagcacaggagtatagtagtcatgggccaggtccttccccctttgcccccccctatgaatagtcagtacatactgcatagtaatgcttaataaatgtgttaaatctatgactgaatggcagaatattataaacttaatttcagattgtctgtaaccatattgttcaatagaactttccacagtgggccaggcacagtggctcacacctgtaatcccagcactttggcatgctgaggcgggcggatcacctgaggccaagcattcgagaccaggctggccaacatagtgaaaccctgtctctaccaaaaatacaaaaaaattagccaggtgtggtggcaggcacgtgtagtcccagctacttgggaggctgaggcaggagaatcacttgaaccctggaggtggaggttgcaatgagccgagattgtgccactgccctccagcctcagcaacagagtgagactctgtctcaaaaaaaaaaaaaaaaaaaaaaaaaactttccacagtgatggaaatgttttatgtctgtgctgtctagtgtagttaaaatgtggctactgtgactgagaaactaaattttttaattatacataattttaattaaatttaaggctaagcgcagtggctcacacctgtaatcccagcactttgggaggctaaggcagtcaaatcacttgaggtcaggagtttgagaccagcctgaccaacatagtgaaaccccatctctactaaaaatacaaaaattagccgggcatggtggcacatgcctgtaatcccagctactcgggaggctgaggcaggagaattgcttgaacctgggaggcagaggttgcagtgagccgagattgcaccactgcactccagcctgggtgacaaagtgagacaccgtctaaaaaaatttttttaaaaaatgaaatagccactcatggctacttggccaccaagttggacagctcagttctataacaacaatttcacggggcatggtggctcacacctgtaatcccaacgctttaggaggctgaggctggtggatcacttgagcccaggagttcaagaccagcctgagcaacatagattctctatttttaaatattttaaaaaattctttttgagataggttctcactctgttgcccaggctggagtacattggtgtgatctcggctcactgcagcttggacctcccgggttcaggcaattctcatgcctcagcctcccaagtagctgggactacagacatgcaccaccatgcccagaaagcttttgtatttttagtagagacagggtttcgccatgttgcccaagctggtctcgaactcctggcctcaagtgatccacctgccttggcctcccaaagtgctgggatcacaggcgtaagccactgtgctctggcctaaaatttttatgtttaaaaaaaaaattcaagaagttaggttacttagatattggaattcctatgacttttttagaaccagtggatgctctagcaataatactcactttgtgtgttttcttttgtttgtttagaaacattttctgagcaactgcttcttcaatagttaatgacgatgcaaaatgaaagacacagcttctgtttttaagatctatccctaaggacttgacaattgttataggtacagtgtgaaaagtaccattttaaaagcattcatagggtgatgtgggagacacagagaagagactacatgactgtttacaggagcccaggaaagcatctcagaaaacttgatgcttgaatgcttgagctgaaacctcaaaaggagtgtttgaattatttttggcctctgtgtttgctgttttctgtaagaacaggtttcttgggttacttgtaaagcatctgttatggtcagtttaggactaactttctcccggtctttcttttgcttcctacaagctatcaatttaggtccagaaacataggtctctcccttttcctccaactctgctaccttgacacctattttcttcctacagtgctctataaaaagctgcatcactgccttccacgtcacctgtgcctttgagcacggcctagagatgaagaccatcctagatgagggagacgaagtgaagttcaagtcatattgcctcaagcatagccaaaacaggcagaaacttggagaagctgagtacccccaccacagggctaaagagcagagccaggccaaaagtgagaaaaccagcctgcgggcacagaagcttcgggagctggaggaggagttctattccttggtacgagtggaagatgtggccgcagagctgggtatgcccacgctagctgtggactttatctataactactggaaactgaagcggaaaagtaacttcaataagccattatttcctccaaaggaggatgaagaaaatgggctggtgcagccaaaagaggaaagcattcacactcgaatgagaatgtttatgcatctacgccaggacctggagagggtaaggtgaccagctgtgactagtatataggcctcggtctgtgtagaaatggaggtcccacttctggtttaataatggtcagtcagctcataatagtgtgggcttctgtgtccttgcttatcttctgatctctttatggccccagacattgggctctgtgtaaattctgacaggcacatccaggggatttgggaggcctcgggtatatgctctatgaactttacatttgaaataaactctcatttggtttactttttattcactgttgagcctaaattggcccatccatattttactgacatatttatgagactttaggctgaagaaagagtgaattttgttcaggaaaacaccaaattagagtttcacaaacttggcactgttgacattttggactggatagttgtttgttgttagggggctgtcctttgttgtaggggcaatttaagatgtttaccagcatccctggcctctacccactagatgccagtagcacccgcacacacacccccagcgtgacaaccaaaaatgtctgcaaattaccaaatttgctctccagttgagagccactccacatgataattcaatataactcatggtatatttatcaggtatctactaaatgagatactgcagggcttcaaaggtaagttaagccctgtgtttatcctagagaattttctaattaaatgtaaatctataaatggcttgtgtttttttttctctgctaccagaatttgaaagagaactaatagatttggctcacttttaaaaatttaagacactcacatatagcacctactattactattattgccaacactgtcctaagcattttataaatattaattcatttaattctaacatgcccatgaaaaactattattatcatcatcactatttacagatgaacaaactggggcaaagaaagtttgtgtaacttgcctaggtagggagtatgagagagagagtatttcacctttgtggctgtggaaacttggttgagctgaaagtgtgagcaaaaaaaacacttctagtcttcccagtggaactgtatcctgctcgtccggcactgattagaaaattgtactggatacagccagcattgccatcattcgtactcagggatctaaagggaaggctgaattgttaaaccattattcagcttcccaacctggctgtgcaaataaatatcaagcccatgacactgcaaagagagtaggtttcagaaggcagatttggagcattttgcttttactattggttgatagatcccagaattgaccatgctgtgtgaattcctgtggagtgggtctcattctgcagctcttggattctgtcttctctcctcacccccacctgactttaggtctttattttagccaaacaatttcagttgtcaggtttgcttaacatgacaaacatctctatttgttggggattgggctttcaggtccgaaatctgtgctatatgataagcagacgagagaagctgaagctgtcacacaacaaaatacaggaacagatcttcggtttgcaagtccagcttcttaaccaagaaattgatgcaggtaacctgtatatttaaaatgtcctaacaaatatgtagactctggttatatcctatcttaacaatttaaatttcatgccagtcattccacttaaaaatcttttaaaattcttgtcagatatctcatttgcttcagtctaatcttaatataacctggcccatttcactgtcagttcataaggcaagaaatcccagggtggggtaggaggagttgcaggtctagggcaggtaatctaggtcccaaacagatattcgaggccattagtggaagccatgaaattattctgtaattatcaaattcatttagaaattgacgggataggatctaacacgtttccagaaaacacttaattctagggttactcatcttaacaatagtctattaaaacaaatccttagccagaagtaagtttggagatctgagttgttatcttttcatttattcactaatatttgttgagcacctacagtggactaagagctgagctacaagatacagtagaaagcaagacaaaatccctgcctgtagggtacactgcccacttggtgagcaagacaggtgagcataattatagtgccctaagcatagggagctgggctggaatgatgacagtcatattcagtgacacctgtaaactccctgtgcctcatttaacacagaggtcaatggcagagcctgggcaactaggggtcactggacagggtgtgcagaatcagctcctgccaagggagggtcagccatggagcatgagagagactcagaaatgaggtgacaggtgggtgtcagaggccttggggtatctgagtgtcatgggtctcaacagagtagtgtagcaggaggcagcaagactgctcagccacaaagggcaacatgacaagcaaaacaaggagaagcagaggacaacagggagagtccctgcatgccaaggaaattggctcctacccacatgccttctgatgtgtaggagtcaacctcattatgacttgcagcatcagcaggtgacagctcctgacagagatgggggttgtgggtgttcaaggtggacctttggggaacaaatgctgcccactgggatacctaagagctgtcctcttgatatctcatttttgtgagggtacagtaagatggtaatgggcaaaggtcaagtccatatacaaggaggaattgtttgatagtgctttttaaatttcaaagtacttgaaataatagaagaagacctgctctgactgtgattgtaggatgacttaactgagaaactgattgccgatactccccaaccaatcctatagcaggctggttggcaggaatgttatgattcttttctgctggccttaccactacaaaacctcccaccaccataatgttcatttgtagtcaggaaattattctaggttaaggatataaaatttatgggaaccacccaactatcacctctaatgccaagttcaaacacatacatactcttcacccaccaaaacccttgcaacgtttctgaaggtttgtgtttgccttgcttcaggaaggccagaagagattagaggatggggcctgaaatgtgtgtgtttaagacacatactaagtgctgtgccataccaacacatgcatgcacagacacacaaataggaagaccctattctaaaccattgctagagacattcttctcagaaatggaagggcagagatgggacgcaggaggcaacacactagtttgtgatcattttacagactgaaagagcagaggtgaagaggtgtggagccatatagcaaacagtggcattgctgagttcattcttggccccaacctctagttcagctcactccagctgctacaccatgatatacatacatagcagagccaggtgcttgttaaacatttggaagagtaggtatgtgaactcactctgccataagcacaaaagccattatttaaatcggttgttaaaacgaatctttcttttttatctcagggcttcctttgacaaatgcacttgaaaactcactgttttacccaccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccagggtatttgctcagtaaatattttggggcagctttccggttatataacacattgacaagtatatgtattaagagtccttgcattgttaactgatttgcaagagaccatgattatcagacactaaaactacttatcttttgaagctacagcatgtgactccccagagctcctgtctgtaggaagtttctaattccctggtatctataaacccttttcaggggagagaccggagaccccatcttagatactgtcaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcccctttttaccaatactttttcattaaattatgaaaactgcta

SEQ ID NO: 5669 - DNA, 148905 bp, human; identical to SEQ ID NO: 5668

SEQ ID NO: 5670 - DNA, 148905 bp, human; identical to SEQ ID NO: 5668

SEQ ID NO: 5671 - DNA, 148772 bp, human
tacaatagtgctccgcgccgcctcagccgccgccgccgcccaaccgcctgcccagcgctgaggcctgacgggccgggcggacgagggccgagggcgggagctgaggcgcggggggcggccccggcggggggcgggggcgaggaggggattaaggggcaggtgcgagggagggaagagaagaaagcgagcggttaggggggcggttaccactccgaccggactcacccggcacattgccgggccgcggcgtggagccgggcaggagccgcgagccagctgcgcgaaggtaggcgccgcggaggccggacccggcgcgggcgaggttgggggcgtcgcaccggctgggcggcgggagcggcggcctccgggagtggaagcgggcggcgcggagcgcacagtcccggcccggcctcgccgcgctccgggtcgctccggttccacatcgtggtcgcctccggcgtccccggcgccttggggccgagagcgtgtgtgggctgaggtaaagtgcctggtggcccctctgcccgcccgggtagtgcctggtggcccgggcggggggcgggggcggacgcgcgagctcggctgcagctcccggctacaccgggcaggaattgagcgccataactgttgcggctctttcctccggtgccccctcctggcgccccctcctccgttcctgccctttgcctggcttcggggctgacggggccagacccgtggcgggaggacctgctctgtcggccgccaggggtcggatgctccagggagcgagggcgcgccctggctgtttagctgttggggggcggaaagaaccgagtgcctggagaggggagaacgggtggtgctgggtgcggcgaggcaccccgggaagcccgggtgcccacccggcgggagcgggagcgcgggcgcccggcgggctggcgaactttccctcccactggcggcattgttcgaactgcgggtccgtggccgccgagcgtcgggcggtccgggggtgggaaaatcgtgagggctttgctagtcttccggggaaattttcccaccgctgggcacggcaaagttaacttttctccagctttcgagttcgttttattccctccgccccgggggccgtagtttgtttttttgttttgttttgttttgttttttgtttgtttgttgttttttttaatagccttcaatctttttctcccgcttttcacagcagagccagtgcttcggtggagtctagctttaaattgcacagggcagcctgagtttgttatttgtgaggagggggtggcgggatctggagtgagtgaccacaatggtggtatgtggaggcatgtttcaaagtttttatcgctgtgcggccctgggacatatgtggctactagggatttggcaagaaacttgtttggccgcttctccgactttgagttgcaaggaaatccgtggcctcagatgtgcgcgagttgtttgtgtgtgtgtgccgtgaggtgcgtttatctatgaagctgaggatgagattcccccctcccgccgtctgattgtgtaagaagtcaaaaccgtgttgaaggtgattccagtggtggcctggagggaaaggcgacctcattccctgtgttcagtctgataaagtgaactgctgctctctaaacttgggaagtaatgaaaaataatttaggtaaaaactggttgcacaacgtctttgcttagtttaagcaacccacaatccactttcccagaccagttctcctgttaaatactttccctttagccacttcttgtcagcctaggctgggagggggaaagagtagggctgagagaggagtcggtctgaacaaagcattgtgtttttatttagtttaatacttccaaaacatctgtagacaatgggagtatgggtcccggccttcgtaccctttgagtagtgtggttctcatgcttttgtagcatcatgtgattactcttcggatacgtaaaaatagattttttttcttttttgtttaacctaagagtattctacctccataacatatcattttctctttcgtttaaagtgagctctgagcttaaatacttgaactgtaaaaggataataccctctcttcaaggattacctgagaccgttgagaagtgtttcagtgcccagcgtgtattcaactttcaatcgatgttagccaccatctttgccaccttttctccagttgtgctcttctttatgcttttgtttgctagagaatagcttttaacccaatattgttgccttgctttctgtccagtcaattctggaatactcaggggtgcaagtctggctctagaattcacactttctctctcccctcttctctgagtcatgttgcttgccctcggcaatgcgatgtgaatctggtcataggtagaaaaaagtagagaaaggcttcccactcctccctgaagtgttgtgacccaccttcaggcccgtaggggagattcccaggagcaggacaggtgatggtgcagggctggcatcatagctaagaagtatggattggtgaaagttaaagaagaaagggtgttgaagacttgtaggtttagtattgtcctctcctttaataatgcttgtcttttccctctcttgtgttccaccaaccataacaacccattttttcccctaacctacacaaagccatatcttctttctgcccactgctttgaggtctggctggaactaggcaagtattttggaagaggtgggggaggtaggaggcatcaggtgctggtaaagacatggcattagggagggctcttacaagccttgatcagagttacagagagccagtccaaaaatgaagctgagcattatcaggggacataatgcacctacctccttgtggagcttacacaaaataggagctgagaagacagaggtaatatgctgtcttacattaagaaaatctctcattgaggtatgatttactatgatcttgacttgtcccacaatataggtgagaagtgagtgttaggtgacacctgtctggcactctcctaacatggggacactttaatggctcacaagtttctgttgttccagttacagtggctgggaaagctgaaacattctggtttgtatggtggggaggatctagggtgaatgggtaaaagtgatgaacaaataaacgggtactagcaagtaagtggtcattacaaaccaaataactaccactttgagttttctgatttctggaatctttatgactccctcatggttatttttgccttgttcctgtaggtctttccatagataataacaacaaaattcttaccattagaactgcctctgtgcttttcttgggagaaagtaaaaaaaaaaaaagggtcctgggaaaaacttgcccgatttcatagctaggcttgtgaaaaggaaggtgataagtcagaagacagccgactgaataaaggacctggtgtgaggaaatagtactggggctttgaccaataggaaacacctatgagttcatcaatgcttttcaagcagcaaataatttaatctttgccaaaacccaggaactatggctgtgccctgctacccaaggagctccttttcccttggtattggctgatgggcaaggaaacccaagcctagaatgtgtttttttgttttgttttgttttgttttgttttgagacacatgacaagaatatatgataccagcatggccaatacactagactttgtgtgttggaatcttctgggacacattcttttttaaattttaaaaacttattttgataattacaaactgttataagaatagtacaaagaactcactatattcccaattagtaacggtttgctctcatttgctttatcacttgctcttttagttctctttccaaaccatttgttagtaatcactgaaatttattatttgttgtttctttcaagccatttgttagtaatcactgagagattggtacttatcaagggcatcctgtcctgaacagtggctcagttgcagccactgggtatagcagaacagtggtggtgaggcagggtccagaggtagagcaaagtctacctacagctgtgaagcacacagtttgtaaaccgtgtagaatctctagggctagatatagaaatcattatcgattgtaaaagtggttaagataaactccacttttctcaccattcttgtcaagtttgttcttaactatgccaaactttaatactgttaatgaaaattcactccactccccaactttgcaacaataatatattctccaagattttcatttaattcattcagcaaacatgtattaaataccttctgtttgctaggggtataagaggtgaaagatacccccttaacagctcaacttccagtggaaaggaattaagtcatcttctcacagtcaggaggaagagtgctctgctgaaggggttcacagggagtgatgggagcaccatcctggttaaggatctgagaagtagatctctgggagtcatttgggatgggtgtaactatgaagatctgtcttctctgaggcctgctcttagatgacaaggttcatgagttagagaagcctttggtgtcatatacccagcacaggctgtgaggtcaggccaacttggattcaaatcctaactctaccacttgctcttggccagttatttaacttctctgtgcctcaatttctttgtcaaaccatatctctgagggtggtagtgagaattgatcaatgctctgtaaacattcatttcatcttactctacaaaaatgcaatgtatggggaaattgcctgaaaagtaataggtattaaggtgggatccaagctggtgggggcgggtgggggtggctcggtgtgtttctattttttcaacaaataaatatctaattgcactaagagctatgatggacattaccatataggataataacaataacagcagcaatgatttcttaaacatttcctgtgtcccgagtactgtgctaagtgcttaactaacagaggatctctctctctgaggtgtgagactcagaaaggtgaagcaaaggtaacttgcccaaggtcacgcagcaagtataaggtagaatgtccctgtgagggagaccagcatggtgccctgagccttgagaatgagcaggaataagcaaggtaagggttagagagaagggattgccaggcaggggtagcagcaggtgttgtgagggcactgaggtggaagagagatgtggaaaggatccacagaggtttggctaggacttggggtaagagagatgaggtgggcagggaaagattgacagggccttacgggacctcattaaagagcttgtgttttattccaagtacaatgagaggtgtttctttctctctctctctctctctctaatgggaggtctgtctctctctctctctctctctcactctctctcatcctctctctctctctctctctcatcctctctctctctctctctctctctctcatcctctctctctctcatcctctctcatcctctctcatccagggaagcatatagtgaggcctaaacaaaaatggtttaagaaagtcatttccccttcagtgtcccaccttgcaatccaatagaggcaatgtctctggaccaaatgtgtaggtcttaaacagtttttatcgactgccattaacatggctaaaaagagtttctatgatgctggaagaagctggtccttcagaatgcttctagaaggaggtttaattaggctcatatagctgatgctttttaggctgcattaagggagctctttcagctctcactgatccctgtcacatggggaaaaagtagaattgagagaaaacataattcctggaaacctgagttgttgttcagtgttagaaatggaactatcgagtataagactttggtttaaatatatcatgataaagatacttcagtgactaaatggaaatttttttatgttttttgttttttgcatgtgtgtgccatctgtgatggcagacagcacatttgttagaatctgggaagacttaagtattttttcaatacttatatatttatatttattctcatccaggtactagaagtttttctgtttgaaactatttcttatctacagagtaaacttcacaggaggaaaaccagtgttctgttccccttcccataagtactaggccacaaacatatttacttttaagtagcctgtgtcaattagctttttgggggagggtggttagctggtggctagatgatctgggatagccttactcacacatctggtggttggcaggctggttggtctaggaggccctaagccgggatggttcatctccattctatgtggtctgccctccagctggctagtctggacttactaacatggtggtcttgaagtcacagagtagcaagtgagagcaagcaccagtgcacaagcacttttcaaatgtttgctgtgtcacatttgctattgtcccataagctaaagcatggaagtgcttctgtggccaagcccagagtcattgtgggtggtgaccattcaaaggtgtggatacagggagatgtgaaaaaattgggggccattactgcaataattcataataattagcaatgaatgtaagctgttaagctttgataaatcttgttaaacacccatttctgaatgtagtgtattctagagactaaataatgtgattgtgccattggtaacacctcttccaccaagtgtggaatggagtgatggtttttctgggaagaagccaaaggcagacagtgtggttttggacatagatattcttgtgagtggcttaactgctttctgatcttgtgtggctattatcaaaggagtctctagatttcctcaaccttccattcaagcattatcacgaaaaccctagtgtattagactctactagattttgtggtcaagccaaaagaccgttatttgggaaccaccaccacttaagagatgaaagaaacatttgcagtctttccttggaacctttatatgatttataatttgtacctaagagaggaaatccgtatttgagcattggtaataaggacaagggattctctgtaaatgtgttttaattggttaagatttaaaaatcttcctgtggttgcagtgaaaaatccagcattgtactgtgaagtgagtggccaggaattaccaatttggggcatcagcctttgacctttgcttgtgaagatctcagaagtaacactttccacataactgaaataggcttcacaacagcttgtggcctgaaatatattacatgaaaatgcaactggaccccaggaagtatgtgtgggaaactatacaaggctcattttgtatgtcttagagatgtacattcccccagaaaattgcctggtggtagaatgttagcttttcttctttcctcctaggataaaaattaaaaatctctgacattttaaaagtcagtgacttgaaagagcaatcaaaatttataaacacacacatcattagaccccacaaacacttccaggaatttattcaacaaatatttgcatattaattggagtattgcttgtagtagcaaaagattggtaatatcctaagggtcaatcaagaatattgaagacactgatagttttggaacacgcatgaccaagcaggtagagggtgagagggagacttttcactacataaacttttacgtatgtgttttgaattttaagcaatgtgaatatattttcttattttaaaagttaaatacattttttaaagagatgatatatagtgatgcaaaattccatagactcctatccgagttgacctgatcagagctattcctgttcaaaaaaaatctagccagtttttccccctagaaatgcctcacgatagtgtacttctgaatttttaactataattctgccttttccagaatatcacatgagtggaatcatgcaatatgtagcctttttttggtcttgcttttagtggattcatccatattatgtgaatgaatagcctgttccttttcattactgaatactattccattgtatggatgtaccacagtttgttcattcacctgtcgaaggacgacttagttgttaccagttttttggtggttttcaatagagctgtggtaaacattagtgtacagatctctgtgtggacataagtttgcagtttattggggtaaatacgtaggaatgggattagtggatttttctttgacagaaattaccaaactatgttccaaagtggttctaccattttatattctcctgccatgaatgtgattccacgtatggatgtctagttgtcccagcaccacttgttgaaaagactaccctttctccattgaattgcctttgcatatgtgtcaaaaatcagttgactatccttctgtggatctatttctgggctctctgttgcattgatctatatatctatcatttctccattaacacacagtcttgattattatagctttataataagcctagaaatcaggtaatagagtactctggctttttaaaatctttctctcagggtatgcttaagttactttttaaaaaaatttttttatagaaacagggtctcactgtattggccaggctagtctcaaactcttggtcttaagcagtcttcccactttggcttcccaaagtgctgagattacaggcatgagccaccacgtctggctttttttgctttttaagagacagggtcttgctctgtcacctaggctagagtgcagtggccccatcatagctcactgcagccttgaactcctgggctcaagtgatcctcctgcctcagcgtcttgagtagatggggctatgggcacatgccactatgcccacctatttttaaatattttttgtgcagagataaggtcttgctatgttccccgggctggtcttgaactcctgcctcaagtgatcctcctgctttggcttcccaaagtgttggaattacaggcgtcagccactgcacctggcctggcttttttcttctttttcagagttgtagtggtgagagaggacatccttaacttgttccaatcttggaaagcattccatctctcaccatcaagtatgatgttgtaggatttttttttaatatactgtgttgtgcagaaaagagttaacatagcagacctgaggctgctgtctttagaaggccaacgtgcacgattggcccttagctggtgtttgggaaattggcttttcaaatgtttaaaaagaaaagattatattctaccttcatttattccttttccaatgcttttcatttctttatggtaatccaggtttcctaccttgatcacagtctttctgcttaaagaatcccctttaacctatcttttgagggcagatctgctggcagtaaattctctgtttttggttgtctgagaaagttttcattttccttcacttttgaaaggacacttttgtgggttgacagttgtttttcctctttcaacatagtactccaccattgcctggcttacgtgatttctgatgagaaggctgctgtaatccttttttttttttttaataccttaagttctgggatacatgtacagaatgtgcaggtctgccacataggtatatatgtgtcatggtggcccgctgcacccatcaacccgtcacccacttcaggcacctctcccaatgctatccctcccccagtcccccatcccccaacagactccagtgtgtgatgctcccctccctgcgtcgatatgttcccattgttcgactctcccacccatgaatgagaacatgtggtgtttggctgtctgttcccgcgttagtttgaggctgctttaattcttatccttgttcctccatagttaatgtgtcttttttcctctgactactttgaagattttctttttgtctttggttttcagcagcttgaatatgatatgcctaattgtggcttttaaaattttttcatttttgtcctgctttgtgttctctaaactttattatatctgtggtttgttgcctgtcactaattttggaaagtttctcagccattatttcttcaaataattctatcttgttcttttttttttctctttctgggattctaattacaagtgtgttatactgtttgttattgccccacagttcttgagtgctcttcagtattttcattcgtctctttttaatttttattgactgatcaataaccttgatcttcaagctcactgagtctttccttggctatgtcaagtctactgttcagcccattgtttttcttactgttttttttttaatttctagcatttccctttgattcattcttacagtttctatctctttgctgaaattatctgtctggtcttgcatattgtctattttttacattagagtctttaagatattaatcatagttcttttacatttttttctgatagtctcaacatctgcatttactgagtctggatttagtaattcctttgtcacttggaatgttttcttgccttttgttacgcctcctaaatatgctgaaagctgaacatgggcaggagatgcttaggtaaatatttgatatgtttggagaagaacatatttatggaaatttgtgttaatttggtcaggagttggcctgtgtttttttgtttttgtgtttttgcttttgagataaggtctctctccgttacccaggctggagtgcagtggcatgatcatggctcactgcagcctcgacctcctgggctcaagctatcctcccatctcaggctcccaagtagctgggactataggtgtgctccaccatgtccagctagtttttaagatcttttgtagagatggggtttcaccatgttgcccagagtaggtctggaactcctgggttcaggtgatctgcccgccttgacctctcaaagtgctgggattacaagtgtgagccactgcgcccagcaagagttgacctgtttgatattgggtttgttttgttttgctgtgggtaccagagatttcttttctctctctctctctctcttttttttttttttttttttttttttttgaggcagggtcttcctctgtcacccaaactggagtacagtgacacgatcatggctcactgcagcctcagcctctcaaccttctgggctcaagcagtcctccaacctcagcctcctgagtatctgggaccacaagtgcatgctaccatgcccagctaatttttaaatttttttttgtagggatggggtttccctgtgttgcccagtctggtcttgaatttctaggttcaagcgatcctcctgccttggcttcccaaagtgctgagattacaggcatgagccactgtgctccaccaggcaccagagatttctgatttctctagtgatacattcattttgactcttgcttagctttgggtttttactttgtgctgcttcccaagagctagctctaacagctctcccagttgtattctattgttcttaaccatggagctggtttgccaggttgtggttagtaggggaggagggagttctctgatgatctgattaaaccttacttagacaggtactagagcctgggtcttgagtgtgtccttggcaagatttacttttcctcctcctggactggagcttctttttctttttcccatgttcctttaccctagctgcagtgggtatccaccagtgttctccaaccatgggtttcaagtccttcccccaaagactaagcctttttttctgtattggggataaagggatctgggtaggtttcacagtgggtgctgttttcctcagccagctagccagcaccatggtgggcgctttctctgagatttttccctgatcttccctgtgagagcctggtggaattcctgtaggaaaagcttgtaagagtgtagcaacctcttacaagcttcacactctcatgccagctcatactctggtctccagtaatttgtcagaacttctagtttggtcctcctacaagtttatatgctcggatcctgtgtctccctgcgggtatgagtatttccatatattgggattgtgggacagtggtttgtcctaggacctcagttctgtcatattgaagaaaagtagttgcttttcagtttgtctagcatttttcttttagtgagagtggagatggtagcatcccagtgctttatatccaagctgaaacctggaagttttaatctatataaatgtctaatgcaatgcatggtacatagaaactcagtacaggttagttttcctttatgtttctttttcttactctcttgaattttatggttttatgactagggagccaggaataattgattctagtttggtttctccctgttttaggcttaaaaatcctctataccacttaaacattatacgtttgtcttgctttcttccaaaattcaatgtatgcctttgtagtttttgaatatgtcattagcactcagtaatttgcgtcactgaaaattagagcatgattttatctatttagattgtagattttgttagtgaccatgtttttgtcatttttgttatccacatcgccaggtgccattcgcttcagcagacatttgttgagtgcccactgtactatgagtgaggcactaggtattgagtagaatacaaacctgactaggtaagtggaataaccaaggggtccccaagggcagtggaaactccatggagggaaggatattgcaacttgcacagtatctccatttcaatctagaaaggtttaattcttttaagaattctatttttatactaatgatacatgaatgcatcctagcaaaaaattgaaaaattgtagaaagagccatggttgttcttgacatcctcctcctatcacattctccttcccagggttaattttgattactatttctgtttgactgtagaaattgctgtgtgaaatatcatgccatctaataacttagtaaatacttttatttttaagggaataagctctcaaatttatttaacttttaaggaatgcttatttaaagagatgactattatcattcagtggggatgtgtgacctgatgatagttctttgtttcactttatagtatagctattttaattgttaaatcctacgttagtggtcagtggaaatgttgtagtaaatgggaaacacagaaattagtagtgaccaaaaagatgacctattggctgggcgcagtggctcacgcctgtcatcccagcactctgggaggctgaggcagggggatcatgaggtcaggagatcgagaccatcctggctaacacagtgaaacccggtctctactaaaaatacaaaaagaaattagctgggcgtggtggcaggcgcctgtagtcccagctacctgggaggctgaggcaggagaatggcgtgaacccgggaggcagagcttgcagtgagccgagatcacagtactgcactccagcctgggcaacagagcaagactccgtctaaaaaaaaaaaaaaaaaagatgacctattgacttttttttttcttttttgagagtcagggtcttactccatcacccaggctggagtgcactggccctatcatagctgactgcagcctcaaactcctgggctcaagtaatcttcccacctcagcttcctgagtagctaggactacaggtgtacaccaccatgcccagctaattttattttattttattttattttattttattttattttattttattttattttaagagatgggaccttactgtgttgcccaggctggtcttgaactcctgggctcaagcaatccttctgcctcagcttcccaaagtgctgggattgtaggcctgaggcactacacctggcctattgacttaaaaaaattatacagtaggttggacttttttggggttatttatggttctgtggattttttttttaagacagggtgtcactttgttgcccaagctggagtgtcacagttgtcactcactgtagcttcgaactcctgggctcaagcaatcctcctaccttagcctcctgagtagctaggcctacaggcacgcattaccacacctagctaatgttttagtttttttgtagagacgaggtctcactatgttgcccaggctagtcttgaactcctgggctcaagtgatcctcccaccttggcctcccaaagtgctgggattacaggcgtgagccaccacacctgaccccgttctgtggatttttaacacataaatagatcagtgcaaccaccaccacaatccaccacaatcaaggtgcagaacagttctattacccaaaaaattcctttgtgctgactctttagtcatactctctttccatcctaaactctggcagccactgatctgtgttctatcactacagttttgttattttgagagtatcacataaatggagtcaaactgtaatcttttgagtctcattttcctctctcagggtaatgcttttgagattcatccaagttgtatatatcaatggtttgttcctttttattgctgagtagtattccattgtccaaatataccacagcttgtttaatcattcaccattgaaaggcatttgagttgtttccagtttttgttgattgagtagagccgctataaaaattcatgtacatgtgtttgtgtgcatataagtttgcatttctctaggataaatacctgggagtatgatggctagaattgtactaccattcatggtaaaactagttagctagagtttgaatgctaggatggatagagtagcagagacccaagtttgaatcctgctttttctttttactagctctgcaaccttgagtcagtttaacctctttgtgcctcagtttcctcgtttgtaaaatgaagttaaccactggtattgtgtgaaataaatgacatattaaggataaaatgctgagcaatgtatgacatactgaatatattattatctcatgtttaatagaaccctttttgtgagaaacattcatctttgatgaattaaaatggagaaattaagtaatctataagtgtggcgtgtttggtaggcaagccttcaaaatatgttgtccctggggaaaatttcagaagtcctcagtggtgaaaaggtttaggaacatagatgtatgagagtcttgtataacatccaaaggttggaccagatgcccaagtttggtggtttgacttgccctgtcaacactgaagaatcagattcaccaaaaattgagtacattgctatatttcatgtaagaagctgcaaaaagtagctcagaatcagtgaacacttattgagctcaggagatccacctgctttggcctcagaaagtgctgggattacaggtgggagccaccacctggcttaatctccccagttttgagaaacacattgaggtcggaattacagaaatactcagcaagtcttgccctagagcactataccattagaaaatgcagtggagaccctttcttgcataactgccacatagtatggtctggctcagtctgagcaggcaccaagggcagagaggatatgttttcccctggagaattttcccgtatcctatgaggtgcgcacagaagactacccattcactcaccaggcagtggatgaaattcagcatttgcaataaggaacctaaatgttcttttattgtctgttcatcattttgtaatgttttcacatggtacagtccatcaactgtgacagttctttatctgggatttcagcagaactgggtggaacaaaaagtcttgagcacacaatcttaagagatgtcacctctggactgtttctgcactgccttccctctcccgtaccatcaacaatccaacactcatgtttacctgcacctttcctcacagctgggaaatccttccctctttgccctgccaatcctgcctgggccaattcttccaaattcctgtaaattctatctcagcgagagattttccactatccccaactctattcttttggatgccatcccctactacatatttcctcattaagtcctgtcttttctattcactttggccctaatgccatacttccttactctgtgacctatttgtgtacatgtgacttgcaggtatacagctagacagagtgatagaaaaccttcaggttctctgcatcttatctcccacaaatacctgaaggggacttgctgcctcttattcaattaacaaaccaaatatcgattatcattttgtgtaaaaaaaaattacatgtaacatgttcttatttgtgttttttggtttttcttaaagacaggatttcactctgtcaccgaggctggagtacagtggtgctatcatagctcactgtaaccttgaacttctgggctcaagcaattgttctacctcagcttcctgagtagctaggactacaggtgcacaccaccatgcctagctaattaaatggtgggttttgttttgttttgttttgttttgttttttgtagagacagggtctcactatattgtgcaggctggtcttaaattcctggcctcaagtgattctcctgcctcagcctcccaaagtgctgagattacaaatgtgagccaccctccccagctgcatgtagcgtgatctaatggctatatacttcctgtggaaaacaatagttaggaaaagaaatacacattttgcagattgtcaaaactgctgctttgccatgctaccgttgtgaaaagtgtggctgtacagtctgcctgggtaaagtatggcttcagagtgtagattgcagacagctcttccctggctccagtttggtttctagccttcctcatgattccttgcccacttaaacaatgttaacaccaggaattttgtcttttcaaatatagacaaaactttgactataaacagctgtatcctacttgtctcacatgaaacttatacaggagcggtgtttgtgtatgtgtgtgtgataagcctaaatttagctctctttggaataactaacataaatccagaagaaacttttttctttctttagttgatagtatggattagaaaattaacatgcaagaaggagcttttttagacttctaaataaacttacttgaaagagctccaattatgccccttagcctcttaaggataatccgtgtagacacttgcctttagggtaattgtctctaggctactttcttcccataatctctgtgtcaccatattccaagtccgactcaacttccttctggactgctgtccataaagatgcagactcaaaaggctttttcactatacccttgtttcccaccctcaccactaggctaccactgacctctggctgtgcactgcacagtaagtagtgtgtgtaccctctagaacctgacattcaaggtcccccatacccaatcataatctttcccactacccttgactcctctcaaatacttttctctagccactctgtccaagcatgtattcactagagtctaaacataccatgagtcattctgaccgtctgcctctgcctggagtgttctccatattgctctgagtttgttccatcctgtgtgttcttcaggacccagtgaaaagctcatcttttcactacagtggtttcttccacctctgaagccccacaggactaaatgtgctcaacactcatttacccagatgggatagtgtggtagagtacttactggctacaatgtcctttcatctctgtatgtacacttagagtgtgattttgcagatccttgcaacaagaggtggagtctgtttctctactccttgaatctgggctgtccttgtgactcactttggtcagtaaaacatggcacaggtaactccagatgacttatgagcctaggtctcaagaagtgttgtagcttctttcttactctccattctgaggcaaccatgtgaggaagccccagctaacctgctggaggaagagagatggtatggagagggagagagagatccagtcatcaaccagccatcagatatgtgagtgaagccatcttagaacattcagccccagtcacattggcagatgactgtaaccatatgaaggaccacagaaaagaccagcagaacaaccacctagctgattctagccgaaattgctaatccacagaattgtgagctaataaaatggttattattttaagctactaagttttggggtgaattacatagcaataaataactgaaagggcagggtttgtactgctatatccccagggcctagagggcatgaccatggcaggttttcagtaaaagactgttgtggattactgtcattgtggtgtcactcctctctttgcttaatagacaaccaaacttcccagtcctcttggctctcacaaaagttcaaagcttgacttcaacacattcttccagaataacaccttgaagttcttctttgccccactgcaccagcatccatccatttgcccccatcacagccctatgacagacagttcattacaccccacctcagctccatgttgcgtccctcctacttacccttattctctaaccctgtggggtcaacccattgaccacctcagtgccataaagctcttctcaacttcccagccccccatccataccctgaacgcgcactacctgaatcacatgtgcttataattaggaggaaccttagaaattgagacagccccttctagttatgaatgaggaaaggaaggcccagataagaaataataataaatggcttattcaaagtcacatggaggcaatgtcaaaagtagagcccacatctcacacagatgattacctagtggattgcctgtgttttcctgcatctggtgcttggtttatgtgtaggacaatgcctttaatgattaaactatgggaattctttggaggcaggcataataccttttacttatgccttttctcattgccagcatatctccacttaaagactaaccagcgactactagacacatcagtagtcaataaatacctgttgattaattgacattttaaaaacaattatgcctggaactttttaatatattgtttgtggtagtgattacaatagtatacatttgtcaaaactttaactgtacgttaaaaagggtaaattagagtatatgtaaatttttttttttttatttgagacagagtcttgctcttgttgcccaggctggaatgcaatggcacgatctcagctcactgcaacctctgcctcccgggttcaagcgattctcctgcctcagcctcctgagtagctgggattacaggtgcccgccaccatgcccagctaattttttgtatttttagtagagacgggggtttcactatgttggccaggctggtcttgaactcctaacctcaggcgatccacctgcctcggcctcccaaagtgctgcgattacaggcatgagccactacgcccagcctatataaatttttttaaattaaagcgtaatcaaagcaattatgctgaagaaatccatttatttgataaatgtggctaaatatataggtaacatgttactatgtgaaaagaagtttggccctttgaaaataaacttgcatataataggcactcaatgttagtttccttcttccttgtataccaatgcttcatgatcacctgtcaaggctactaaagaaagcattcttgtactagaagatagctggatctgatctgacttctaagattctatgatttgtttaaaaggtaaataaatgactgttttgaaatgcctgtgtaaagtaaaaatacgtaagcactacaacactgttctaaaaggtggccccctaggaccttaattttactttcaaagacttagttacaaaataactagtcccctgttaatagaagttacttaaagcaaaaggatgtctgaatatcctttcagtgtcgtactggagcattggctgacgggcccacccaagaattacttagttctctaggggattgcatctttgtttggctcactgttcactaatgattagagtcgagaccttttcaagcaacatgttaacttatagatttttgcctggtagagatgtaaaattttctgtttggtagaagaaattatcctaaagactacagattaattttcctatagggcataaccacttttctaatttagcaattttattcgagcattctttcaaggcctatatatagcaagtctctcaaatattctttgaataagctttaaatcctgttagttccctaataagttaaatgtctttgacatgtgttcagtctacatttgtatgagtcatgtttttaattttgaaaattatatttcgatacccaaacattctacaacattgcctgtgggtcatgacccatcctgtacagagtccctgaaatccattactgactgttggttttgatgctgtgctagcaccttcaaatacctttgtgatcatgctagtacttgaagaggtcttcacaggaataattttggatacctctgcaggtactcaagaacactgcagaaagactttctgggacttctctcacaaaatgagaaactaatgttccttcctatcatgttattgttctgtctataagctgagaggatgacattaagagcctttgttttaggagatccatggcaaacagactcacagggtctttcttgttaaacaatatttctataatctggctttcctagtaatggccataaaataactatatcatagcaataaaaattgataaactatcagctgcctcaaaaatctaatagctttggcaaaatatactatagctcatgtatatcctctttttctctaacagattttaatacttttccttttcatactactgaacagcataatcaaatcaacaaattcagctaatggccattgtgttgtgggcactgtgcttggccctgcacatccccatgttccctctcccctttgtcaaaaactagctccactggttgttaatgtcaatcactgatttgcggttgtccagaataaaaatggagagcagagcccaaacggagggtggcagtcggccttgtcattacccaaagaactaaaaatggagtaatgcaaaagagtggaactccttcacattaacaaaagcttagttatatacagtataagaccactgaatattaaacacacaaatttgaaatatgcagagaaccaggaagaacaggttaaaacatggttcactaattctggtatttataagtattctgagtcagcttgacaactttattgaaagaagcatgaaacatcttacaataaaaattcaaactcagaagtaatccaggtgtgattcccattcatacaaaaggatcaaagtgccaacttcgtatgcagtatagggaatcctctgcagaggaagtgtgaaccaaacttttaaaataccagggaggatgaggtggagtggattgagaacaggagtggaagaaaaaatttcaacccacttttcctggtgattatttaaaaacaaaaaatctactatttaatgtttcacaataaagtgttttagaaaaagtaattagctcggccagcttctgccccaggatgtagaaagctggaagcagtgttgttcacatccttaaaattaaaaaaaaaaaaatgctgggctaatttcaaattcatgacttttgtcaaacccatcagagagaagtattttgcccaagtattagttcagagaagtatttgttcaagtgtttcttatttaagttgggttgtttcttactgttgtttttgaggttttttccctaatagtctgggtaaaaatcctttggttatttgatttatcagcaaatattttttgtatgtaacttggcttttcattgtcttaatggtgtcattcactaagcaagattttcattttgttttttttaagacggagtctcggctctgtcacccaagctggagtgcagtggtacaatcttggctcactgcaacctctgcctcccagattcaagcaattctcatgcctcagcctcccgagtaggtgggactacaggcgcacaccaccacgcctggcaaattttttttttttttgagacggagtctccctctgtcacccaggctggagtacagtggcgcgatctcggctcactgcaagctccgcctcccgggttcaagcgattctcctgcctcagcctcccgagtagctgggactacaggtgcctgccaccacgcctggctaattttttatatttttagtagagacggggtttcactgtgttagccaggatggtctcgatctcctgacctcgtgatctgcccgcctcggcctcccaaagtgctgggattacaggcgtgagtcaccgcgcccggcctttttttttgtatttttagtagatgtgaggttttaccatgttggccaggctggtctccaactcctgatctcaagcgatccaactacctcggcctcccaaagtgctgggattacaagcctgagccaccgtgcccggccttcttctatgtttataagaaaaacttgcttataaaagttttataattttacatttatgtctattttgagttaatctttgtaaatggagtgaggtttaggtgaaggtctatttttgtgtatatggatgtctttaatttacttttgcatctttgttgaaaatcagttgcctatatttatgagggtcagtttctggtctctcttttgttctgttggtttattctcagtctcactctggctcccaggctggcgtgtacagtggtgcgatctcagcacactgcaacctccacctcccaggttcaagccattctcgtgcctcagcctcccgagtagctggtattataggtgcccaccaccatgcccagctaatttttgtatttttagtagagacggggttttgccatgttggccaggctggtctcaaactcctgacctcaagtgattcacctgcttcaacctcccaaagtgctgggattacagacatgagccactgtgcccagcttgctggtctgtttttaatcactttgccaataccactatcttgattactatagctttatagtaagttttaaattcaattgttattattcctccaattttattcttctttttaaaaagcgtttttggctcttctagttcttttgctgttctttataaattttagaagctgcttgtctctctctacaaaaaataggctgtggactcttaccagtctgtggcctgttaggaaccaggccacacaggaggaggtgaacagtgggcaagcaaacattcctgcctgagctccacctcctatcagatcagtggttgcattagattctcataggagcacaaaccctgttgtgaaccgctaatgtgagggatctaggttgcacactccttatgagaatctaatacctgatgatctgagatggaacagtttcatctggaaaatcatcctcccttcccccgtccgtggaaaattgaaacctgtccctggtgccaaaaaggttggggactgctgccttattgtacaggctgatacttccagtatgacattgaataggagtcatgagaaagggcatctttttcttgtttcaactttaagtctttcacttttttttttttttttttttttgaggcaaggtttctctctgtcacccaggctggagtgcagtggcgtgaacacggctcactgcagccttgatctcctgggctaaagcctcgacctcctgagattacaggtatgagccaccacgcctggctgatttttctttttttagatttaacgtggttgaatacattgatttttttttttttttttttgagatagagtctcactctgtcacccaggctggagtgcagtggcacgatcttggctcactgaaacctccgcttcctgggttcaagcaattctcctgcctcagcctcctgagtagctgggattacaggcgcctgctaccatacccagctaatttttgtatttttagtagaaacggggtttcgccatgttggccaagctggtcttgaattcctgatctcaggtgatccgcccatctcagcctcccaagaatacattgatttttgaacactgaacccaacctgccttacattcctagggtaaaccccacttggttgaggggtattattatttttacatattgctgttagatttgctaatattttgttggaggtgtttgtttctatgttcatgagggatattggtctgtagttttctctttttgtatgtattgtctgtgtttggtatcaaggcttcataaaatgagttgggaaagcttccctccttgcccatattctggaagagatcttgtagattttttttttatgtttgttggaatttgccagtaaaactatctgggtctgggcatttcttttttaaaaggttttaaactttgaattcagtttccttagtagttatgggagtattcaggttatttattttattttcaatgagttttagtagtttgttatttacaggggattgctccatttcatttaagttgtctatgtgtgcagttgttcatagtgtccatttattatccttttaatatctgcaggacctgtagtaatatcccctctttcattcttgatattagtaatttgagtgttcttttttgcttttcaattgtgctagaggtttatcaattttgttgatcttttcaaagaaccaacttttggcttcatcgatttttctctgttgtttttctgtttagtcctttatcttgactgtttcctaatcatcttgctttggatttattttgctcttcttttcatagttccctaaggtaaaagtgtaggttgtttttttgagaccttttttcctcctaaaagagaatttaatcctataaatttctctctaagcactgtttccactgtagtccacaaaatgggttatatttttggttttcttgagttcaaaatattttataatttatcttgaaagtttctctttgattcgtggattatttaaatatatgctgtctaatatccaagtgtttggagatcttcctcttatgtctctgttgttgattcttaattcctttatggtcagggaacatgctctttatgatttccatattttatattttggaaggtttgttttatgatctaggatatggtctatcttattgaaagaacacgtattctgctattttggggtgaagtgttctgtacatgtcaggtaatgacggttgatgatggtgttcagttcttgtatatttttgctgattttctgtctactagttctgtatattaattagagtgttgaaacctccaagtgtaattggatttttctattattttagatcttagagttttgcttcacgtattttgaaacactattgtaaatgtttacacatttaggattgttaagtcttttgggtatgttaacccttttaacattatgtcatgtccctctgcatccctcttctatcttggtaattttctttgctctaaattactccttttggccaggcgtggtggctcacgcctgtaatcccagcactttgggaggccgaggcgggcagatcacctgaggtcaggagtttgaaaccagcctgaccaacatggtgaaaccccatctctattaaaaatacaaaaagtagccgggcatggtggtgggcgcctataattccagctgcttgggagctgaggcaggagaatcatttgaacctgggaggtggaggttgcagtgagctgagatcacgccactgcactccatcctgggcgatgagcaaaactgcatctcaaataaataaacaaataaataaattgtttcttttaatcagtgtttgcatcacatatctttttccatccttttgcttttcacttacttatatcattgtatttgaagtgattttcttacagatagtgtgtagttgggtcatgttttaaaaatccattctaaaaatctgtctttaaattgtaatgtttagaccactacatttaatgtaattattgatatgattgttttacatctgtcgttttttatttttgatacctgtttttatttcctcttttttcccattttcctgtcttcttttggttatgtgaacatttttagtgctactacatttttatttacctactgtgattttttagttatctctttgttttttgtggttgttctagggattataatatacatagttttatacagtctacttagagtaagtgctttaccacttcaagaggaatgcagaaaccttaccaccctataggtccctttatcctcctttctttatgtcatagttgtcttatatattacacctatacctgttgaaaattccttcacacattgttaccatttttgctgtcagccaccaaacatattttaaagaactcaagaaaaggatagtatattgtatttatccaaatattcaccatttatgttgctcttttcattcctaatattctaagtttccttctggtatcatttaccaattgtctgaagaacatcctctagcagttcgtttagagtaggtctgctggctataaattctcatttctgaaggacatttttgctgagtatagaattctgtgttgacattttttttacccccagcacttcaaacgtgttgtgccacttccttctgacctccatggtttcttttttgagacggagtctcgctctgttgcccaggccggtgtgcagtagcatgatctcagctcactgcaacctccgcctccctggttcaagtgattctcctgtctctgcctcctgagtaagtgggactacaggcacgtgccaccatgcagctaattttttgtatctttagtagagatgaggtttcaccatgtttgccaggctggtctcaaactcctgacctcaagtgatccactcaccttggcctcccaaagtactggggttacaggcgtgagccaccacacccagcctggcctccatggtttctgattaaaaatccactgtcattctaaatgttgtacccccataaggtaatgtaatagctgctgctttcaagatttttttctttgtattactttcagcagtttgatttaggtatgcctggacgtgggttaattttttttttttctgttgggatttttcactgctcaggctattgaaagtataagtcagctctagattttataatagactggaataatattgataaaagacttcttttgaaagtggcttggcatcatagggaattgcacagtgaaatatataagtatttactatacatctcagacagaatttaacgttagtaaattctagttgtaactcctgctctctttcaatgatgtggaagattgttaaaaacggactagaatggaaggaattaagccccagaaaaaataagtgagttttgtagctttacatacctagtaagttgcaggtcttattttcaggtactgtttccactgtaatgtattgctgtgtacttacagaattttcgcctccctcaagctgaaactttaacataggtttatggtgagatactggtttgaaatatctactttttatcaggaaaagtctaaattttcagtttcttcagtgaggcatcaagtcttagttaagagcacgattggcaccctgtggcctgccagccaaatctagtctgctacctgtttttgtacagtccataagctaagaatgggcttttcatttttaaatggttgggaaaaaactcagaatagttcatgacatgtaaaaattatatgaaattcaaatttcagtgtccataagtcaaattttattggaacccaaccacatcagtttgtttacatattgcccatggtttattttacactacaatggcagaattgattaggacacagaccaaatagcctgcaaagcaaaaaatatttactgattagccctttacagaaaaagttcgctaactcctggtttacaataatgttgagtgaattaggttagagtgtcagtaatctgaactgtgtgaaaagggtagctaggattcaaactttactctttgaataagtatcttagatgtgagaaaattagaagatgagagttaactgattataatcctagtctattaacatatattaaacattatcagtcctacagcaatattccacattatctgtactttttaaattagcccatcagatcaggagaggttgataggaggaaaagttggagttgtttctacctaggtatttgaaaattgttggaggcattgagactcatgcataagggacttaggaagcctttactggctggaggagataaaggctcttatttaaaattctgtgttttcctggttatatttctgttttcctagagttgggctttttataggtctagttagttacctagttgcctttctgcaggcttcttttgtgagggtgtttctctatggctagtgggaggaaatggctggtcatttttaaatgaagaggaaagcccaactcttaccaggacctcagcctgacattgtcccttacccctatagaggcctttcttctgagcctatagacccaccttgccagctgacatcagaagcctattgagatgtccatagcctgttgttcccaacctcttcccgttttctccccttcttttcaaagaccaaatgagctacatctacactacgtatacatttaaggattttttttaaggcacaaatcatcttgttacccactgaaatttaagcttagttgggtcacctaagaaacaacctagaaactgccaattttattttttcatttaaaaatataatttcagcttttattttagattgagaagatacatgtgcaggtctgtcacgtgggtttgttgcatgacatcgaggtttagggcacagatggtcctgtcacccaggcagtgagcatagtacctgataggtagtgtttcagcccttcctcttccctctctccccatctagtagtccccatctttatgtctgtgtgtacccagtgtttagctcctgcttatagacgacaacatgcggtatttggttttctgtattaattcacttaggataatggcctccagctgcatccatgttgctgcagagaacatgatttcattcttttttatggctacatagtattctatggtatataagtaccatattttctttatccagtcctcctaggttgataccgtgtctttgctattgtgaatagtgctgtgatgaacatatgagtgcatgtgtctttatggtagaataatttattttcctttgggtgatatacctagtagtggaattgctgggttgaatagtggtttgatttcacattctttgagaactccccaaaccactttccacagtggctggactaatttacattcccatcaacagtgtctaagttcctttttctctgcagcctcaccagcatctgttactttttgactttttaataatagccattctgactggagtgagatggtatctcattgtggttttgatttgcatttctctgacaattagttttgttgagcatttttttcatatgtctgttggccacttgtatatgacttcttttaagaagtgtccatgtcctttgcccacattttttttttttttggatacagggactcactctgttgcccaggctggagtgcagttgtacagtcagtctcagctcactgcagactcaagctcccaggctcaggtgatccccctgcctcagcccctcgagtagctgggactataggcaggtgccaccatgcctggctaattttttttttttttttttgtagaggcagggtttcaccatgttgcccaggctagtcttgaactcctggtctcaagcaatctgcccactttaacctcccaaaagtgctgggattacaggcgtgagccattgtgcctggccttttgtccaccttttaatggggttgttttttcacttgttgaattttttaagttccttatagattctagatattagacctttgttggatgcacagtttgtgaatatttttctcccatttgttagggtgtctgtttactctgttgatggtttcttttgctgtgcagaagctcttattaggtcccactggtcaatttttggttttgttgcagttgcttttgaagacttaaccataaattctttggcaaggctgatgtccagaaggtatttcctagattttcttcttgtatatttatagtttgaggtcttacatttaaatctttaatccagcttgagttaatttttgtatatggtgaaaggtaagggttcagtttcttcggcatatggctagctaattatcccagcaccatttattgagtagggagtcctttccccgttgcttatttttaactttgtcaaagatcagatagttgtaggtgtgtggctttatttctgggttttctgttttgttccattggtctatttgtcttttcgtaccagtaccatcctgttttggttattgtagccttatgttttgaagttgggtgatgtgatgtctccagctttgttctttttgactaggattgctttggctatttaggctcttttttgttgttgttgttccatatgaattttagaatatttttctaattctgtgaaaaatgatgttgctaatttgataggaacagtgttgaatccgtaaattgctttgggcattatggccattttaatgatattgattcttccaatccatgagcatggcatgttttttcatttgtttatgtcattgtgatttctttcagcagtgttttgtagttctccttgtaaagatctttaacctccttggttagatgtattctaggtattttatttttgtgtgtctggctattgtaaatgggattgcattcttgatttatttctcagtttgaatgttattggtgtatagaaatgctactgattttcatatattgattatcctaaaactttactgaattcatttacagaatctaagagtcttttggagaattctttagggttttctagacataagatcatataatcagaaaacagataatttggcttcctcttttccaatttggatgccttttatttttttctcttgcctaatggctctggctaagactcctggtactatgttgaataatagtggtgagaatgggcatccttgtcttgttcctgttcttaaggggaatgcttccagcttttgcccattgattatggtgttggctttgggtttgtcataggtggctcttattattttgaggtattttttttgatgcctagtttattgaaggtttttatcatgaagagatgttggattttatcaaaagcttttgctgcatctatttggcataaatgcatctatttagatgatcatatggtttttgtttttaattgtttatgtggtgaatcacatttattgaattgcatatgttgaactaacctagtatcccaggaataaagcctacttgatcatggtgaattaactttttaatgtgttgctggatttggtttgctagtattttgttgaggatttttgtctaccttcatcagggattttggcctatagttttcttttgttttgcctttgcctgatttggttatcaggatgatgttggcttcatagaatgcattagggaggagcccctcctcctcaatttttttggaataatttcagtaggattggtactagttcttctttgtatatctggtggaatttggctgtgaatacatctgttccagagcgttttttggttggtagattttttttattattgatttagttttagaacttgatctgtttagggtttaaatttcttcatgattcaatcctgggaggttgtatttttccaggaattcatccgtttcctctagattttttagtttgtgtgcatagaggtgtttataatagtctctgaggatctcttgtatttctgtggggtcagtgtaatgttacccttgtcatttctgattgtgcttatttggatcttctctcctttttgttagtctagtaagcagtctatcagtcttatttagcctttcaaataaccaactttttgttaattctgtgtgtggatttccgggtctcagtttcatttggttctgctctgattttagttattttcttctgctagtttttggggttcttgtttttctagttcttctaggtgggctgttagatcattgaattgagatctttctcacttctttttttttttttttgagactgagtattgctgttgtcgcccaggctggagtgcaatggtgtgatcttggctcactgcaacctccgcctcctgggttcaagcgattctcctacctcagcctcccaagtagctaggattacaggtgcccaccaccatgcccaactaatgtttttgtatttttagtagagatggggtttcaccatattgtccaggctgatctcgaactcctgacctcagatgatccacccgccttggcctcccaaagttctgggattacaggagtgagccaccacgcctggccttttctcacttcttgatataggcatttagtactgtaaactttcctcttaacactgccttttttacatcccagagattttggtataccgtgtctctggaaaccaccaattttaaatgttctgtacacattaatttttaggctaataaaaatgttactctcttgatttggaaacttatcttttaggtgacagaaaaacaaattttgtactattcatgcatatgtattttcaatacatatgtgtgttctttttgtttaagaccgggtctcactctgtcagccaggttggagtgcagtggcataattatggctcagtacagcctcgacctcctgggctcaagcaatcctcccacttcagcctcccaagtagctgagactacaggcgcacaccaccacacctggctgaatttttttttttttttgataatttttgtaaagatgagatttcaccatgttgcccaggctagtctcaaactcctaggctcaaacagttcctcccaccttgacctcccaaagtgctgggaggtgcccagtccatatgtgtattttatagctattcactcttggatctgttactaccatgaaatacagctgtcctaaatgccctgggccacatcatccaggagggtaaaaccagagtctggatgatagtcactcatagactttagctgttatagttctccagcttccagagcagtcttcagctatacccattttgccctggaggtatctgctatgttttcctgactaggtactttatagcacctaatgtcccttctctcttctttcctcttagcacttttggtgacctcttgggcagggtctttcctggactactattgatttcaacctctggaagcttctcttctattaatatgtttgcacagcccccagtgctgctgctaccactgacttgcttgacttcccatttggctgacccactcatgcagtactcaactaagggtactagtgtctgtgctaaggttcttggctctctcatctttctgctgtagctgggactcctggagctgtgggagctgcatgtcagcttgtttaggtttctgtgaagagcctctcactaggattctgaactgagtccttgcaagctagctgagctaaagaatgaacctgagtaacacacttcacacagttttatgaattactgctccctcacgccttggaatattgccaccagattcagttggtgagctaccattttctcttggggccccttctttaacaggagattcctgttccctcaataatacaaatttctggtaggataggccgctcctaggcactccctaacaggtgagaatcctcctggtgtgttcatctccttatgcttaagtagggcatatgtgaggatttgtgtatgtattgatagtatattccttatagtgcatacattcctgttggaaagcaagacttcagagtagcaggtaaagaattacgattactaaccttgcaaaagagaagatcaagagggtgccctttcagtacttggaacattttaaatgaaaataggtagtagccagttataattatgggtactgagaataatataaagactttcttgctatgataggtttaagaaaataaggaagtatttctgacaactgttgaaatgggtcccaaaggaatatagtagaatttcctggctaggcctgagaaaaaaatgtccatattctcccttttggaagttaaggtaaatgtagaggacttaagaggcagttggcaggatgggggtgggggtgtgttcttacgtcatcacccagccctcccatggaggtagcataatgtagtggaaagatgtgtctttgggaatcagtccatgggttcagatctcagctccctgaagctgttctgtgtaaatagatactatcatgtggcatgtatgattaaatgaattaaaatagtgcctccatgagtatatcctcctgtacttggggagggacttgaggtcacctagctcttgagatctgatctgtatgagctaagatggcagtttattgatatatagtgaagattcaactgtgattgcattttcatatgatggagccacctcacaccggattgcaagagccgatttgcgtgcatggctttcaaattccatgatgagtgacatcatcttagtagcttgaaattgaccatcttgggagtatctatatcacaggaatcagtaaactacaaatcagggctttttctccctcttgaagagcctgatgataaacatttatcagcatatcactgatactatctctctgtctttgggtgagttgtgtggtaggccaagccatcttcacaagattacatcccaagtgtggacttggaccagggactttagttccatgattctcatgtttgatgccatcagcatgagagttgcttttggtccttttcttttctcttcttttcttttcttttctctttgagacggagtctcactctgtcacccaggctggagtgcagtggcacaatctcagctcactgcaacctccccctcccaggctcaagtgattctcatgtctcagcctcctgagtagctgggattataggtgcgcgccaccatgcccggctaatttttgtgttttttgtagagacagggtttcaccatgttggccaggctagtcttgaactcctggcctcaagtgatcacctacctcagcctcctaaggtgctgggattacaggcatgagccaccgcgcctggccttttggtctttttctgaaactgcggtgttcttgtccttgagcccggaggggtagatacttggacatggactgtatctcctctggaccatgcttacataggaatttcaagctgtgtaactttcgtttttgtactccttcagactgatcccccttttatttttagtctttttccatcctaagtagaatataaactacagttgcttgtttttactaaactgtagtcatattctaatcctgcctccctgaaatgaagtcagacgtaactgttttttgtatccatgccattcccaaattaatttggagttttggatattgatgagcttttttggctcctatataggcaatatcagggtttgtccccttagctgtccaattacatctgaatgcagattttaccagtttatctttcataataaaaatctgcattttgctcatccccagcatgagaggtaccgtgccgtttggtccatgtcctgataatgtgtcacttccaacatggagcctccatgccgtctctggacagatttagtcaatattctatcatgcccccaggaaatttggagccttcctttcttcctctgttatacaacctgttactctgggttctggtaatttgttttcctttcttccttatccctccaccagagcccacgttcctggagattacagacctgcaattatctgtccctggtatctgataccacaactgtatcaggcctctagatgaatttggcatgtggatagattaataaaattatgtgaaattaaagggtcggtgaaagttgttagcctgtgggagtttttaagattaagatcactgtctaaattcaagttgtgtactgtcagttaagaatcaattcctgggcagctttttgcctcctttataatatttctcagctttgataattgctaaagtatgtgaaagtgcctttggacagattccctatataggaaggagcacgcaaaggaatgtcactcctgacctacacctttgtcctggaattatgtggataaataaactaatccttctatttaaaggatggtttcccttctatggatagacaggccagattgtttgatgctaactcatgaaattctgcctgtgtaaaggatgcctgtattctccctgcattcattttgtgggctcgctttatttgcatcagttttgacttaagtgttcctaatcattggcaatgaagatacaggttaaatacaatatattattgatagttcagcagacaagaatgtagagagagaatgcaaagaaggataaagatagtgtcaaagagggaaagccttaaatatatgtacatagagcataaaggaaagtatatagcatataagtagaagtataatatacctgaagaaaaagtgaacaagtcataagggtacaacgctattaataatctcaaagtgaacttacacattcaaccagtgccccagtcaagaagaacattataagcacctcagaggccttcttcctgagtacccctttcttctaccgcaggggttaccaggttactgctatcttgaattctgtcactatagactaatgtcattttcacactttgtgtagatggacaatacacatacacaaacatatcacaattttttaaaaaaactctacttttttttttgagacagggtctttgtcacccagactggaatgcagtggcacaatcatggcccactgcagccttgactcactggacttaagtgatcctcccacctcaacttccagagtagttgggactacaggtacatgccaccatgcccggctaatttttgtattttttttttggtagagatggggtttcgccatgttgcccaggctggtctcaaactcctgggcttaagtgatctgcctgccttggcctcccaaagagctgggattataggcatgagccaccatgcccagccaaatctactctactagtgatgaacatttctgggttgtttctagcttggggctgttacatatagtgcttatctgagcattctcatacatgtcttcaggaacatttgtgtacatttctgttgtatatataattaggagtaaagtagctgggtcatagggtgtgcacatgttaagtaagcttcagtagctattgtaaaacagctttccgaagattttatcctaatttacattctcaccagcagcataaagaggcactttgccaacaacacttgtattgttgatgtttcgaattttagccattttgatgagtagtagtggtgacttccttatttctcttttattgaggcataatttacgtatagtaaaatgcagagattttaagagtacagtttgagttttgacaaatgtatgtacccacatagcccacaccctaatcaagatataaaacatttctatgtccctgaaagtatcattgtgtctcttttcagtcagtcccctctaagcggaggtagctactcctattctgatttctgtcaccatatagtttttcctatgactgaacttcatgtaaatgaaataatatagtatatatattcttgtatctggcttatttttggtttattttcctcaatataatgtttctgagattcatccatgatgtagaggaatattcatatcagctatatttctaataaccaaagactggaaacaacccaaatgccctccagtaagtaaatggttaaactgtggtgcattcataaaatgtaataaaagaaacaaactattcataagtggatcaacttgggtggctctcaaaagcattatgctgaatgaaaaatagcctatctcaaaagtttacatactgtatagtttcacttatgtaaaattattaaaatgacaactttattgaagtataatttatataccacaaaattcacctgcataagtatataattcaatgccttttaatgaatttactaagttgtgcaaccatctccataactcagttttagaatatttccatcacgctaataaaatcccttgtactcatttgcagtcactccactcttctcccctcagccctaagcaactactaatctactttctgccattgtagatgtggacatttcatataaatagaagcgtataacatatggtcttgtgtgtccagattctttcacgtagtataatgttttgggggtttatctgtggtggtacaacatatcaataattcattcctttttgttgctgaataatattccatcatgtggatgtaccacatcgtggttattcctttgctagcagatgggtatttgggatagttccagcttttggttctcatgaacagtgctgcagtgagcattcatgtacatatccttgtgtagacataagttttcatttctcttgggtagaattttaggagtagaattgctgggctgtatgttaaatttatatttaattttttaaagaaactgccagttttccaaggtggctgaacccttttatagtcctaccaataattcctgggaaatatagcttgtgtacttgaaaagcatgtatattttgcttttcttggagtgttttgtagataccagttaggtcaatttttaaaatagttcttgtttaggttttgtatattctttatttttttctagttctatttattaccaagagtggaatgttaaactctgttagtgtccaattgtctgtttcttcagttctttgtctttagttttcagcagtttgatcatgatgtgcctaggtgtagattcctttgtatttattctgtttggtgttcttagtgtcttggcagttttaaacttttttttatttttattttttatttttatttatttttttgagacagagtctcgctctgttgcccaggctgtagtgcagtggcacagtctcggctcactgcaacctccgcctcccgggttcaagcgatttctggctaacttttgtgtttttaatagagacggagtttcaccatgttggccaggctggtctcgaactcctgacgtcccagctacttgggaggctgaggcatgagaattgcttgaaccccggaggttgaggttgcggtgagcggagattgccccactgcctccatcctggcaacagagtgagactccgtctctactaaaaatacaaaaattagctgggcatggtggcagtcgcctgtaatcccacttactcgggaggctgaggctggagaattgcttgaacccaggaggcagaggttgcagtgagccgagatcgcgccattgcactccagcctgggcaacaatagtgaaactccgtttcaaaaaaaaaaaaaaaaaaaaaatttcaactacccagataagtcaacttggtatcttaagaataaaaagatatatacatgtacaaaacaagtccctttaagataaaataccatttgcagataagacctcttaagagtaaagtaaatcaataagagatgcttttactatgaaatacacaattctttctccagatagaaactcaaacgatttaaaaaaacgatttcccattgttttatctgctgctgtgagttgtttccacactgaaatttttacccacatgtacccattatacatttacaataacgttcatgtgatttaaagtaatcatcccaatttattagaaggaaaaacaacctttatcccaggttttcgtaacaacgtaacatgccttatatgtgaggcatgtaaacctcacatataaggttaaacacacagaaatgaccccaaacttactgagcaagttcaaatccactgcacaccaacttttaatactgtgctaacagagggcaggcactgtactggccaccagaaagaggacagacaaggaaaaaactgagaaaccaagtcctttggctcccacagagccagggtcacaggaccaggtgcaccaaacactgtggcttgggtgatcacagcctaaaactgttaaccaatgatgtgtgacaaaccaattagaggggggtttgagttaatcccaagatcaatcaaataggatatgggtgtgacatgaaggagggttactgttaaaccctcacctctggtcagatcaatgcccatggcaaaggagcagtcagacatggaagttaacatacaagtcagtactgactttgaaggcaacaaaaaatgagggaaaatgaaatggcaacaaatttccctggggagaaatcaaagggtctggtagataaatgccaatacatgttaaatcccaaaaaaatgtatttggcctccccagcagaggttctcaacccccattacacatgggaatcatatggagaacttacaaaaatcccaatgtccaaattgcacccattaccaattaagtcagaatctctcttttggaagaaccagtttttagatggattgctttttctgtttttctgtttttgattacattgacttttgttcttttattatttccttccttcacttactttgggtttatcttgctcttctttttctagttaaagtgggagcttagattattcatttgaggcctttcatcttttcctcatataagcattcagtgctctaaatttccttcttagcactcatttaagttacaccccacaagtttttctttttgagatggagtttcgctcttgtcacccaggctggagtgcagtggagcgatcttggctcactgcaacctctgcctcccgggttcgagcaattcttgtgcctcagcctcctgagtagctgggtgcctgccaccacactcacctaatttttgtattttaagtagagacagggtttcgccatgttggccaggctggtcttgaactcctgacctcaggtgatctgtccgccttggcctcccaaagtgctgggattacaggcgtgagccactgcgccctgccacgagttttgatatggtatattttcatctacattcaggcattcaagccactgtactgatgagaagtgtgacgcttagtttccaagtgtttggagaacttcttgtagtctttctgttttgttttgtttttttccttttttgagacagagtctcactctgttgcccaggctggagggcagtggcacgatctcagctcactgcaacctccgcctcctgggttaaagcaattctcgtgcctcagcctcctgagcagctgggattacaggcatgtgccaccacgcccggctgatttttgtatttttagtagagaggggatttcaccatgttggccaggctggtctcgaactcctgaccttaagtgatctgtccgccttggcctcccaaagtgctaggattagaggcgtgagccaccacacccagccgtctttctgtttttgatttctactttgattctattatggtctgagaatatactctatatgatttcacttcttttccatttgttgaggtttgttttatgacctgggatgtagtcaaccttggtgaatgttgcttgtgcacttgaaaagtaagtatattatgctgttgttgggtgaagcattctataaatgtcaattaaatctggttgactggtggtgttatttcttctatatctttgctgattttctgtctactggttctatcaattactgaaagaggggtattaacattctcaagcataattgtgggtttgggtttgtctatttctcaattcaggtctgttgggttttgctttgtgttctttgaagctctgttatgtggtgcatacacatttaaaattgctatgccttcttggtggatcgaccctttgtatcattcttttagtccctggtaattttctttgctgtgatatctaattatctgatattagtatagccactccagttttcttttgattggtgtttgcatgatattttttttccatccatttactttttattttgagatacggtcttgctctgtcacacaggctggagtgcagtggcacaatcgtagctcaccataacctccaattcctgggctcaagcaatcctcctgcctcagcctcccaggtagctaggactacaggtgtgcactactgtgcctggttaattttccatttacctttaaactcactgtatcattactttgaattggaatagactgaaatgtgtctactccatcctgtctggaatgggaagtttgctctctgcactatttttgcaactcctgtctaaatttattatctcaaaatctcttaactcaaaataaaaaattaactcaaaatttaaaaattaactattaaaaaagcaagtatatgataaaaagagcagtttattaatgttcctacatatctggaaagtattaatttgagaaagagaaagaatcaacctatcattttgtgagattttcacttactgtactcttccagagtgaggaaacaaacaggctaagaaacgggtaaaacttacaagcctggggataattgggaggctgaccccctatctgtgggcccagaagaaagcaagtcactttgtaacaaggaagtatatctatttttcctcaaaagataaatattcaccacacctggtattcctggttttgccttgggagcggggagctgttttctcagtccttgcattttctagtctccctgcctggattttagtcatttcactacttattagcattctgaaaggttaacagaatttaaaatgtgtaactcgagaagaaataaaaggctaatcagttagttacaacacttgttagttctgtaaaagcaatgatgagtgagaaagctggaaagtactgactaaaatatggctttctgagaattagttgagttcagtcatttttgctgttcatgctccagtagccgccccaggaagccagatttggaaacagtacctgagtcatttgagacaaaacaacaagttacccctgaattgttttaaatgttaacgaaagagatcactaaaagatctaagtcatggatggaacctaattacctccccttggccctagaaaaccaaaaacatccagataggaatatgaaacacagaagaaagcaggtttttcctttctattcatttctcctattatcttagccctattttaattattctgagttaacgccattttacaaaaatggacagataaaaaattaaactcaaaattttgaaacaaagactctttgttgctgtgtgtggaaagtgaccatcttgtcaaaaaaatacctgtgagcctacagcatgattgattgttcaatgtgatgaaactttcctggaccctaagcctcaatattttgttatctgaaaatctgcagtttaatttcatccttcaagatcaaaggcaaataaattaacttggtctagtgattccacaaatctctagagagctgccaggcaaggcagatccacagaataactcattaacttataatgcttaaagcaactttgggaaaactgttaggaattgaacacaggctaaaactcctgaaggcactcaccaatgtatctttctacacagttgaccagaaaacagctaagctctgcttgactactccagtgaccaggagctcactatctaacaagcaatttattctaatgtctagacagctctaaacatatggatgattttctatgaacagaaaaaatctgccttttaacttccaaattctgcctttatgctggatttctttctgttaacaggttccaacctctctacctttattcccaaaccatctcttgaccctacttcatttttctctagctaatatccactttctttctttctttgccttctcttgcaaactcctcaaaaagtagtttacagtctgtaactccttccttactctcaatctctccttaattgcttctatctcaccagaattcttggaaaaatgtgcatacttcccaaccctcatctttaagtatctgtatgctgcatttgacacgctgatcactctggccttcttgaaactactcctttggcttccagaagcttttttcaagttccctgtgttgctaacactttttttcttcctctaaccatcttgtaggtgatggtggttccctgaagtgccctacccacatgcttatggctcccaaaacaaggtcctctggtccagagctggagatagaaaggaaaggcgaaagagacaggaaggtaggagggaaaagcaaagcaaagaaggaaggaagaaagaataggaaagatacatcaacaaaaagaaaaaagtcctgacaaccagatacatcaagctggaagacgatcaacactgaggaaactatgttctgttttccactagttcttcctaccttctaactggtctcagttggcaccttcctctatgccatcacaaaatctagaaaaatctctgaactctttcctatatcttaccctggaacatccaatcaattattaagccctgtcagttaacctctaaaataatcttccaaatcaatgttcctttcccatctcagctgtcattttcttagtttaggacctatctatttcctcaaacctagaatgcaagagcagtttcctaactggctttaaaagtcctaatcttgttgtccccaaatttaccctccacccaactgccagagacctatctaaaacacaaattggatcatgtgcctccacggtcaagagatttcaatggctgtcctttgctcctaggatctttattaaggtcctcatcaaggccaacacagccctccacaatcaagccatgtctacttctgcagctttatccctcaccacattctgccccagttttatgctcaaacaatgctgaacctctgcagttcctacctctaggctttataccatcccttctcccaggaggaccctcttcttgcttcctcacttttaaaacatataaactaattcttataaggctcagcaaacaggagccttatccttataaggcacagcaaatctcttctaggatgcctcccctactatgactcacccacactttgacaatcaacagcagtatgctctcagagtggcctgtgtatagtaccatcactaacttaaagtatttttaaccactaatattatcaaatctccgagaatgagttcctaccaggtatggactggactttaaaaattttgtaatggatgttattcttcctttatctctttgaaaatcttccagatttagacagtgagccaataatacatttgtccctggtcctaagtctctctctgctctcctgcctgccactctgaacagaagcaacatctttttactgtctctgttcatgggcaatctctgacttcacagtcagggatcatttcctccattcactgaatgttttaatcccattatctacagaaatacaattcccagccatctctacctttttctggacctaagagtccagaatgtccataactataggcctgtaactaataatcctcacttattgtctgatctgtttctggtccagagatttatactttcttgaccacagatatgtctaattttttactttattatcacttttaaagaaaggagatatgaatttaaagtatgaaatcagagccatcttgacgagaagccctcaagtttaaattttatgactattacacaaccttttagatcggggtcagcaaactacagcccatgggccaaatctagcatactgcttatttttagtatggcctggaggctaagaatggtttttacatttttaaatggttgaaaacaatttaaaaaatattttgtgacatataaaaattatgtgaaattcatatttcagtgtccataaacttttattggaacacacccatgaccattcacttatgctgttccagttactgactgttgtgcaacaaacaactgcaaaatttagtggcataaaaccaccaccactttatcacttcatgaattttgtgggtcaggaattcagataggcacagcagtgatgacttttttctactccacaatgtatgggacctcagttgggaagattcaaacagctggatcatctggagacgtcttcactcatctggcatctttgactgggatggctgggcttagcagagactacctccagagtgcctatctaaggcctctctggcataggtggcttctcaatagtcaaacttcttacatggcagctcaggagtcctagtatgagtgttccaatgaacaaggcagattgccttttatgatttagcctcagaagtctcatactctattgtattgaagtagtcacaagctcacccagatttaagtggaaggaggcacagatcctacctcccgaggagaagagaataaaaaaatttgcagctgtgttttaaaccttcatttatgggtttcacatcattttattgcaaggatccaggattaatgactgatttaaaatgtgatacacatccaggtctcagagcatccaagcttcaaaacaatttagcttcacaagaggaccatcatcagggtcatgacatgtgaacaattttaatactttcctatttgcttctggtcagtctttaattccaaacacatagaacacatgtgtttttaagtgttataggagtagactggtgccttaaaaaagagtaatttgtatctgtgtgatagatagcaaaaatggccccaattctttatccatgccctttccttatggatgctccttgaatctggactggctttgtggcttgcttagggcaatcgagtacagtatgaggtgatggtgtgccagttcagagcctaggcctcaagaggccttgctgcttctattcactcttagaaacctgaccaactaccatgagaacaagtctgggctagcctgctgcaggatgagagatgcatagctctgtgctcctacctcctaccactgccccagttgacagccgttggacttcaaaagcagagctccctgctgacctgtagttgaccataggcataaggggagaccagctgagaacagcagaactgctcagctgaacccagcccaaatgactgacccatagaatgaactaagtaattactattttaagccactaacttttgaagtggtcgttatacagcaatagttaactgacagaatttgaaacacagcttttaatgattaactgtagagtggaaatttcatcacaaacctcagtcgtactacactaaatcactttgggtactaattttccaaagtaggcattactgctgggatccacagaggaaggcactgtagctaatgccaagatcacagatgggtcaagcacttgacccaaaagaagtacataacagcagccatacgagtagcaaatgtcactctatctggaagtttctaatcctgtctgatgccaaggcagccataaggtacctcccctgtccagagataagcgtggcacctgcaaccagtggttaactatttaactggaatgtcagagtaacacatcagagcacccctataatcccagcactttgggaggccgaggcgggtggaccacaaggtcaggagttcgagaccagcctggccaacatggtgaaaccccgtctctactaacaatacaaaaattagctgggcgtggcggcaggcacgcataatcccagctacttgggaggcttaggcaggagaatcgtttgaacctgggaggcagaggttgcagtgagcggagactgagccagtgcacttcagcctgggagacagggcaagactctttctccaaaaaaaaaaaaaaaattagtttatattaggttgaaccatatgaaactgccattgttgcaagtcaaaatgtttgcatatcagcaatttcatagggttcaatctaatactgcaggatttggctcatgaacaaaaataagcaaaaaataaaagcttccttcctttgcttctcttagtctccaaagccctcacatattctagagaagtttaattcctatgaacttttaaggacatatattaagaaatacataaagcctcgcttataaatacatttttttttctcaattcaaaacacctagtttcctttaggagttgtattccacttaccagacttaaggtaattagcctgtgggtccccagtggagtattaggtctctctacctacatctcaaatttctagatcagatctgagcaccctcttttcatgtgccatttgtacacggcgaaccaggattccagaatgttgtttaacacaagaggaggttgttgacaaaaaagtattctgattattactatcagtgtgtgcttggtgtcagtggggggaggatatatttgattttattctagtttctgctttttctgccccagagttgcaaccagatggctagactatcatctctgggtctcttgtcagtcagagcaggagaagcctaagaggcaggattcctacccctgcatatgtgactagagtggtgaggcagttttcctccatcttcctgggcagccacaacaagaccctgtgaggaggcgcaggtgcttcgaataactggcactctcccaggccacagccgaagccacatgctcagaacagaggctcaattttaatccttctgagacaccatttcagggattggccaatatacaaacatgtaatcaatgtaatgcttttgtgtgctcgtgtgggtcttgagcttgtgaattttttgcattaacggttttagaattttctgcctagaaatttttagaattacccaagtataaacgcagtcttttttatggtaaatgttatttcatgagaaacactgcatacataatttcagcttcaatggtcagaagatcctgtgctttcaagcttactgttagaaatgcaaaacagggacaccaaaactccatcatcccacctcagttccctcagtacaggatgtttccctccttcaaaggttttttataagatctttcgtccagtgtattttacataaccagctttctctatttcccaaagaaaattattgcacagtctaattaagttttcccttaggaaacaccactcctgacacacaaaggaagacaaaacaatggtggcagactgtggaaacagaaatatttcatttttaccagctgaaaaactataaaaattaaaactacccctaagctattaatatgcaacgatttgaaatatcagcaattcacaggagactggtaaaaagtcctttgttcatttactgtttttatcaagttctgaattcagaaccccacataactactttgacaactgatagcatcacaaccacctaaaaacaagttcagagcgttccgttgtagacagtataaatgatgcttgtttttgcatgatctgtctcagaagtacagccaaggaggaactaagtctcacatgttcactctcacagggcccatcaaagaactcaataaagatctgatgaaggaacttaggctggaatttggaaaatgtggataacaccaatttctagtccattatcatattatttttattataatggctttgtagtaagttttaatttgataaagcaaactcccctcacaaattttcctgcttctggggcatttattctttccaaaatgcaaacctgattatgatacttgatgtaaaacccttctgttgcttcccagtgctcacagactcccttttaggcccctgcagaactgcggtttagtagagtggagagtgcgagtttagggtgaaatctgactgctcaacaggagagtcactgccaccatcagagaacctctctctctgacctggttccttaccaggctcactctctcctttaaatatgcattgaacaaataatggtttttgcaagggtgctgtgtaaggggttcccaagatcacccctaggttcagtgattcacaaggaagactcacaggattcggcatataatcatactcatggctatgatttattacactgtaaggatacaaagcaaaattagcaaagggaaaaggctcatgggatgcagtgcaggggagacaaggcacaagcttctaagagtcctctcctagtgcatacacagaacacaatttccctagcaacaagttgtgatgatacatgtgaaatgttgtctactagggaagcccactagagactctgccccagggtttttattggtgactggtcacataggcaccctctgactggtacagaccaaaattttagacttcaagaaataaagcaggtattcagcataaaccatattacttgtataaacaattccggcacaatgagccacccttatccgttctgggaaggtcaagaaccatccccaaaataaagttcttattcgccagcccagagtcaaccttgtaagcaggccttttcaaagtcaggtctgctatgataacatttttttttttttttgttgcacagatgccaatcattagcttggctgggcacctacacattctgcccagacctggatggggtaaacaaaactgtgacagtactctgagcaggggactaagggaacaggaatagaggaacacccatccttttccagtggcttgaaagaaggggcaatgaggactgcttcttgggagaggcaatgcctgagcccagtttgaacatgatagatattgtggtgtccatagatttaaatgctaaccaggtaagtgagcttggtaaattaatgagactaagctgtatctcagaaagtgagttacccatatggaccagggctattaatcactttgattccctgctttaaactttgtatggcttctaaatctcctgcaaagcatgcagctctgtcagaggtggtgccaacctaattttccagtcctacctgtgatactctgccccttcagtctctgtggtcccaacatccggtattcttttcagtgcctggagtatgttcctttctacctccaatactatcctaccccctactctggactgctcatcatcaccctatcctacttcacatggctatctcctagtcatgtcagatttcaatccaaacaacatttcctcaggatagccttctgtcccctaccccagagtaggtagggacccatgtcatttgcttcccagcaccaagtaacttctcctttatcactgtgggcacattaaagtccatttccttacacattgacacttcaagagggcagagactatgcctgtgttgttcactgtgataaccacagagcctaacacggtgcctggtacatactgggcactcatcaaacatatgaatgaagaatgaatcagggctcactccccttccccaacactacacacctcctgtgtctaaggcacatggcctaagctaggtcgacaagtcagccaagtgttttgacagaggtattgggaaagaggcactgcattgctacagatacagtctgcctgagagtgaaactaaatcacaggaacacacaggtgagaaaaggagatttggggctgcaataacagcctggatgttgccattcctaaagtcagcagcctgtggacttcatttaccagtaaaccctctttctgttacttaggctaatttaagtcaggactctgagatgtataactaagaatccttatagaaaaatagtaactggaattaggcacgtggttggtcctaaagaacaagagaaagactaccaggaagcctaacttgtgatgtcccaagctactggcctagggagtccttacagttccttaaattataaaaagggttggttattgttcagggagaaaagatgccctggctgggaagtagagcacaagcatcctggctggtcattatcctaaaaactactttatttgtggaaactcaaaccagatctcccaataggctacagagagacaaaaatctcccttattttcaatgggggtagatataattattgcaaataaaaagcttgaatatcacttcaaactagattctaaaccacattaataaagcattggctggataagcacttgaaaaagaaaacagtcactagcagccagcataggctctctaagaacatgacacacccaacttactttaggctcttttctgttccagtcactcatttattgagaaaattgtttataggtacagtaatacgtggaggcagctgacaggattttcctgctgatagattaaaaaaaatgcaggctgcaggcaggtaatcctgaaggtaggagtcttctggtgggacacagagctatgcccttggccctatcttgatcaaaactttgatgagtaacatagatgaatttagggttattgaccctaagagggataacattcatcaaagaaaagaggagaattcaaaagcaaatattataagcaaaaacaggatgaaatttaactagaacatatgtaaagtcactgcaattaaattgtttcccaaatacaggatgatagcagtttcagcttttgatgtcagtaaacaccacagtttagtgatgcagctactaaactcgggctgaattcagaaacataatgtctacctcagttggacaacaactggacaaccatgttccaatctgagtaccattaatggtgaccaatgaaagtgcatccagagaggggaaccaagactagaaaaagtttggggatcatatcacataaatgaccattgaaagggtgagagatggtgtagccgcctgggaaagcaaagacagaatcctataaaactgaaaatatccaaaccctatgacccagcaatcctatttctaaacatatatctggagaaactctcacaaatttgcacaatgatcaacatagaactgtttataaaagcaaaattcagaaagtagttaggtttccatcaatagaacggctagacagaataaggttcattcatactctggaatactttgcagcagttaaaaacaatgaagtgggtctataatcaatcaggatagactaagtttgccaaggtaacaaaaggaacctaaaatctgagtggcttaacacaaccaaagtctgtttattccgtatgctacatatttaaagtgagttggtaggagagcttattgtagttattcttgacctaagctgtcagaagctccatctctaccggccaggggaatggaatgtggcaaatctcatattagctcttaaaatttccatttggaagtgcattcattacttttactgacatttcaatgaccaaagcaagtcacagggccacgcctaacctcaaaagggacaggaactacaatcctaccacatgcccaaatggcagacagccaaaaacatcatgtgacatataataatacatactatgcaaagattaatagaaaacatatgaaaagatctaagatattttgctgtgtagaaaaaacagacacattcataataccaccatttatgtaaattaaaacatagatccaaaacaaatctatatatcgtttatatctatctatctatctatctatctatctatctatctatctatctaatctatctgaaactgaggagggaggaggatgacattagaagaggtgaccaaaggagaaataagcatttctgtaatgttttagtccctttatttaaaaatggtggctcatgcctataatcccggcactttgggaggctgaggcaggtggactgcttgagctcaggagtttgagatcagccttggcaacatggagaaacctcatttctaccaaaaattaaaaaaaaattagctggaagtggtggtgcacatctgtggtcccagctactcaggaggctgaggtgggaggctcactggagcccgggaggcagaggtttcagtgagccgagatcatgccactgcactccagcctgggcaacagagaccctgagaaagaaaagaaaagaaaaaagaaaggaaaggggaggggaggggaaggggaaggggagaaaacaaaggggaaaaggaaaaggaaagaaaagaaagaaaaaaaagaaaaaaggaaggaaggaaagaaagaaaggaaaggaagggaaggaagaaagtagctgggcatagtgatgcacacctgcagtaccagctacttgggagtctgaggtgggaggatcgcttgagcccaggagttcgaggctgcactgagccatgattgcgccaccgcactccagcctgggtgacagagtgaaaccctgtctctaaaataaacaagcaagaaaaaaagaaaaaaagatattacaaaatcttaattgttgataattctggctggtagagaatatgagtatttatcatattattctttgaatttttccattatattaaaatccttgaaataagttgttacatgaatcagaaatgttttagcttaaaaggccacgggggccaagcgcggtggctcagcctgtaatcccagcactttgggaggccgaggcaggtggatcacttgaggtcacgagttcaaggccagcctggccaacatggtgaaaccccttgtctactaaaaatacaaaaattagccaggtgtggtggtgtgtgcctctaatcccagctacttgggaggctgaggcaggagaatcacttgaacccgggaggcagaggtttcagtgagccaagatggcaccactacactccagcctgggcaacagagcgagactctgtctcaaacaaaacaaaacaaaacacacaaaaaaaggccacgggtgggagaaaggggaatgggaagtaggaaaatagatagctttaaatattttggacaaaagagatttgctgtgtgtgactatggagaggagagccaggaatgatactgacagttcctgaaaggcagattttggcttgggaataaagaaccaccaatctattaaggtttttggtcttattttttttagtagcctcaaaactgtatggaggaaaaatatgtattctttggggtaaaaaataatgttgtcaagagtcagacaaccacctgtctgacaaatactgtggcaaggattcctgcactgggaaggaatttggatttggtaatctccaagttccctacaattctcaggttccatcaaccttggactggaacctctcagtttctaaattctagttcacaggctctgggaaatgcaccacagttatcccaaggaaaacttcaaaagataatgcaacagtctgaacacaatacaaatctgaattgtgttacctgggaatatttcacaatcaataaggaataaatcacttaattgggactaatagttattataggcaagagagtcacaagaattatactggccttgaataaagctagctttaattctcacaccccgatcaaccttatgcacataattaaatcagtattatttggagaactattgcctgtttaattactgtttctgtgacttgttatttgttctcccagtaccaaaggcaaattgctcccacagctaaagagatctccacagaaacatcccactgaaataaacattcctttataaaatggaagagtaagaataatgaatgtgttttcttttaaactagttgctttggctgctgtcaaaagaaaaaataaaagtcttagcaatggaaaacaagtatcacttctatgaggagggccagtctggcataaagatagtgaggtaaaaactcaagcagctctctgctgctaccctgctcccagccaagaagataagggatttcaataggagtaaatgagacaacatgttatagctgaggattttctttcaaaaaggtaccataccttttaaaccagtaaggttctttgctgtacacagttaatatatgcctagaaggttataagttgagcagcctttgcatgcctggaacctgacagatctcaacagacacctgggaagcccactgtggcttttaaagaatgcatatttctggctgggtgcggtggctcacacctataatcctagcactttgggaggccaaggtgggcagatcacttgaggtcaggagtttgagaccagcctggccaacatggcgaaactttgtctctattaaaaatataaaaattagctgggtgtggtggtgcatgcctgtaatcccagctactcaggaggctgaggtaggagaatagcttgaacccgggaggcagaggctgcagcgagccgagatcgcaccactgcactccagcctgggcaacaaagtgagactccatctcaaaaaataaaaataaaaataaaaaataaagaatgcatatttctaccacaaaaatactgaaagcatgctgcaacataaaaacatgtgctctgcccatgtgtttttgctcgtttaggatttccttccttcagtgattctgtaccacataactaacaataggaaatactttcataaaagtgactgttatttagtagtttcttctattaactttcaaaactaaaaccaaaccaaacaaaaccaaaaaacagcccacaaagctcttaaatattcccaagttaatgaggttagtatggcttaaatataccttctttctagacccacattcctgactgtgctggagtttcatgtgtcctggtctctgttacccaccagaaataccatgtgaggcagaaagccccaatatgctggaaaagcagctgcctagaccaccacaatgccttgcagagacacagttggggccctaatctatgagcaaaacctgattcccacccccctccaggtttctccatccttcaaatgcaagcacttaacatcctaaaatgtcacaaagcagtgcatttatccttgggagatagaatttggtgataaaatgcaagactgtaatgttaggaaggacagagtgtggggaaagccagagacaaacaggagagggaggaggagaaaggggttgaggaatgaagttctgcagggcaaaggttactggaaaacagcaggacagaagcaagagactacgacagagaggcagggccaaggaaaacaacgaggtcaatgatatgctacacaaagacaaagaactgtgcttccagatgagattaccacatatgcctttagagaagtggttctgtttttcagggggtcattatgtattcagccaatagtgcagctaatctgcttactcttagcaacttttgtccacctaactgcaccaaacactacatatctgaaactattatttcagagatataaatactttaagggggagggaaagcaacccaaaacatccattaaaatatcagtgaagacttccggttccaagtaagatggtataaacacacacgtaacctttctgttgaccaaatgcaactataaaatctgtaaagaaaatatgggcaactattagagaactcttaaaagtatataacagcaggcgatcaagaaagaatgccagaatgcggagtacaactgaactggcagtgacttaaccactttttttcttccagtattcactggcctgaattcaacacaatgaaatctgaaagtgagcactgtggttagagcacatgttctggttcaaggtgcttttttggaaaagggaactactaatgctcagagaaactggagtggtgaggtggcggtggggggcggtggggggggaatcccctgggtttttctctcctttttctcccctttctaatgtctagaaaatcccatggtagaggctgtggcagcagcaacaaaaagtaactggcatagggagactgtacgagctaaaactctgaaagagagagaagaaacttctgtccatttggtggaactatggctccaaaagggcaaagccaaatcccattgctttttttttttttgagacagtctcgctctgtcacccaggctggactgcagcgatattggctcactgccacctctgcctcctgggctcaagagattctcctgcctcagcctcctgagtagctgggattacaggcacacaccaccatgcccggctaaattttatattttcagtagagatggggtttcaccatgttggccaggctggtctcaaactcctgacctcacgtgatccatacgcctcggcctcccaaagtgctgggattacaggcgtgagccaccgcacctggcctcccattgatttttcctactttttttctctctgtttgcctgccccttgtgccctagaggcagtgtattgtgaaagtgtgtagtttctcactggaggactaaaaaggaaagccctggaaaagtagaaagtaccagagaaataacaacgaaggaagagctcaggaaaacaaactcacaaaaagttgcttacaaactcctgggaaggcctccacttcctcacaggtggatctgattctaattagcatatcaaagacttggagaaatgagttaacacacacttaggtccctgactgacaggtgggtggcacacacacgacagaggtgaacagcactgcaaagccattgaatactgaactgatatttgaactacaccccacagaaagtgagatggaacttgcagtctgaacctaaccagaccaactgctgctgaaacaaatacattgacattctccatggggttgaaacaagatccagagtctcataacataatatccaaaacatccaggataaaatccaaaattatgcgatatacaaagaaccatgaaaatgccagctcacatgagaaaagacaacagatgccaacaatgagatgacacaaatgttgaaattatctaacaaggactttaaagcagctactctaaaaatgctcagattgccatgcatggtggtctgcacctatagtttcagctacccaggaggctgaggtgggcagatcacttgagcccaggagtttgagtccagcctgggcaatagaacaagatcttgcttctaaaacaaccaccaccacacactcaaacaggcaatcaccaaacctgaacactcttgaaagaatgttaaaatagaaaatatcagtaaaaagaagatataatgataaccaaatggaaactctagaactgaaaaaacaaccgaaataaaaattaactggaagaacacaacagcagaatggaggaggcaggcaacctgaagacagataaactggccaatctaaacgaaaaaaagattggaaaaaaaaaataacaaagcctcagggacctgtgggataacaataaaggatctaacatctaacatttgtataactagaatctaacacagagacgaaaaagagtgtgatgataattttttttttttttttttttgagacggagtctcactctgttgccaggctggagtgcagtggtgcaatctccgctcaccgcaacctccacctcccgggttcaagcaattctcctgcctcagcctcccaagtagctgggactacaggcgcatgccaccatgcctggctaatttttgtatttttagtagagacggggtttcaccatgttggccaggctggtctgaaactcctgacctcaagtgatccgctagcctcacctcccaacgtggtgggataaacaggggaaaactcccgcgccagttgtaatttttggatatatgtacttaaatttaggaatgtgctgcaaaatttttaaaagttattggaactggggctttttttttaaaagacataaagctggccgggcaaatttggtcacgcctttaatcccagcattttggacggttttggcgggcagatcacgaggtcaggaggttgagaccctcttggctaaaacggtgaaaccttgtttttactaaaaaagacaaaaaatttcccgggggtggtggcgggcgcctgtagtcccagttaattgggaggctgaggcaggagaatggcgtgaacctgggaggcggggtttgcagtgagctgagattgggcatttgcactcccccctggggtacagtgggtgtcttctttttaaaaaaaaaaaaaaagacataaagcagattttaatttagaaagggctagcaccattaaaatctgtcaagataacattatagagttgaccaccgagtgaggtctatagcagccaaacagtgagctgagaaattagggattggggtggggagtgttaggagagtgataattcaattgtattcttcaaattttcaatattctttctttcagtaaacattttttttagtttagaccggaggttgacaaatcagcgtgtgagctaaatctagcttgtcacttattttgatatggcctacaagcatacagaatggtttttacatttttaaatcattgaaaaataatgaaaggaagaataatatttcataacacatgaaaattatatgaaattcaaatagtataataaagtttttttttcttttttgagacagagtctcactctgttgcccaggctggagtgcagtgcatgatcttggctcactgcgacctccacctcctgggttcaagcaattctcatgcctcagcttcctgaatagctgggattataggcattcaccaccacgcctggctaatttttgtattttaagtagagatgtggttttgccgtgttgtccaggctgatctcgaactcctgacctcaggttatctgtctgcctcggcctcccaaaatgctgggattacaggcgtgagccactgcacccggccacaagttttgatatgctgtattttcatctacattcaggcattcaagtcactgtattgagagaagtgtgatgtttagtttccaagtgtttggagaacttgtagtctttctgtttttttctttttttgagacagtctcactctgtcgcccaggctggagtgcagtggcacgatctcggctcactgcaatctccgcctcccaggttaaagcatttcttgtgcctcagcctcccgagcagctgggattacaggcatgtgccccatgcctggctaatttttgtatttttagtagagaggggatttcaccatgttggccaggctggtctcaaacccctgatctcaggtgatccactgcctcagtgtcccaaagtgctaggattataggcgtgagccaccgcgcccggctggaataaagttttattccgaagagagttgtgttcatttgtttatgtactgtctatggctgccttcatgctacaatggcagatttgagtagttgtgacagagaccatgtggccctcaaagccaaagatatttcctatctggtcctttacagaaaaagttgggtgacccctggtttagacacacttcccaacctggccttctcatgcaaggtgatttctactcacagagtttgaaattcccaaataatttgctaacaagtctttatattaaagagggtaagcctggttcctggtgacagagataattgtggttgacaaagaaatacttgtctgtggcaggaatctgcctaggtaaatttgtatgttcttcctttatttttccttggatgttttttgagggctttggaaaagagttgacctccagactcctcatctggtcacaagattcatgagtcatatggtatatcttaattttaaaaaataagctttgaaatgctgagataaagtcttcatttagaaaagttcattatcccaacttctgctatctctttcaaagatttgttaggggtgaggagaagcagtgacatatgtagaatatgttctcttcttattttttgtttattcaatctctagatagatgtttatggctttaattactggactactgagaagtggtagaaatgaaagatacacaagatgaacagatttgaaggatagagttttgtttccatgacattgaagcagggatagaattgttttgtagagaggggtgaattctgaattaaagcacaggcacttaaactgtcttactatagaggttaggattgtttgccccaaagcagaggataatcagctcaagaaacacatttatagcattcatgacttctatttaagaaatagttggccggacgtggtggcttatgcctgtaatcccagcactttgggaggccgaagtgggtggatcacctgaggtcaggagttcgagaccagcctgaccaacatgacaaaaccccatctctactaaaaatacaaaattaaccaggtatggtggtgcatgcctgcaatcccagctactagggaggctgaggcaggacaatcgcttgaaccagggaggcggaggttgcagtgagccaagattgcgctattgcactccagcctgggcaacaagagcgaaactccatctcagaaaacaaaacaaaacaaaacaaaacaaagaaatagtttgggccgggtgcagtagctcacgcctgtaatcccagcactttgggaggcccaggcgggcggatcatttgaggtcaggagttcgagaccagcctgaccaacatggtgaaaccccgtctctactaaaaatacaaaaaaattagctgggtgtggtggcgcatgcctgtagtcccagtcctcgggaggctgagacaggagaattgcttgaacctgggaggcggaggttgcagtgagccaagatcgcgccactgtactccagcttgggcgacagagtgagactctgtctcaaaaaaaaaaagtttgggaggttctttgaccacatgggcaggaattcacccttcgggatataagaaacatgctgctctggtctgaccagtggcttaactgaaatgtctgtctctgataatggctctgaatattttcctgaaagcctaagggagctagactttcagatgtttctttccttaaggattacttccaaataccatcacagatttattctgatttttatctcagtccttcttgaacttgtttacattttcattttgtttcacttcttgaactgatgagttctctaagttagttccctaagcatggctgaaagtcctgttttccttttgataaaattgcctttaggtttcagggaatacccctttgttatttaattctataattggatgaataaaatcaagctgatcatttctacactcttcttaatagctcattgatttctgtttcatccctttagagcaagatttctcagccttggcactgttgacattttgagccagataagtctgcacattgtaggggactatttctgtgccttgtaggatgtttaacggcatccctcctgacctctatccctagatgccagtaacatcaattattgtgataaccgataaatgtctccagatattgccaaatgtcccctgggggggcaaaattgtcttcagttaagaatcactgcttagatctttggcttttccaaaatgcaaagtctgtgcgactgtcttgatgacacagagatgtctctgtttaattgattatattgcacttttctggatttctttcagctctggttaatgtccatcttgaatgacagtgatggccacttttatagtttcaatgtttcaagtcagctgaatcatttgggagtgacatgggaacagatatcttgaaatcttagaaaagtattttttccggttgtaaacgtcctatatgtttactctaaaactgtggggaatggaaaaattcagaaagaatgtttttatcaaccagaaatctgtcacttcagtgcaactaatgttagtaaattggtttatggtttttgctttctatatattttatttcatacatgtatagtaatttcactgtaaaaccaatttttatacattttaaaacaacttagcataaatgtttccctgtataccatgtttaaatgactggatgaaataccataatattaatgtaccttaattattcctcttttgtgtgataggtcggttttatttttattataaagttttaatggacattttggttcataaatcattttccgtgtttcaaattatttttctttcttttttctttttcttttttttttttttttttttttttgggacagagtctcgctctgtcacccaggctggtgtgcagtggcatgatctcagctcactgcaacctccgcctcccaggttcaagcgattctcatgcctcagcctcctgagtggctgggattacaggcacctgccaccacacccagctaatttttgtatttttagtagagacgcggtttcaccatgttggccaggctggtctcgaagttatctgatcctggcctcaagtgatctgcccacctcgaccttccaaagttctgggattataggcgtgaaccaccgtgcccagcctgtattaattttcaaggacgaatgttagaaatagaattcctaggtcaaacggtgtgaatatgtttaaagtagagcattattttttaaactgctacatggccctgcagagggcagtgaataggggccccttgcactgaccatgcatttcaaaagtatgtctcatgggtatatagtaggaaaggaaagggctatgtttgagctaatcacttttcctttccttggcctgcatgttcttccgtgggaatattaatggggagtcaagtagccaccaaaccgcaggcttaggttccagtcccaaataatcccagttgggttgacttccagacagtcctcctttaaaagggtattttactcaaggaagacatttactccagacatttgtattttgcctggtttgcagtcactgttaaaccactgtgctgttaattattgtacttgagatgatagtaggaataagatctgaaaactgccatcaaattactgttcccagtggtgcaaggtgaggtctagtgtacattttgtttctgccaaaatgaaggtaaggaagaaaagaatgcctttataaagtctgtgctctgatctgaggactagaaaataaacagctgaataatataaccaagtgtaagacatcgagatatatcacagttactctaggattacactatactgatttatggttttgtttaacaaaacattttattctaaggtaatttttttcatggtacaaataaatttatttgcttgttttatgttccttattcctcttttcttcccaagaagttactttgacaatcacagaccttattgggcctctttcccttctagttcttaaatgaatattcatgacagggacatcacagaaaacaattgtttgccgtatgctttcaggtgtcatcaagcatcatgctcagcccctgggctgctgtgactttgagatctgcctggtcaactaaagagggctagtccttctatggggcttttctttcttaaaaaaatttttttgacatacaaaaagctgtacatagttaatatatacaactagatgagtttggctgggtgtggtggctcacgcctgcaatcccagcactttgggaggccaaggtgggtgaatcacttgaggtcaggagttggagaccagcctggccagcatggtgaaaccccatctctactaaaaatacaaaaactagccaggtgtggcagagcatgcctgtaattccagctactcaggggctgaggcatgagaatcgcctgaattcgggaggcagaggttgcagtgagctgagattgcaccactgcactctagcctgggtgacggagtgagactctgtctcaaaaacaacaacagctactaaatgagtttggagataagtatatacctataaactatcatcacaatctatgccataaacctatctatcacccccaaaagtttccctttgctctattcttctgtcgtggtaagaacacaatataaaggcctatcctgttagcaaacttttaggtatacaatatagtattgttaactatagcactctgctgtacaaaagatctctaggacttaccttaaattaagtagtacattcttaaaattaccacttaataaggattcacatgttaagtaggggtgcctagaagcagaacctgagacagtattcaaatgcacatgatttattgaggagtgttctcaggagaaacctgtaaggggaagagggtaaccgggtaaggaaggagcagccagttagggtcttaagaaaatctagccatagcctgtttgaggtgatggcagaacaattattgactgcaggctgcctctgggagggagactggaagagtgtaatccccagttcttgggaagagaggggccattgtgagccattagcagccaacaagaagtagctggaaaatgggtacagtatgctagctaggtaaacaggattgggtgggggcagcacagtgtgttattcctttgcctgtttattttgtgcaggatactgtgctaagagctaggggtaaaaaatgaatgtgacacagtccctgctttcaagatgcttgtggtctagtgacaacagggctgaccatgtaaagcagcagtgtccaatcttttggctgccctaggccacattggaagaattctcttgggtcacacataaaatgcactaacacctaacgatagctgatgagctttaaagaatcacaaaaaaaatctcagtgtttaaagaaagtttatgaatgtgtgtttggtggcattcacagccgtcctgtgccacatgcaggctgcgggttggacaagcttgatgtaaagaatattgatggtgcaagtgaggtgcttctttgcatgtacttggatggaaagcaaaggagtgaataattgtgggggagggacgtctgggaagcttcatcgaggacatccaatgaatgaatagaaccagggttggggaaaatgggctggtcaaggaaaacatggggaggaattgtaggtagaaggaagagccctgtgcaaaggctggcaagcaagtatgaaacaagacgaacgtgttcccggaatcacatggggcatagtatatgccaaacaattggagtggattggggggaacagcagttgatgaggcctgagagactgggagccagaactgggcctcgcaagccatgctgaggagattgggcttagaaggggcaccattcttgctgtcatccctccagcctgtcctctggcttctggatcaacttggagtgctcattgtcaatgtacctgactgccccctggtggccatgttgctctaagcatgtcgctttaatgcttctgagccccaatttcctcatctgtaaaatggctgctgctgctatgtgtaggactgttgttgtgcttagaaataataaatagagatataaagatttaccatcattgaattattctgctgatatttattgttttctgtcattttcctacaataattaaaacagcagtatgtcacagaaatggacagacaaatcactggactttaaacagcccatacccaaaaattaacttgctttgttttcttttctaaaagtcattgatgactcattttcttatttcccaggactggtgtaactcgtattagataatctgtttcctaggctttttactgataatacaagattttttgtttccatctataataaaaaatagttgttactgtaattgttttaaaaatgccaaattttgcctattctttaaaatctccctctgtcaagaacagtttgataactcttttacttaaagaacagaatattatagaaaatggagaaactgttttatccaaagtacacatacccagaacttcagatgagaggagtatccatctcacaagaagtcttaggtcttctgaaactctcagggaggtgaggagagagggtccatggtcagttggctttcttcactgagatttttagagaataaaactgttttttctatgacatttgttgcccttgatcccatcatgagtcatccatatggaggttatattcagtgggaacataaactttcatttctctgggataaatgcccaggagtgcaattgctgagtcatagttgcatatttaatttttaaagaaatgaccgaaatattttctagaatagctatactattttacattcccacaagccatgtacgagtgatatagtttctctacactttctccatgatttgatattttcactatttctttatttcagctattgtaataataagtatgtaataatatcttgtggttttaactggcatttccctaatggctggtgatactgaatgtcttttcacgggcttaaatgccatttgcgttcctctttggtaaaatgtctgctgattttttttttttttttttttttttttgagacagagtctcgctgtcacccaggctggagtacagtgatgcaatctaggctcactgcaacctccgcctcccaggttcaagcaattctcatgcctcagcctcccgagtagctgggattacaggtgcatgccaccacacccagctaatttttgtatttttagtacagacggggtttcaccatgttggccaggctggtctcgaactcctgacctcaaatgatccgtccgccttagcctcccaaagtgctgggattacaggtgcgagccaccatgcccggcccatctcttgatttttaattaggtcatttgtttccttactgttgaatttttagagttccttatgcattctgtaatataagttcattgtcagatatgtgttttataataaatattacatgtataatatttctaagaaatgaccaaaatattttctagaatagcgattcctttttacattcccaccagcaatgtatgagtgatagtttcttcacatcttctccagcatttgatattacacgtgtgtgtaatatgtgtaaatattctgtcccattctgcttgcttttgcgtcttcttaacaggggctttctcagagcagaagtttttttaaaaatataagtagatagtttatttgggccaagtttgaagaccacaacccagcagcatagattcaagttgccctggatatgcttctgagagcaaaagtctttaattttgatgaaaacacatttttctttgccaatcatgctttaggtatcaagtctgagaactctttgcttagccctagatcctgaagactttctcttatgctttttgtaaatattttataattttacatttttcatttaagtctgtgatccattttgagttacattttgtatattaggttgtggtaggcagagatgtccgtgtcctaatctctgcaacctatgaatatgttaagattgctatttagctgactataaaatagggacattatcctggattatctgggtgggtccaatgtaattacatgggttcttaaaagtggaagagggaagcagaacagaagggtcagagaatgagatgcgatgacagaaacaggatcagagagattcagtgttgtttgccttgaagatggaagaagacagccgagatcaagggagtaagagtgtcctctaaaagctgtaataggcaaggaaatgagttctcccctgtagcctctagaaaggaacgcagtcctgatgacatcttgattttagctcggtgagacctgtgtcaaaatcctgacccactaaactataagatagtaaatttatgtagttttaagccactgagtttgtgataatttgttactgtaacgttagaaaactaataggtgttttagaaaagcttctattaaaataggattttatacatttgggtatactgtgtatctgaacaatttttatatatgcaacatccccatgatatcagataaatgaagtgctactctaagtagatctgtgcattcagtggggaatagttagaaaatgtattacttttatttctgcttaaatttctacattcattgtgactttaaattccccactactactttttaataggaagtgtcttgttgttactgttggttttgtttgcgtttcagaagagatttgaatgaaattttgcaccagagagccaaatgtagccccaaaaatttatgtgatgggaggctcttttttaaaaatattcaattgactttgactataggacaaacagaaccttagttaatggttctgattcttgtactaattttattagttttttaaatgacagctttgagatataatttgtataccatgcagcttacccacttaaagtatacaattcagttattttaatatattcacagatatgtgcaaccaatcaccaaaggacacaatatgttttcacactgtcttctaattttgtttctgagaaattagctgttaattttattggagttctcttgtaagtgatgagttgttttttttcccgggctgctttcaagattttctccttgtctttggctttcagtaattttactatgaggaatctctttctggatctctttgcatttatcctacttggagttctttgagtttcctgaatatgtaaattaatgtttttcagtaaatttggggagtttttctaatattttttctgctcctttctcattcacttttccttttggtactcccattatgtatatgttgatgaacttaatgatgttctacatttctctgaggctgtttcttcttcttttttccatctgttcttcaacttgcctaatcactgttgacctacttcaagttcattaattcttttttctgcttgttcaatctactgttgaggcccttcagtgaatttttcatttcaattgtgctttcatcaccagaatttctatttggttattttttatacttcctatttctttattgatagtctctgttttgtaaaatattgtcatcataccttcctttacttctttaatcatggttttctttagttcttcgaacatatttatatggctaatttgaaggttttgcctgttaaatctgacatgtggttgtatgggtcatactttcctgtttctttgcatatctcttaagtttttgttggaaactgggcattttggataatatattgtaacaattgtgggtactacccctccaccagggttctttattattatttgcttgtttactgctttagtaactgcctggattattttattgaagtctatttcctcaacccccattctcaccctgcagtatgaagcctctaatgttgctcttcgggggtacaagcttgtgtatgcccacagtcaccctgggatgacagtgggtttggtgaggctctccttggctgtctctttacttgaccacaccatgctgttatggtctactaattgttgactggttgctcttgttttgtttttgtttttttgagatggagtttcactcttgtcgcccaggctggagtgcagtggcgcgatctcagctcactgcaacctccacctcccgggttcaagcagttctcctgactcagcctcccgagtagctgagattacaggcgcctgccaccattcccagctgctctgttgttttaatcatgtcctggaatataaattgctccacaaactgatccaatcaaattagggctcctttgaagatagttcctgagatctgtgtttgagatttcttctgaccgcaagaggctctttccctgctgtctctttctctggttctctctggcatattaggcagcctaggcttgaacttctgtacactcagttgcaaatgaagtcagtttcattgcaggagaattgaagccccctattctatgccctgcctctctccctgggaaaaatctttgagccacagctctggcgcagtggatggagataaatggtgagcttccctctgagtgtcagccccaggtctcccaggtttgcctcttctggtatagaacccccaccccacaaggtaacgccagagcaatcaaggctctggtattcttggtggcacaacacccaaggcatagcctccatcccatgagttgggggctaggtggaagaagggagcccccacctctcagccacattctcctggaacgtagcctcagcaaaagtagctgggaacgggataagagatgccgacatcctgttcttcccaggaagaaaggagcttggagctggggtagaaggaaccctgtgttcttggctactgtactctggcatgagatctttgctgggagggaagatggaggaagtggttctagatccaaatactgcagactttgactttactttatgaattttagtagattttctcgaataagtacttcatttgctgtatgcccttaaaaccatttccagagactttaaatggttgggttttttttaattgaaataactttcaccaattttgctgggaagagggtcgtccatggagctgctcacactgttatgccagaagtggaactctgtgagctttttaatgtaaaattttgttgctgctattcttaattgctcagagtggccttgtatttggatttctacctcctcagtagattgtaaatagcttgaaggcagtagccctgacctttattcattatggaatcatgatagcccctggtagcatgttgtatgttgtggcacataaaagaatgtcagtcactggctatattgctgtcttttcaagtttacattttcagcacttcgtttgtgacttaaagtgcttaactgtgtcttccttttttcttacactccagtgctagtgtgttcccagaagggtgatgcttcttttttatctgtcattggccatactcagggaagtacacttgaaccgttggaagttttagtccaaagcatttttatttacccttcacaatataggagctttgtttaacattccttgtagtgtatatataattttgactttaggctacttatttgggatatggggacaggaagagagtgagagagggataaagggcaggcagaaaatcagtgtggtcgtgttcttaaaggtggatgtgcctcacttgttctttcttcagccaactatgtctcatgcttttcaaccttggctcttgatggccctgccctcatgactgattttttctttcctgttcgtctcttattggggatcactggctggttatggccccatggctgccccaccctttgttttggtggacagtggccatgtggccacatctgaggctccagttagtgctgtaccactcatttgtggcttgggcttcctcctaaggctaatgtggcctttcttagtctttgacatgctttgtattgaaagatctggtagtactcttctgtcattattctaagtcatttgagaatattcttgacaaaaatcattcagtttgtatgatttgcttgctgctatttctgggatccatgggacagtgttgactgccctctgggatgggtgtgtgtgaactgttttattcagtgtttttctttttcccaggatgctccaggatgaaacgccataggcctgtcagcagcagtgacagttcagacgaaagtgagtagaaccggctggcagctggtaacctttctatctatatcccttgaggatttttcctttcatttgaggataaaccatttcatgcttttttcaatggttgaaaaatgtttctgagaaggaaaattcagggcaccattatcttatttaaatttcattagagatagataaattagaagaattgattgtgtgtggcatataacttttcacttttcatttacctaaataacaaaagccagatctagtaatgctttaacagagcttctctagaaagaagaaaagtacaagagcataaattgtaggccctgattctaattgtagcttaggtactaagtgtttgactgtgagtcaatcatcatttgtaaaaggcagtaaccttattagcaatagcctttggggaagtgctgaaggatacacagattacttgctccacatttgtagtttttccagttgtttttggagatactttttcttcaagtggaatatgaattgtgttattgcagaacattatgaggtgtgattataccaaatcagataatctcatccttagcattgttgaagcttttgcactgtaggagatcatctataaatgtcactaaactccattatgaggcactcttcagtgcagtttgactgttttcttcagtggtatgagctctctggtttctccatcatatttttcatattctcttgggtgacatttagttttatgacatttagttatattagtaggtaatgtgtctcagtatttttttctaattatctttcacaggtccttccacttcctttacttctggctcaatgtataggatcaagtcaaaaattccaaatgaacacaagaaacctgctgaggtgagatcgtattctcaatttttagacttaagctatagtttggatgcttgtcttccaaaacctcatgttgaaattatatcccaatgttggaggtgcaggcctaatgggagatgtttggatcatgggaatatatccctcataaatagattaatgccctcccagagcaggggggtaagtgagtttttcactccgttagttcccttcagagctggttgttacaaagagtctggcacctcctcccattctctcttgcttcgtctctggccatgtgatcacatatgctagctctcctttgccttccaccatgagtagaagcagcctgaggcccttaccagctgcccagtcttgaaccttccagccagcagaaccataagctaaataaacctcttttctttataaatacttagcctcaggtattcctttatagcaatactaaataaactaagacaacttttaaaaatataaatgtctgcctcctaactatataccaacaatacccagaatctgaagatgtgaagaataaagaatgtgtcagtgggtaggcttgttttctgatgaacttatttgttttccaagaaagatttcattttctatctcctttaggagaacaataatcttcacactgtgatttcattttgtgatttcaatcatcttcacactgtgatgacacatagtgcctggctttagaatattcctcccctaaccaggaagtcaaagagagccagactaggggaactgggaaggacctagagatctcctggcctatgattgggaaaagctaagttagcaggtgaggagagatagtacagaaaggtataggtgagtaggttgtagatggactacattaaagatcatatgggtcatggtctgtgaagctgtgatgggtccttacagcctttggatcactgctggcccagaaagagtaggtcaatccttatcaggctggtcatcttttccacaaagggcagcaaagtgccagcgttcctcttggacttgataatggtttagtggatcctacagactttcctctgtgataattaaatgataaaatgactttgtatatcttcacttctactatgagtagacttccttagctgtaaaggaacagagaatatattagttatgtattgctacattacaaattatcacaaaattcgtgtcttaaagcagcacacacttatatctcagtttctgtgggtcagtaatctgggcatgatgtgactagattctttgttcaggatctttcagggctgaaatcactgtggaaaatgggatgtgttctcacctggaggcttgcctagggaagaatttgccaccaagctcatgttgtaggcagaatttgtctccttggagctgaaggactgaggtttctgttttccttcttgcttttggcagagagcactctcagtttctaaaagccacttgtagtttcttgccacatggccttttccatagatcctctcacaacatggtagcgtacttattcagcgccagcaaggagagtctttccctccagtcagctaagatgtagtgttacataacataatataatcatgggagtggcatccccaccacatttgctatataatgtgacctaatcaaaggaatgacatcccatcatgtttgccatattctgttgtttagaagcaagtcacaggtcccactgccttagtagaaagggagtgactctttgtgggttacttttgggtgtgtccaccagagagcatttctctcttccttggaggtcacttttcatttgtttcttttgccagggatttttctgggcacaatagaatgtaagagtttatttatatatgtccatgtcatacagaaagacttagggaatataacacacataaacaggagtggaagaaatttcccacctgtctagaggagactttgactacagaatggtgagaaagaaacctcactacctacccttttaggacgacagctggttctaggacataaggcaattcaagggctttgggttttgaggcctactgcctcccaggcagtggtaatagtagtcttttttgttgcaagggataggggacctgggctgctgaaagcaaattgttttcgtttatatttaatattctgttataaaaaggaaaacctggtgatattgtaggacaaaactagcctttgcattagaagagcttgatcccatgttctgctttgctggcttatttcatctctctgagataatttgtcagcataacatggacattatcatacctatctctcatacctatcatttattgaagttttatgtgccaaaagctttacattaaatagtttgtttcccaaatttaaacaattatgagactctccttggatgcctgtttaaaataatgattccagacttaccccaccctgtgacactactgaattagtatttccaagaaaagtgcctgggatctggattttaaaaagtgactcaggtgatttttataatcaagcacgtcggggaagtaatatactcttgttctattcctccagtaacactataaagtaggtactttccggttttttgtttgtttgttttgcaggtgatgaggctcagagaagttacttgcccagggtcattaaaaaaaagcagaactgacattcaagtttttattcatcctgaatcttgttttattaaccagtatgcattggacatattatgtagggtacaataagtatatagtaaacatttgttgaaactttggcagttaagaaatatgggacagcaccagtgttttctcatgagtagttataatcaaagtttccataatggagtgagagcaaaactcaagattagagagaacaaacctggaattgaacaggggctgggaacccaggcagcaaggagaatatggtaggaacccttggtaaaagaagaaaagtaaaagttaagtgggaattggcaaaggtgacaagcacacactactcacaggtgagtctgaaggcagcctttgaggaatcagatggaaccactgtgaattctttcttcctatttggcccctgaaactgaagcaatattgccattggctgctttttatttatttacttattttgagacggagtctcgctctgtcgctcaggctagagtgcagtggtgcgatctcagctcactgcaacctccgcctcccaggttcaagcgattttcctgcctcagcctcccaagtagctgggagtacaggtgcctgccaccgtgcctgggtaatttttgtgtttttagtagagacagggttttaccatcttggtcaggctgttcttgaactcctgacctcgtgatccacccaccttggcctcccaaagtgctgggattacagacgtgagccactgcgccctgccgccattggctgcttttttcaaagcgtcagtttatgccctatttctgatagcagactatcacttttctctcaatttctgattttcctggccttacttgctgcacctgtttgcttcaaacagttgttttaaggttcacttaagaaatatgacatatttgtatgcttctttatttctgatgttcccatttttcttttttgttcatttgtttctgtttgaagaatttcctttagctgttattttaggataggtctgctggtgataaattcgcttagttttccttcatttgaggatgtcttgatttctccttcattcctgaaggatattttcacttgatatagaattctggtttcacagtacttttctttcagcacttggaaaatgttgtgctacttccttctggcctccatggtttctgatgagaaatctgcccccattcaaataggttgttctcctctaggtagtcatttctttcccagttgtttttgagatttttctttgtctttagtttttaaaagttagattatgatgtacctgggcatggatttcttttggcttatcctcttcgggctttagtcagcttcttgaatctgtagatttatatcttccactaagtttgggaaattttcagccattatttcttcaaatatttttcaactccaccttctttttcccctccttttggggcttcagttgcatgaatggtagatcttttgttattttcccacaggtccctcaggcacttttcttttttttttcagtgtatattctgttgaacagattgaataatttctcttgttcattggttccatcttctgtttgttaattccattcattagttgagcctatcttatgagtttgttatttcagtaattgcattattccatcctaaaatttccatttggttattctttatatatatattccatttcttcactgagactttctgtttttttgtttcaaaagtgtttgtaatttcttgttgaaacatttttatcatggatgttttaaaatccttgtcagataattctaacatctgtggatctcagtgttgatgcctgttgattgtctcttctcgttcccagttcttagtatgatgagtgattttcagttgtatcctggacttttttagtattatgtcattagacactgagtcttatttaaatcttctgttttagtagtcctctgctataaccaggcaagtggggaagaggggtcctgactctctactacctgttgtagaattcctgagctccccatcctagctctttcactctctgggaagcagcactggggagtctctactgcttcatagaggtggaaattcccaccactttgttgcccccactgatgatggagggtatggtggtagtgaaggtaccaccttattgatcagtgatggtgacagcccaggctccctacccagtctgccaacatcacattgaggaggagaggtgcctcattattgctgggagagagtgaacatcaagacctctcatgtggtgtacattgataccccaataatcaccctcttttaaaaaccatttttaacatcttttcttgaaatataattcttgtagcatacaattcacccattttaagtgtataattcagtgggttttagtatgttcagagttgtgtaaccattacaatcataatttagaacattttcatcatctcagaaagaaaccccttacccattagcagttactccccaatctccctacctgcaacccctggcaaccactaatttaccttccttctctatggatttgcctattctagacatttcatataaatggaatcatacaatacgtgccctttgtgtctggcttctttcactgaacatagtgttttcacctctcatgttgtaacatgtattagttccttccttccttctttccttccttccctccctccctccctcactccctccctcccccccccccccccactttctttctttcttttggcagagtttcactcttgttgcccaggctggagtgcaatggcgcaatctcggctcactgcaacctccgcctcctacgttcaagcgattctcctgtctcagcctcctgagtagctgggattacaggcatgcaccaccatgcctggctaattttgtatttttaatagagacggagtttctccatgttggtcaggctggtcttgaactcccgacctcaggtgatccacccacctcagcctcccaaagtgctgggattacaggtgtgagtcactgcacctggccacttcatttctttttatgactgaatgatattacattttatcagtacaccacattttgtttatccgttcatcagttggtggacatttgggttgtttccacttttggagtattatgagtaattctgctatgaacattcaggtacaagtttttatgttgacgtacgttttcagttgtcttgactatacacataggagtggaattgttgggtcatatagtaactctacttaaccatttaactacttaaagaactacgagtctgttttccaaaggggctcatcatttttcagtcacaccagcaatatatgagagtgttagaaatttgttattgctgtaacagagacttcaaattcttctagtgacactgtttttgtctctcctcttggctcaaggtctctttgtgcttgtcctcataggaattttgtttcttgcagctctcccaagctgttagccagtgttattatccctggagtctttagcgtagtagagggtatgggggaggggcagtattcgctaatcttctcattaactctttcttagtctttagggtgcatagtggtcctgtttctgggggtggaagtggtggtagggaaggtagtcttcaggtagagcctttttgccactgccccctgttccctcattggcctgtagcaggtatcttctgatgttctcagcctttgtccttgaggttctctctcctgtagattacctttttgcccgttaggtaacacagggaggctgaggctggatgcttttcccttctcccagcagtaatgaaactacaccattgtcctgacttgatacccttcccctgcagatgaagccttttgtttggtaagggaaccagggcactaagcaccaagtacccagacagcaccactctggtgctttctccaggtaccgccccctgccccggccctgcccccaccccagcttccctgtgtgagcctaattgggttcctgaagaaaaagcttgcaagcgggtgggaccccccccccataactacagcccccaagaacttcatattctcatatcagtccccacgcagcatccagcgattcaaaatttctagtttaatgttcctgctgtggcttctgccacaggtaaccaaatgctctgccctgtgtctccctgcaggcacctgtctctctgaattgggtatttgtgctgtgattcacttctctgatgggttcatgaaaatttgttaatttgctgcctgtcctgccatttgcttcttataaaaacgggaggttgttttgttttgttttttgttttctgactacaggtctgagacaaaaccagaattcttgagccttatgattttactgggaattagtcactgacatgcaatataaattaccccttttgcagaggattaattggctgcattaaaagatacatatttttctttgatatttagtgtatcagtgagattcttgtgcaaatctccctctaatttatcctgtagagaagagtttcctagggatatgtgaatcccctgtatggttcaggggctttgtgtaccttctggaaattgtatacagatttttaagggtatgttctttgttaatttttttttctgagatagtagccttatctgattcttaaaagggcccatactcgtaaagttgttgttgttgtttttaatccctagaaaaagtacatagtaactggctgggtgctgtggctcatgcctataatcccagcactttgggagactattaaaaagtcttccattctttatcaaaagctaggatatttttgactactagtctggtgtgtaaaacatatcaacctatcttaaaacattgactgcatatcatctgtaggcctggagtctcattattatccaagactttcatagcaacagaatgaaagctcatatattttaattcagtggagagcactacatactctctagtaaagcctgtttacatcattgtacctatatttctaacaagcttaattacttggttttctgacctacagcagataaaaagcactgagctacaagtgcatacttattacacaaaaagggacattgagggaagggagaataatttgcaaagcagccttcaaatgttatttcttgtgctgaaattgctcagatctctaaatcagactttgttgctcccccttctccgttatacctctgtttgatatgggggaaagggaataatccaacttaagcaacccaaaggtacattgctttatggtaattgatgttgcagttggtgttagcccatagccatcaaaacgttctgtttattctttataagaaacctgagagttattttaaactatttgaaaaatatttccatgggttttaaagtttcaaatttagaaattacataagctttttgattcattgaaaaaaatcaatgtgggatgcaatgtcttgacaaaacaagaacagagtttttaagggttttaggcacagtgttctttgctaagttttctctgctattgattttctggataacctgacaactttttttgcctaaagattgtataattataattaattccttttgcttaaatataattaccagtttgtagctgttttatgcttttggggtgacatgttagtttgtggtcagttatgtgtagcttcagatttcagtgactgaatcaaaattgatcaatctctctgctttattcacacggaccagacagtgttactctttgtgtcatacaggaagttaatgttttgacttttcctatgaaaaatgtcacacaaatgttcagaggagctgtgctttaaaaaactgccaactgagagatgttaatgagagcaataaaagccagagttgtctgcaaagggcattttcattttgtggctctggcaggttaagcattgatgttctaattgaattcatagtgaggcctcctttgtttctgcaagcatctgacaggccagatgtgcacacagtgttgggcttggcatagcttctggactgtatgttagccagtgaatcccctctttgaccataaatgaacagttatctggtaagtacaaagcctttttgtttcaggaacttttgggaaaactaccagtgcatataaaatagacacactattaagaacttgtaaaacttctcaacttcattacctagaaaggtcagggtcagcatctagatccctccttcattatctttaatttagcaacaaatggctgtgttttattttgtgaagtttctacattaccttgtggcctttggaacgttagttaaagttcttgttggggctcttgcttgggaactgtgtctttgggagccaaaccatgcacattttaactgagctgtgaactcatatctctcttaccccatcaacaattactttgtggactatagagaagaactcagttatatacttgtttctgattttagaaggaatgctatggtgatgataataaaataacaccatctagcatttatttggaaattactgtgagctccatactgtgctaagtcctttatacaagttcacccatttaatctttacaacaacccctatgaggtgagtgttattatccccattttatagataagttgagacgcagaatttggataacttgctgaaagctacagtagtgaaatcagtataccaatccaggtggtctgtcccagacccatattcctttaagattttttttttttttttttgagatggagtcttgctctgtcgcccaggctggagtgcagtggtgtgatctcagctcactgcaagctccgcctcctgggttcatgccattctcctgcctcagtctccctagtagctgggtctacaggcacccgccaccacacccagctaattttttgtatttttagtagagacgtggtttcaccgtgttaaccaggatggtctcgatctcctgacctcgtaatccacccgccttggcctcccaaagtgctgggattacaggtgtgagccaccacgcctggcctaagattttttaattatataaagtatttgcctgcttcagactttaaactgtaaaacaaaatatattgagagatccagctagattcagctcaactattttggtaacttttctataagtctctctcccctccctgttttctcctcactctgcagagttaaccttttttgttacgtttttggtttattcttttattgtttctttatgaaaatatatacaaatatgtatgtatgtgtgtgccacttctgtatataaaattctcctcactaatcgggatttgctatagttattttgttttcagttcaaaaactttaaaaatgccttttcttatcaaaagcgggttaatgagaccagtctggtaaatatgttttatatcactttgcagatatcttctgcctgagtactgaactgacattcccatccactcagcattttatgttctgtctcatgcttgagattgacttccatagcaaaataaggcagcctctcacactctgccttaagtaaaaatgcttctctagaaaacttagatctgatgctctttaatctggctagcttgtaaaattgaaatcaggcttatcatatgcctgtttttctctaaaggggaaggaaaaattataatagtcattggattcagttttcatttgcttaagaaaaacaggtatgaattggttggtggtttcccagacttcaccttcgtggaggtttgagtatttctctcttttttttgaggcagagtctcgctctgtcgcccaggctggagtgcagtgacgcgatctcggctcactgcagcctccgcctcctgggttcaagcaattctcctgcctcagcctcccaagtagctgggactacaggcatgcaccgccacacctggctaatttttgtatttttagtagagacgaggtttcaccatgttggccaggatggtcttgatctcctgacctcgtgatccacccacctcggactcccaaagtgctgggattacaggcgtgagccactgcacccggccaggtttgagtatttctgaagccatagacaaggaccacatttcattggcctctgcttttgtatacctttgtctgtagtcttcaagttactcttctgtttggtaaacatgtatattagtttcctagggctataataaattaacataaacgaggtagcttaaaacagtaggaatttattctttcacagtatgaaggccaaaagtaaaaaatcagccagtctgtgctccctccgtaggttttaagggcgattcattctttgcctcttccagcttttggtggatgtcagcattgattgatttgtggatcaatgaatcactctaatctctgcctccatgatcacactaccttctcctcttccatctcaaatctccctccacctttctcttgtaaggacacttgtcaatggacttagagcccacttggatattccagaatgatatcttcacctgaagattcttaacttaattacatctgcaaagaccctttttccaaataaggtaatatccatagtttctgggaactaggatgtggacatatctttttggaggccaccattcaatccactgcaatatgttttcaggttaggaaactatgtagagcagatttcataagcagttatggcaagtatgaaggtacggcttatgctttgtaattagatcatttggcattattcattattagtcaagcccaaagcatgatcttgtaatcaattgatatattttataaagactatcacttggaaaataatgaaatattttaggatgttgacacatactttccagaactaaggaaggatttcccacagcaccatctttcccaaagatagtagtttagcaaattggaaattgccaccactacttaaccactgcctcattaaagatactctgaggccaggcaccgtgcctcacgcctataatcccagcactttgagaggccaaggcgggcagatcacttgagtttagcagtttgagaccagcctgggcaacctgtcgaaaccctgcctctacaaaaattacaaaaaaaaaaattacaaaaattagctgggcatggtggtatgtgcctgtagtcccagctactcaggaggctgaggtgggaggatcgcttgagcctgggaggcagaggttgcagtgagccaaagtcacgctatcgcactccagcctaggtaacatagtgagaccctgtctcaaaaaaataaaattaaattctggaacagaaagacattagggagaaaaatagtgaaaatttgaatgaattctatacattagttaatagtattatagcattgctactttcctggtttaggtaattgaactctggttatataaactgtaaacaattagaggaaactaagtgaaggatatatggaaactttactatttgataacttttctttaagtctaaaattatttctaaataaattttaaaatgaaatgatgcccaaataattattaactatcagtggatacttgttacttaatttaagaaagttaaggattgttttatacaaactgttttgagtaacctgtattgttggtttaaatttagagaacccaagaaaataattcaggaaggactgcattaccctttattaaatcccaaataagctggcttccttgtcagtacttcaaacctttccaaacagaagttgatctggccatttaggaagttagagatgtttctcttgttggaagcagagtggatggggatggtctttttaaaaggagaacattgaatggtatcagttgcatagtgatggtcttctcaagatatgtgcaatatctttccaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggtatttgcatgcttgcacctttgacttagggaatgaatgctctcatgtttgtctgctgcttggggagaaacttagagtggctaattatgcatttatagtacaaagtcacataccattttcaccaattcactcagaccagtggcagattttaccaggctataataagcaataaagtcaggctcatgtatttagggacatagtatgtgcccattattcataggataaaaccatttgaagtccaatctgaaattatgataaaattttggagacaagaatttccaagtcttgactcaacagtcagtagcatttattagtcttctgagagaaacagaattaattacataatgcctgtcttagtctgtttactgttgttataacaatacctgagtctgttttatttatttatttgtttgtttgtttgtttatttattttgagatggagtcttactctgtcacccaggctggagtgcagtggcaccatcttggctcactgcaacctctgcctcccgggttcaagagattctcctgccttaccctcccaagtagttggaattacaggcgtgcaccaccttgcccagctaatttttttggtatttgttttaatagagacagggtttcatcatgctggccaggccgttcttgaactcctgacttcatgatctgcccaccttggcctcccaaagtgctgggattacaggcctgagccaccgcgcctggccgagtctgtataatttataaagaaatatttggctcacagttctaaagactgggaagtccaagggcatggcagcagcttctgaagggcttttatactgtgttataacatgtgagaaaagaagaaggacaagtgaacatgtgtttaagagatcacaagagtgagccaagctcacttttatgatgacccactcttgtgagaattaattcactcctgcaggaactcattcccacaagaactaactgctgctataacagcattagtcaattcatgagcactccaccctcaatacccaattatctcttaaagaccccacctcccaacaccatcacattgggaattaaggttccaatacacaaacttttggtgacacattcaaactatagaaacacctgtgggaagttttatatatatatatataacatatatatacatatataacatatatatatatatataacatatatatacatatataacatatatatatataaaatagggtcttaaagtaatggtatctataaatagagggtcaaaaacatagagtaatggtacctgtaaatagagggccaaaaacatagagtttgtaaatgcataaacccaaataaaaggggattactgaatgattgagttgactctaagcacatggccttcatttgcattagacctgagaagaaaattgaaataggagagggctttggttttagaaagaggagagaaggacttttctgccagaggaagtaataagtaataagttcagttaaagagtagcgactggttttggaagccattttttctttctggtctttgtgtttccaatactttacacaaaggttggcattaaacaaaatgctgagtaaaagtttgagtgaatgaatgaatgggtagaatgtagagtgccaaataaaggggctagtgggacctactggttactgtgagaaattgcagatcttattgtacacccatcaatttctgttacatattagatttttttaagggcagagataacatccttgaattctctgctcctagtactaggtttttaagacctagtcatgctccagaaatgcttgttggaatcatttctagaaacccaggctgtcctacccacagaggctgtcctacccacagagaggctgcctatgctctgttaaggaaagctccacagccttgctcagcacatgtcccaaaactcactggttcatcatcaacaccatctcctgccccctaaaaatcagagtagcatcatgaatgaacatatgagttgagtgttttcatgtccttgttgtcagtatttttatacaaatatagcagccctggtgctgagttgaccatcaccattccattgatactccgaggattattgagtgtgactagcatcttgactttagtctcgttggtaagtcagtatcaattatctacttattggaggtgattttaatcttttaggttgagtggaaaatgtcccctgtaccactttaaaaatgttatctgataagtgagccatgggtaagtagggtagcaagaatggagcaacagtttaagaacagtaatttattttcatttttttaattttttgagatagggtctcgctctgtcactcaggctggagtgcagtggcatgttgtcagctcactgcaacctccgcctcctgagttcaagtgattctcatgcctcagccacttgaatagctggggttacaggcatgtgccaccatgcctggatatttttgtatttttaatagagacggggtttcaccatgttggccaggctggtctcaaactcctagcctcgagtaatttgtccgccttggcctcccaagtgctagaattaaatgtgtgagcccccgccctcagcctaagaacaacagtaattttagaaactaaaagagtttaacttgttttcaaatatagggatgtgcgttcctaattcatgtgtggcttcagtgctctattatttgttccgagggcttcacatatttaccattataagtgctgtgaattgttggtaaatctcttctgtttcccatagttctttgcctatcatacgaaactcttaattttaatggaacaacaaggcagactattaaattattgatcatattgaattccttaatgaaatccttaactggttgctcttggtaggtatatcagtttctgttttttagaaaatatcaataagacttgtactgtagtatgtagcctttcctatggaacagtaattctcaaattttagggtgcatcagaatcatttggagggcttgttagaacagatttcttaacctcacccctagtttttgattcagtagatctgaggtgtgaggtctgagaatttgcatttctaacaactcctgacatgatactgatgccactagtctggggatgacactttgagaacaattttgttatgaaatatgtttatctcatttcctgaatttaatggaaatctccatacttttatcatcttccttggatttctcttttggctttcaatataagccagccatattggaggctcaacctatttaggatttggttggagtacctaaactttgtttggagtacctaatttcctcaaccacagctgcttatcacagcaacccttaactatcatcattttgcatgggtcaaactatgtcttgtgatttttactttctgaattttgtaagtcaccttaaaaattaaatctttgtgatatgaaattatattggaacattaataaataatttgttttcatgtccttcaacagattttcaaaatcaaatgacttcaattaacatttttaagtactatataaattcaggcctatttagataccccatggtatgaagttactctcagacttgccttttaactaggaactagtcttaaggttttttggcagagctttctatttgccatccatatacccttttcagtgaaatatatctttgtcttttgcctgttttctaatcagattctttgtttttttactattgagtgttgagaattacttataaatttgagatatgaatccattgtcaaatatgtggtttgcaaatattttctcccagtctatttatagattgacttttcgtccagttaagagggtcgttcacaaagtataagtttgtgattttgatgaagttcaatttattgattttttttttcttctggatcatgcttttaatgtcatgctgtgaacttttcacttagctctatgtctcaaaaatattcttctatgttttcttttaagagttttatagttttacatttaaatgcgtgaaccattttgaattaattttgtgtaagatatgaggcatagatcaaagttcaaaatcaggtaagttgattcttcccactttattcatttttcaaaattgctgtggctattccactttctttgtctttccattcaaattttataataagctttccatatgtacaaaaaatcttgctggattttcataaggattatattaaacctttatcacttgggaagaattgacatctgtacaagtcctgtacacattttgctaaatttatgcttaagtgttaaaattttttgagcagttgttaatggtattatatttataatttaggtttccacatggtcattgctagtacatacaaatacaaccaatttttgtgtgttgatgttgtgttttctataaccctgctgaattacttagttctggcagttttatttaaaaaaaaaaaaaaaaaagaggttccttaggattttctgtgtagaccatcatgttacctgcaaataaagatggttttatttcttcctttccaatctgtttactttttatttcttttcttgccttattctagtagctaaaatgtcttgtagtatgtcaaatagcagtggagagagcagacatcattgtcttgttcccaatcttaggcggaaggctttcagtctttcaatatattaagtatgatattaactatagggtttttcatagatattctttgtcaagttgaggaagttcacctctactcctaatgtgtggtagtttttttcataaatgggtattgaattttgtcaactgaaatgatccctatcaaatgatatgatcaggtgattttttttcttcttcagcctgttaatgttatagattacattgattgattttttttaatattgaacaagccttgcattgcttgagcaaacctgagtattagtcagcttgggctgccataacaaaatatcacaggctggatagcttaaacaacagaaatttatttctcaaagttctggagtctgaaagtcctagatcaaggtcttgcagagttcagttttggtgagggctctcttccttgcttgctaccttctcactgtgtgctcacatggcctttcccttatgaccttatttaagcttaattacctcctgtaggccttgtctccaaatacagtcacattgggggttaaattttgggggtgacacaattcagtccataacaccaagttgatcagggattatattatatttttatactgcttgatttgacttgcaaatatcttgttggaaatttttatgtctatgtatttttatgtcttatttttatgttcccgaggaatattgacctgtagtcttatatatataaaaataattatatataattaatgtatatatataaatttatatatttatatagatataaatttatatatatattaattatatattataattaatgtatatgttatatataattaatgtatatataaaaattacaaattataattaaatttgtaatttatatataatttatatataaaataattatatataatttatatatgttttatatataattttggtgacatacaccaaaattataaatttatatatatttataaatttatatatataaatttatttttatatatttatatttttatatataaatttattatatatataaatttataaattatttatatatataaataatgtgagagacagggtctcgctctgttgcccaggctggagtgcagtggcaccacctcaagctcagtacaacttccacctcctaggctcaagtgatcctcctgcctcagcctcctgagtagctgggattacaagtgttcatcgccacgcccagctgatttttgtattttttgtagagacagggtttcaccatgttgcccaggctggtctcaagctcctgacctcaagcagccctccagcattggcctcccaaagtgctgggattacaggcaggagccagtgcacccaacctctcatgatatttatatctgtattgtatcagggtagtactggtcttataaaattagttgggaaatattccttcctcttctagtttttggaagaaatggtatagaactggggttaattcttattaaaatgtttgatggaattctccaatgaaacactccagacctggaggcttctctttggggatttgcttaagtataaatttgagttcttttttttgtttgtttgtttgaggccttgctctgtcacccaggctgcagtgaaatggcacaatcacggctcactgcagcctcaacctcctaagcccaagcaatcttcccacctcagcctcccaagagctgggaccacaggcctgtgccgccatatgcggctaattttttaagaattttttgtagagatgaagtcttcctatgttggccagtctggtctgaaactcctgggctcaagtgatcctcccgcctcagcctaccaaaatgttgggattacgggcgtgagccactgcacatggcaaatttgagtcctttaatagataatttgaatagccctgtaactatttcatgttgagtgactttggttagtttgtagtttaaggtactggtttgtttcatctaagttgttgaatttacatgtatagaatggctcatagtattccctgtgttgctttcattttaaaattcaatcttggctagacttctacttccaaaaagatggagtaggtatgcttttccctatgcctcccactaagtacaattaaaaaccctgagcattttatataatgcaaacataagactttgaaagatcaggagaagaaagcagaacagctagagtccttgagacctgaggaacaacccagttttatgttccctgggatttctttttgttcccagagttggtgctggagaagctagcaacccagaagcacaaaccagcaaaaacaaaaaacaaaaactaagaaaagcctgtcctctctagccaaatgaccaggaaagggaccgcctatcagacaggaaaccttttttttattattttattatttttttgagactgaatctctgtcgcccaggctggagtgcaatggtgccatctctgcttactgcaaccttcgcctccctggttaaaatgattctcctgcctcagcctcccaagtagctgggattgcaggtgcacaccatcacacccagctaatttttgtatttttagtagaggtggggtttcaccacgttggccgggctggtctcaaactcttgacctcaagtgatccacccacttcggcctcccaaagggctgggattacaggtgtcaatcactgtgcctggccaacatggaaaacttttagacagaaaactcttctccagtcaaacaccacagaaaaatactttgggccaccccaaccttctccagcaaagatggagtagggagcttagacagcaatgatgtaccccatttggggttgtgttagaggagactgagtggacagtcaggattttcacctctgttcagcagtgtcagtggaggccatgcaggaaacaatagcaaggcattctcaccaatcccagtgatggaggtatccatggaagcctagtggggggctgaaactctcagccccacccaacagtaacagggatgttgacacaggccaaatggtgaactaggtcttatacaaccacctggtggtaacaaggcaatgcccccaaccctgatctccagccagatagtgtcataggaagccagccaaaatcgaaggtttgcataagatccagagtctcataatgccccaaatgtctaggttttagtaaaaaattactcatcaagaatcaggaaggtctcaacttgaccaaagacagatgccgacatcaagatgccagatattagaatagtttaacgaagattttaaaacagccaacataaaaatgcttcagtgaacaattgtgaacatacttgaaataagttaaaaaaaaatagtatccctctttcattcctattattggcaatttttgtattatctttttttcttgctataggttggtcagttatcttgatcatttcacagaacactcttcttatttttgtttgtttttagagacagggtcttactctgtcactcacgctggagtacagtggcatgatcacagctcactacagcctggaccttttgggctcaagtgatcctcctgcctcagcctcctaagtagctgggactacaggcgcatgccaccacgccaggctaatttttgtagttttttttttttttttttttttagagacaggggtttcgccatgttgcccaggctggtcttgaactcccgggctcaagcaatccgaccacctcggcctcccaaagtgctgggattacaagtgtgagccaatgcgcccagcccattacttttctgtttttaatctcattgattcctggtctttattatttttatccttctgcttactttgggtttattttgcttttttctcgtttctagtgttgagaacttaatttattgatttgaagctgtttctcttatctaatgtaagcatgtagtactataaattttcctctcagcacctgctttaactgtgtctcataaattttgatatgttgaatttcattttcgttctcttaagtatatatttttttaacttctcttgaaatttcttctttcacccatggattatttcaaagtgtgatttttggtttccaggtgtttggaggttttcttgttatctttctgttgctgatttctagttttctttttttttttcttttcttttaagagatgagatctcactatattgtccaggctggtctcgaactcctgggctcaagcaatcctcccaccttgacctcccaaagtgctgggattatgggtgtgagccactgcgcgtggccagtttctagttttgattccactgtgatcagaaaacacactctatataattccagttatttaaatttgttgaggtttattttatggcccaggatatggtctgtcatggtacatgttccatgggtgcttaaaaataagtgtatgctgctcttgttgggtagagtattccataaatgtcaattcgttcaactctgttagttggtggtagtgttgagttcttctgtacccttgttgattttctgtttgttggttctatcaattattgagagaggttgaggtctatagctataatcatggatttgtccatttccactttgagttcagttcatttttgcttcacgttttggagcactgttgtttggtgcacacacatttatgattgctatgtcttcttgatgacacttttatcattatataatattcctcttcatctctggtaattttctttactatgcagtctactttatctgatgttagtatagtcacttttgctttcttttgagtgatgtttgcatcatatgtctttctccattattttactttcaacctacttatatccttatattttaagtatgttttatttagacagcatatatttggatcatatttttaaatctgctgtatcaatctgtcttttaattggtttagaccacttatatttgatgcaattattaatatgttaggacttcagcgtgtccttttattttgtgtgtgtgtgtgtgtgtgtgtgtgtgtgtgtgtgtgtgtgtgtgtgttctctgtttttcatttctctgttttatttttcctaccttccttggaggttccctgaacaaactaccaaactcgatccatgtgaaatagatcatttgaatagccccaaagctattagtaacattgaatttgtaattaaaaacttcccctaaaaatacctccaggcccagatggtttcactgagaattctaccaaacattgaaagaaataacaagtgataacagtagaagagaaatttgaatcaaagatgaatagagttataaaagaaatagctaaccatgggaatatggggatatgctgctgttttagaagctctaggtttacagccaaaaagaacttagtgaaggcaaacttatcaacataaatgaagaaaatggttatggtgaaaagaatgaagatgtcccagaggaagtgatactagtgaaaaagtgcacattaaaggaattcttggaagtattttacaacattgaaggtacaaagaacaaaatgttgaaaactaatccacacttagaagggaatatgacaatttgccaaggggtagaaaaggtgcttgctccatgttgtaagttatgcaatgaaaaggagttaagcattgtaatcttgataagtttttacaaataaataaaagtgtaattctcaatgtttctagtgtttcaaattatattatattaaatacatattggttttattattttttatttcactatatgtttatagtcaatgggaagatagctttttaatgttttgacaaaatttttaaaggtcattaatgacagttttccccattgtttattaagattgcttttcacagttttagcttgcacagtcatttttacagtatcataccaccatgcaaagcaaggactatctgtaatctttagtgacagaaagcagatcattggttttctgggaggagacagggaagcaggaggatacaaggaaacttttgggggtgatggacacattatcttggttgtgatgctagttgtacaaatgtatgtagatgtgtgtgtcaaaactttatacatttaagatatatacagtttattgtatacccaaatcatgtatatgatgaatataatacttttatattcatatatacacatagatacattataagtatatgaacaatcatcacaagtagagatgagtatatgtatagatgggtaagaaaatgtgatagtggggtcgagtgtagtggctcacacctgtaatcccagcactttgggaagccaaggcgggaggattacttgagcccaggagttcaagaccagcttgggcaacatagtgagacctcgtctctacaaaaagtaaaaaaattagctgggcatggtggcatgcgcctgtagtggagctgctcgggaggccgagttggaaggatcgcttgagcctaggaggttgaggctgcagtgagccactgcaggctgcagagagtaccactacactccagcctagataacagagcaagaccctgtctcaaaaagaaatgtgatagtggctacatgaagacacaatcatgggtggttagaaaaggagaaagacaagatgtgactgtaaactacctaagggcagaacccctactgttcagataaaaaggttttcagtaaatatgtgttgtaaggagaataggaaaagaaaacaaagaggaaaatggtggatgttaattaagaaaatttgagaagggccaaaatataagtcagaaaaacaaagatgagaacaggaggaaactaagccttccattttcaccatttgcattcctttcttttttttttttttcttttcatttttgagacaggatcttactctcttgcccaggctggagcatggtggcacaatcacagctcactgcagcctcgacctcccaggttcaagggatcctctcacctcagccttccaagtagctaggactacaggcgcacaccaccgtacctggctaatttttgtatcttttgtagagatgggatctccttgtgttgcccaggctggtctcgaactcccaggctcaagcaattctcccacctcggcctcccaaaataccgggattacaggtgtgaaccactatgcctggcccacttgcctttcttatactaaaataaaaagatttttttggccgggcatctcaaaaaaaaaaaagattttttcactttctcaagtgcttgattgaaagagtttaatgtaagtagacataacattacaactaataagtgatgttttaaatcaaaataggggaatgggaggtagggaaattttactaagttcctcagtcagatcaagttttaagtttgtcacatgacctctgtggttttcataaatgtgcagcttgcttttcttagatttttttaagtgagataattcacctattataaatttttatttttatttatttattttgagacggagtttcgctcttgttgcccaggctggagtgcaatggtgcgatctaggctcaccacaacctccgtctccccagttcaaccgattctcctgcctcagcctcccgagtagctgagattacaggcatgtgccaccacaactggctaattttgtagttttagtagagacagggtttctccatgttggtcaggctggtctcgaactcccgacctcaggtgatccgcctggcttggctgggattacaggcgtgagccaccgcgcccggccatgtaaatttttaaatcaagatagaattcacataccataaaattcacccttttaaattatatggtggtttttagtatattcacagagttatacaatcatcatccctgtgtaattccaaaacgtttttatcaccctagaaagaaatcccacatctgttagcagttactagtcattctccgcttcccccagcccctggcaaccactgtattagtctgctagggctgccataacaaaataccacagactgggtggcttaaagaacaaaaatttggactttttcagacgtttctctttctctctctctccctctctttctctctcaaaaaaaaattattttttcatagttctagagtctagaaatccaagatcaaggtgtcatcagggttgacgtctggtgaggcctctcttcctagtgtgtaaacagccaccttctcactgtgtcctcacatggcctttcttctgtacgtgcacagtttgtgggggtggagctctggggtgtctccttctaaggacaccagccctatcagactaaggccccatccttatgacctctcataacctttattacctacttataggccctgtctccaaataaagtcacatcatgggttaggtcttcaacatgaatttgagaagggcctattgagttcataacaaccactagtctgctttctgttcttatggaactgcccactctggacatttcatataaatggaatcatacaatgtatggcattttgagtctgacttttttcatgtagcataatgttttggaagttcatccgtgttatatgtatcagtattcattacttttatgaccaaataatattctgttatatggatacaccacattttgttaatcctttcagcagttgatggatatttgggttgtttccacatatgggctgttacgaataatggtgctataaacatcctcatacagtttttttttaaattttaatcaggtcctctagaagaaaattcatacaggtttttgagtgcacatatgttttcatttctcttgggtacatacctaggaatagaattattgagtcatatggtaactctatctttaacattttgaggaattgtcaaactattttttatagcatctgcaacattttacattcctgtcagtaatgtgtgaaggttacattttctccacatcctcaccaatacttgttattgtctgtctttttgttatagcctttctagtgggtatgaagtgtatttcactgtgattatgatttgcatttgtctaatggctaatgatgttgaacagcttttctcgatgtccttcttagccatttatatatcttttgaagagaccttttctactttatcacacaaaaaagcctttatgaggtcagaaaacacaagattttatctttgtcttctatgaaatgctgctgttcacacagccagaatgagtcgtcttaagtcccatcacattcatttgagtatgtatgtccttggctgctgaaaatctgaccctttaatgaatagggcagcaaagttccctgaccatcagtgttctagaatgtcccattttttaatactgcatccatgcacacctcctatgttgtctttggagaaattattcagatccttaactcaatttttttaaacgggcagtctttttattgagtcataagagttctttacatattctggatacaagtctcttatcagaaatatgatttgcaaatattttctcccattctattgattctctttttactttcctcatggtgtcctttgaggaacgacagtttttaattttgggccaggtgcagtgactcacacctgtaatcccaacactttgggaggctgaggtgggaggatggcttgaaaccaggatctcaaggccatactaggcaacatagcaagtcctcatctctacaaaaaataaaaaattagctagccatggtggcgcatacctatagtcccagctgttcaagagacttacgtggaaggattgcttgagcccaggagtttaaggctgcagtgacctatgatcacaccactgcactccagcctgggtgacagagtgagaccctgcctcaaaaaaaaaagtttttaattgtgatgaagtccagtttatctgtttttttttttgttgttgttgttgttgcttgtccttttgatgttatatccaagaaatagcaaatattgcctaagccaaggtcaagaagttttatacctatattttcttctaagaattttatagtttggctattacatttaggtctttgatccatttgaattcatttttgtatctggcttgaggtattaggggtccaagttcatttttttttatgtgtggatatctagttgtcacaacaccatttgttgggtagcttcctttttgaaaatgatgaacactgtaccccaaacccacctaccttggttccatgtattccttataagtcaggctgctatgaaagaaagcatagttattgaattagcaagaaatcctagttttatattttgaaatcttagttcttttttcagagacagcgtctcgttctctgttgcccagcctggaatgcagtggcacaatcatagctcactgtaatcttgaactcctgggctcaagcaatcctcctgccttagcctccccaattagttgggactacaggcacatgccactgtacccagttattttttattatttttttagagatgggatctcgctatgttgcccaggctggtctcaaactcctggcctcaagcagttatcccatcttggcttcccaaagtgctaagattacaaacatgagccactgcacccagccagttttatttttttaatctcctgtttcacagatctaccaaagtgacttaaaatttttttatctagtttgagatgctaatttctgtactttatgcttcactctgtccaaatataagggaactttttaaaagttaatggaataatggaattaagtgatgaaaattaaaaatataaacttcatttctcaacgtaagctccatcaaggtcaagacacttttgtaagcaatgataccagccatttagttcttccctagagaactgagcgtcctgggaatttaaccatgtcagtgcagtcttttttgcattattaactgaaggaaaatgggtacccttaaagattttttaatattaggacacaaaaagaagtcagaaggaggcaaaacaggaccgtaaggtggatgcttaatgatttcccattgaaactctcacaaaattactcttgtttgatgagaagaatgaactggagcattgttgtgatagcaaaagacgttctggtaaagctttcttgagcagttttctgtaaagctttggctaactctctcaaaacactcataataagcagatgttatcattctttggccctccaaaaagtcaacaagcaaaatgccttgaacatccccaaaaactgttgccatgacctttactcttgactgacccacttttgctttgactgggccactgccgcctcttggtagccattgttttgaatgtgctttgtcttcaggattgtactcataaagccatgtttcatctcctattataattcttcaaagaaatgcttcaggatcttgatcccacttgtttaaaatttccattgaaagctctgcacttgtctgtagctgatctggctgtaaccagtttcagcacccattgagtgaaaggtttgcttaactttaatttttcagtcagaattgtgactgaagaactgtgactgtatgctgaaccagttgagatgtctgtggtgttggctgttgtttgtgctgttaatcatcagtcctctttaattagggcatgaacaagatgaattttttccttgcaaattgatgagatgtaaaaatgatgtgaatgtgggctttatcttcaactttgtctcttcccttcttaaaacaagctatccatttgtaaactgctgatttctttggggcattgtccccatgaactttttgtaaaacagcgatttctcctttcttctacccagatttcaccataaatttgatgtttgttcttgcttcagttttagccaaattcctattgctctaataggggcccttttcaaactgatgtcttatccttcttagtgcctgtaaaagttagtatgaatttatttttgtgtaaatttttgaaatctacatatagttttttattttccatgaactttttgaagacctcttatatgttactgttttcccaccctacatgacaaaacagcattatgttaatttttattggttaattttataacttttgtgttagttttccttttgtgtattttaaacagtttttgaaattaaaaatagctttattctcaaaaaccataaataaaaatgttctcttccaatgtaattgccaagtttaaataaatgtaagtgttctataacaaacccttgcaataattatttttagatttaaaactcttatcttcagtgattatgtattactatgttaataattgttgaattgtaaaaattatctccaccttccaaattttaaaaattgtaagtcagagtgcattgaaagcatgatgacattccttaattctgcactgaaggtttttaataaagaatgttatagcaattcacaataacatgtggaaagtatcagaatgtaaaaacaaaaaattatgaatatattattttgggcttgctacttcatattagttttggtaaaattaaaacccaattggttagtttctgctgatggaaatctcacttctatggagaaaatattacaaaatgtaaatctgttagagaaatttaagaatgaatctggccgggtgtggtggctcacgcctgtaatcccagcactttgggaggccaaggtgagtggatcgcttgagatcaggagttcgagaccagcctggccaacatggtaaaaccccatctctaccaaaaatacaaaaaaattagctgggtgtggtggcttatgcctgtaatcccagctactcgggaggctgaggcatgagaatcgcttgaacctgggaaacagaggttgcagtgagccaagattgtgccactgcactccaccctgagtgacagagcaagactgtctcaaaaaaaaaaaaaaggaattgatctaatgtaatacaatagtaaattaagttaaaatgtacttgaaaatatttggaaataattattatgtattgggatacgccatttgttatagcaaacatcctcaaaagtctcagcatctttttttttttttttttttttgagacaggatctctgtcacttgggctggagtgcagtggcatgatcatagctcactgcagcctcgatctcccaggctcaagagatcctcctatctcagcctcctgagtagctgggactacagacgtgagccactgcacccaaccagtctcagcatcttaatacaatgaagtctttatttttcgcacatgtctccatccaatgtgggtttgaatgtggatcccctctgccccacacagttatttagggacacaagctctttttatgaatggcgcttttatttactacccattctcttttctactctctaacttctcaatccagtcagcatgaaaagagtggagggttatacagttggggtttttttctggtgggggcagcgggggtaggctttgaagtgacttacctacctacatatcattagccagaactcactcctgtggcccacctaacagcaaagggggctggagaacgcagtcttgctatgtgtgcaggtggaaatggaaatagggtttggtgaacacctcgcacttctctgctgctctttgatagtggcattacaaagtcaaagctatgagatcacaggaaccttattggttttattcaccactgtaaccctgtagttgatgctatggtctacactgcacagatttccatatagtcttaggatctttccacctagtgtctcagcaggatagtctgacttcttacagacagttcaggactccaagagtgaatgttttaagaggtaagaagtggaaggtgctcatttcaaagcctaggctcagaaactgacacagtattacttgcactatattttattagagcagttgcagagggcttccaaattgaaggaaaggaaaataggccccatttctcaataaaaggcatatcaaaggatttgtggccgtctttgatctaccacgtcataatatttttaatgtttgtctttttttttttttttaagagacagatcttgctatgttgctcaggctagattcaaactcctgggctcaagctatcctcccgcctcagcctcgtgatgagctggaactacaggcacaagctaccatgcctgtcttgagttacttgttttgttgcctatagacagattagtcagctagagaaactttactaataagactaaagtacactcttgctttttatttattaactaatttataaggttatcaaaatgctttagcatcttatttcctaatggacttagagcagtaattttggatatatgtataaattaattgacatgatccttgggtgctagaattactctactcgagctatagtaactgaaaatggatgagggagaaataagaatagatagagcacatcctttcagaatctttgttctggctttcagatgaggttttcccatctgtttcactgtcctttctgcagtttccctgttagttcagtatagtgtatatatgtggtgattgaggggaggggtacagagattacagagccatcttgcactgtaagttatagctgcttaggtaagtactgatgaccaaaagaaatttttcgacagtgagttcaacaaataaagatggtgttaaccctatttacatgtctctaggtagactgaaggattttgagtcattaacagtgagcttcagatatttctttttgggtattcatttatatattttaatcagtttctattgcagtaagattccaatagaaggaaaacaatgcttcattttttgttgaaagcaaacatacattataagttgtataatacacaatgattaatgaagttttactgtgtgtgtgtgcatgtgtgtatgtttttaaaattacggatgaactatcatacaaataaaaacaatcagaatacaaaaaaattaactgtgtagtgtatgcttatacacatgcatatatgtatatataaatgggattgttctataacttgcttttttcacttaatatatacttctgcatcgttaataaaactgaaagaggaaatgattggatatagataggtccctatttccccttgcaatgtaaactctggacttactgggctatggagatcagtgctttctttactaaactctagactcaaatatacaactgtcaattcaacagttccacttggatgtccagtagacatctcagactaaaaatgtcccaaactgaactactgatcttcccaaaccagttctatttgtagttctctagctttagctgatagaaaaatctatccttctagctgtaactctgtcttttcagtttaagccaaaattcttagtcatctttgattcttcattgtcttatatcccatattcaatataacaggatatcccattaactctactttcaaaatatatccatatttcatatagtaaaagaacaacccctaatgataaatggaaacacatgcctgcctcccactccactgctgtatttggtcatctaggcccctcccatctccccttactctcctcaccccatctccttcttcccacacctccttcttcccacacctcctttttcatcccattttaggcagcagcattctatcacttttactttcaattatgagaattcagtaaggagcacaatgtacagagcactttcttttttttttttgagatggagtctcgctctgtcacccaggctggagtgcagtggcgcgatctgggctcactgcaagctccgcctcccgggttcatgccattctcctgcctcagcctcccgagtagctgggactacaggcacctgccaccacgcccagctaattttttgtattttttagtagagacggggtttcactgtgttagccaggatggtctcgatctcctgacctcgtgatccacccgcctcggcctcccaaagtgctgggattacaggtgtgagccgccgcgcccggcccagagcactttcctacacatttatcttatttaaaatttaaaacagtccttttgcagttttccagttactattgctgatgataatttgcccccaaacttagcagcttagagcagctgtgttatacccattgattctgtgggtcaggaaatcagatagggcacagtggagatggcttccctctgctccatgatgtgtctagggcctcatcaaggaagacaaagtttgagagtgacccaacagctgggcactggaatcaactgaaggcttattcactgcgtgtctgtgtaacagcccatccctgggcttggataacatagactacacatggcctttccattagtttggcttcctcatagcctaacaacctcagcatagtcagatttcttacaggagtcaggcacagggctccaagtgcatgcgttcctgcaaaccaggagggagctacattccattttatgacccagccttgcagttctcatggcatcacttctattgatcaaaaaccatcacaagccctcccctatttaaggggaagggagatagacttcactacttgatgaagatgacaaagtcacattgcagaagaatgtgggatttggaaaataccatctgtcgcaggggttatcattgtcctttgttttgagtcatggagacttggagagaagtgattatcccagagtggtaggatgaacaagggtcatcttgggaaatgattcctagagttgttattacagtaactactatctagttagttttatttgtgtgtttagagatagggtcgcactctgtcacccaggctggagtgcagtggtgtaatcatagctctctacagcctcaaattcctgggctcaagtgatcttcctgcctcagcctcctgagtagctgggactataggaacataccaccacacccaactctatctagttcatttttaaggcatttatttcaaacctttacaaaacctatgaggttttggttttatgcagtttctgcagtgttcacaaatgattctaatccacttattaggaaatgtagcatagtctgtacctgccaaatatttagatcaactgaagagacactgaggggtctctgtacataagacactggaggaggccatagatcaggttagagtgactgcagttacctttttattgcctccttagttggcacagcagtatccacaaaggccagaggtagtagtgttccagccactggtctcccctggagagcagatgtgattgtgggtcctttcaccaaaggctagtcatctggaaagttattacaacattcatttacatgcaagcatccaaattgaaagttgaggttacctcatcctaacaaaattgctcatgcttctgggcttgcgagcttttgctgatttggtcaatggtctagtgaccatttaaagagtatcaggccgggcgcggtggctcacgcctgtaatcccaccactttgggaggctgaggcaggtggatcacctgaggtcaggagtttgagaccagcctggccaacatggtgaaaccccatctctgctaaaaatacaaaaattagcctggcatggtggcatgcacctgtaatcccagctacttgggaggctgaggcaggagaatcatttcaacctggtaggcagaggttacagtaagctgtgatcatgccactgcactctagcctgggcaacagagtgagacttggtctcaaaaaaaaaaaaaaagtgtgtctatccatagtacatagccaagaaagaaaatcacccatccagggaggataatcctgggatttcctccagctttagccatgttatatatactcgaagatattgaagctgcatttaaaaaatcccaaacatattttttttcactaattctcacagcccttccccctctatcattataagtacaataatttctccttgtgagtttatattaacttcatcttttacccatgtattttcttgtagttggtgttactgttttagtatataatttattgtcatggtcttggtccttagatgcagacctttagttcaagatacacgaggaaagatgagtgagatgacattgctgtcattatcattattgtaaattttgcatcgaagtataatatccacacagaaaagtacacaaagctgtacagctgaatgaattttcacaaattaaatgcactcatttatctgccacccagatggggaaataaaacatggctgggcacggtggctcatgcctgtaataccagcactttgcaaggccaagatgggagtatcacttgagcccaggagttcaagactagcctgggcaacacagtgagaccccatctctacaaaagattttaaaactagccatcgtggtggtgtgtacctgtagtttcagctacttaggaggctgaggtggcaggatcacttgagcccaggaggttgaggctgcaggagctttggtcatgccactgagaactacctaaaaaaaaaaaagaaaatattaccaacacccaagaacccctccttcttctccctgccagtaactgacctccctcacccaaggtatcagttttgccagtttttgagcttcctatgaatagactcctacagtgtagtcatttgagactgaattgttttgctcatcagtaggattttgccatccatccatcctgttgcatgtagtaattcattaattttcacttctgtgtcatgcattgtgtgaatatgccacattttttattctgctcttgatatatatttgggttgtttccagtttttacctaccataaaaatgctgatatgagcctttttatttatcatttggcatgcatctgtgtacacttttgctaagtatatacctagtgtgggtttgctaggtcatgggtatgtgtacgttcagctataatatctgctgccaaagtggttgttcaaattcacactcccaccagcagcataagagataatctatttgctccatttccttaccaacatttagtattttcaatttttggacagtctttttaagtttaattattctggtagataatagtgattgtaatttcagtttgcatttccgtgataactaatgaggttgagaaccttttaaaagtttatttgccatctggatagccttacttgtgaagtatctctttaagtttttttgcccagcttttaattgggttgtctttttctaattaatttgtaagagtttattatatattgtagatgtaagtcctttgttgtctatgtgcaattgcaaatatcttctcctgtcccatggattgcctttttattctcttaattgtctcttttgataaccagaagttctagtttcatttttcagtctcttcctttatggttaatggcttttgtgtcttatttaaaatatctttgcctgccccaaggtcataaatatattctcctctgttttcttccagaagcttaatgagcatattggtatagaaaaacatttatagcctaccttgttccatgtagaatttgaggcgattgagatgaatagttagcaaaacggtcttccttttagaagaagataactcttgacaaaaaattgggtattctcccttctaggccatgcactaaagaaacatgacatatttaatctcatagtctctaaagaattcatatgtctgtcctaccctttttagttgggtatgtttcagttggaagcaggcctctaacagcaattcccaaaattttagtttcaattagtatttgaggtttctgcatttttcctcaaatatttgttccctttggctttaaaaactccatatagtagaaaaattaaaatgtgcaaatgtgtgtcgttgttattagctttattcaggttcattatttggaatcaggcttttggaagaatgcttattaggaggcagtattctctacatttatagggtggactatgcctgtatatattttatgtttattcattggaatatgtttgtgtttgtaaatccttccatatatgtgatgactctagagtaaagaaactggctctagaagccttccggagaaatgattttcattattttatgatgacatacgtgtgtttatttctttttttagatggaccaccttgttctttaaaattgccacagaataataatccagatttttctcttggttaaattttctgaggcctcatacagtatttaaaccaccaataataacttgttggcatgaaaaaaatttatttttttctctggtttccttgccttgagcccttggatgtcaggaagggtgaggggaaatatcagtctgcttgggcttagatttatggttgctattgtttatggttgggaaatggattgagtgtgcatagctccatggcctcttggctttaactcatttgcataaatagtgaaaataataaggaatataaaaacaataacaatgacgttattgagcatctatttttactgtacactaagccaaacactttctgtttttttctatataattgttataatagtcctacaaatttggcattttttcccttcaacttttaagttcaggggtacatgtgcaggatgtataggtttgttacataaataaacgtgtgccatggtcgtttgctgcacaaatcatcccatcaccaagctgttaagcctagcatgcattagctattcttcctgatgctctccctcccctcactgacaggcagcagtgtgtgttgttccccctaccatgtgttcatgtgttttcatcattcagctcccacttataagtgagaacatgcaggttttggttttctgttcctgcgttagtttgctgaggataatggcttccaactccatccatgtccctgcaaaggacatgatctcatttttttttggctgcctagtattccatggtgaatatgtaccacattttctttatccagtctatcattgatgggcatttaggttaattccatgtctttgctagatattatttttatcatatttaatgattgttatccttacattttagctaagaaaactgaaccttatataaagtaagtggccaggcacagtggctcacgcctgtaatcccagcgctttgggaggccaaggtgggcggatcatgaggtcaggagttcgagaccagcctggccaacatggtgaaaccccttctctactaaaaatacaaaaaattagctgggcgtggtggcacttgcctgtaatcccagctactgggaggctgaggcaggagaatcacttgaacccgggaggcggaggttgcagtgagccgagaccatgccactgcactctaccctgggcaacagagcaagactccatctcaaaataaatgaataaacaaacaaacaaataaagtaatagcctgagatcaccatgtaagtgagtgacagaaaaaaacaagcctctgtgagactaaagcttgttttctttaccaccatccagtattgtctccgtgacagaaaattattaatttggctgaaatatatctttggtatgggatctggctgtgcctttgtgcagatatcgccccctcccaggttggtttcctcttctaaataaacttggtggccattgtaccaagaacacactaatgtgacgacattttattagaatgaatgggccagtcgtggtggctcacgccagtaatcccaacactttaggaggccaagttagaaggattgcttaaggccaggaattcaagaccagcctggacaacatagtgagaccccatctcttacccaaaaaaaaatttttcaaacgttagccaggcatggtggcatgtgcctgtagtctcagctacttgagaagctgaggcaggaggatcactggagcccaggagttcaaggctatggtaagctatgaccttgccactgcattccagcctgggtggttgagcaagagcttgtctctaaaaatttttttaaaaattagaatgttgggaaccaggatccatgagggtgaataaagaatattgtaagcagtcagtgagttaacagcacatgacaaaactaaatttgtaaaaccatttgctttctagaaaggaatctgccatacctcccagagggcatttagccatccattcagtgcctgaaatctgtcatttgttgattgttatcattgtctttctgttgcttttctaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggtaagttcttttctcacaagtaagttgtgacttaattcatgttttttttttaagttatcagaaccctttagcttgtttttatttttgttgcctcctttcttttctggccttttcatttatttttctcattgattttatcttatttcagtgagatatttcttcaaatgcatacatagaaataaagcaataatatttaaatatgaccttttctttcctcattcatagttaatggcacagatcaaggatagcatataggtctcatgaagttgtttcccaattcaggaagtttgagaatggccatagctgattggccatagctgattggacttctggttgagaattctgaggcaggttcctggcctgaaaagcagtgtgatcagtgagcagggccagaggtagaggcccctctggcaggggcttggagagaatctccaacttcagtattgagcagcaccactgcaactgacagattgctgtgacagtaccccttaatgcaggacttgctacctggaagaaaagttgcaggcctagagcaaaacattcacaaagcagttcttagctacttccacggagttctagagttgtcatacaatattcaaaagataaaatgaaacaaaaacaagcaaataaatttatgtttacatatggaagtaaacataattaataattttaaagtaaatgtgtgccatacaataccataccaacaatactgagaaatgctaggctgaaagataactcattttatacttacacacagttcttgttcatctgttttcagtctaagcagtgttcacgtccaagttttcctgtagatctgtgggtagtttttaagactccgtataagatatggtgaaggatacatttgatctcatttttgtttgaatcacattttatttcatttttgtttgaatcacatttgttcattgttagtataaggatcagtggtttttcttttcttcccgccctccctttttcctttctttcttttgaggctagtatctgaatgcacatgaataaaaaactgaaattatattaaagcagtttggcatgggaatgatagttactctgccagtaaccaatccttattccttgatttttaaagctttttgttttatgtcttttcttgctctgccccctaagaggagaggggagtggtaaatttagggtggcaaccacaaagagaagggaatgaaagactgacagagaagtaaaatcagaatatgaggacataatcaaatggattcatggctcaatgtgcgcttgtgttcataatgcatataatatccatagctatcacaatcattgcaaggctgcctttggcatgaaactaccttattatgaggttcctttggtattttgtaattaattctccttgggtgagttttttaaataaactttttattttggaatagtttgatttacagaaaagttgcagttagtacagggagttctcatatacacctcacagtttcagttcccctaatgttaacatcttactttaccatggtacatatgtcaaaactacaaaaccaatactggtacattactgttaacttcagactttattgggatttcaaggtttttttttccacttacaacctttttctgttccaggatcccatcaagtataccacattgcatttaggcttgtaagaattttaaaagaggattgcagtatctcaagcttttctttagggtgaatgatattgcagtgaggtgtctaagagcttaaagtaaactttttaaaaacaatattaagcgtattatgaattaagaactttttaagttgagtgctgactacatattaagcaccatactaagcaatgtaccaatattacttcatctcagcttcacaacaaatcagtgggtttcttattattatactaatttcatagataagaacactaagccctaaagaggataaataacgtgtcaaagtttacatagctaatatgaggtaaggttggaattttaatccaagttttcttgtaaccagacactatattcctttactccaaaaaaaaaatgtgtaacttgtcttggctggaaaaatgaaacataaggcctgggcagtttttggtttcataagtagccacaccttaaaatggtagtttatgtggaattctaaagtttcttaggacatcttatattacaaatgaagtggaatacttgggtacatttgttttggatcatcttgaggattattccggagtttacaagttgttagaataaatacataagtgctgtcacaaaatttgattaataagtgtggaaggctaagataaagttatagctgagaaaaggaatcaggaagcaaagaaggtaattccagaattgaagttagacctttgtgaatattaacaggtttatatgttgttatagtttgccattgaaaaatattattagattttttaaaagtcatatttgaaaaacaaaatattttatatgtgtaatcacctacacatgggacctagaattttcttttatgggcttcatacatttttatatgaaaatttccttgtataatcattagatatgctcattgaagctaacttgctaagaatgaattattatatccaaatagttatgtgattttaattactatgctacaaattatcgtgtccagaattataaagcttggtgaaagtcctcctacagtgagaataagagaaaatatagagatttaagaggagactggcaaggatttggacaagaaatcgaaagggtcagtaatatatcttctaaggaacatggtgaaatatacatctcctttcatgtgtcaaacactaatatatgattataggtaaatgttagagtagcactagcaaaagattttttgaaatctggttgttttagagcaggaaagagatgtttttatcctttagaatcctacccactcctgcactgggctcacagtaggtgttttgggaatgacagctgactgatgggttgattgattgtttgtatttctgtgcaggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggttagtgagagtggagaccgtcatctccctacggtcagcctttctgaagctcagtgatgatctccagcacgcatatctgggtagcagcttgcatttaagggtgaaaataaagatttggcctggttgttcttcagtatttcctctagaaacaatgcttcttatgacccccaagatgacttgctgactaactttaccccatggggctaaacccaggtctttattgtgtcactttatgcccagaccattgggattgccttgttcagcttgcccctaggcccctgccccagggggatctcattgctgcctgtctgaggtctctcctcttccttcaaatctccatggcctcatgaggttacacccatggtcagtaaccttggtgagtttacacttcctacaaatagaagtccagactccttatcctggcacttgtaaccctcccccatcccctaaacatgccactcctaagaatgtccaccccacttttaaagatcacagaattttaggactgcaaaagactgtctaactcctcaattttacacaaataccgggagaggtgaagtgactttacccaagctggttatttgtcattctttctactatactgcctttttaattaataatgatgattatgatatcaaccctcctttcagctctttccattttttcccccacaagcactgtgttccaacaaaataaggttactcaaggtgcagtgatgaatattcctgacactgtcctatctcccatgtttcagccacactccaatttgtaaatgcctcctcctatgtcccagctatcaaaaatctatatatttttcaaggtctagttcaaatcctttcttgaactcccttaccctaagtgatttttcattcttctgaacctgttgtatatttcattcattttgttaatttgtctagcaaataggtacagtactccgtgggccaggattgtgatgcatgctgaggacacagtcagtgatgaagaggcagacatggtctgtgcccccagggagatcatagtctggtgaaagaaatataaggaaactgccaatttagcatcatatgccaagtgtttttatagatataagtccaagctgctgtggaaatgcatctgtgagaaacgagggtcagggacaacttccaggaggtagcacccaagctaaatcttaatgtccaaaaggagatgtcaagtaaaccagcaatgtgtgttcaggcagagaggagaaatgttcagacagggtagtgaaagcaggcaaaatatgtcagaggcaactgaagccttcagaaactgtaaagtggcagagtagagtagggaaggcatggaaagtgagggtagagagggatacaagagacgtgtgtaaaggaccgtctgacaaactaaggaacttcagttctgtcctgtcaaccctggaggatatgatatgtattttagaaagatcattctggctacaaaatgactaaagtaattagaatagataacatagcagatagaaaccagggcttaagattattttaattccctgggcctcttaacctaaccaccctgtatgtaaaaggtactcagaattattctgtgaccaattgggtctttttcttcatttacctttaacaaagtgaattttgaaaatttgtcttcactttaccaattattggcatttatatcagactttaagtgagagcagaaaatctttaccatttaactatgaacttaagtattatatctcacaatacaagcccagagtcctttctctgcaattccaaaattataaagttctgaaaaacgcatgtttttgctgaagtttcacaccagaactgatttgaggacaataccacaacccacccagtatgaggccatttgtagtccttatccattttgtttaaatactcatatattttgttagagaactattaatgtgtttggttatatggtattgcccctggtcccactgggggcttaggtcatatactatatatatatatatactttcctaagatctgagcaattctgaatttcctaatttttcttaccctagaggtttcagataaatgattgtggatctgtagtaggcttaaaaggaatagcataaaggtcatctgtatatatttcctatgtttgtcctttacagttgggacaaaatagtaagtattctcaggttctttaacaaactcaaatgtagcataattatctccaatgctatttattagtcttaaaaacgattccggtaatgaatataaatgatacccctttctcacatagaaagagatgagatggcaataactgaccagaccttgcagtatgtaaactggtatgtattaaagctgggacattggtaccctataaagtttcacataagagattcttccaaagtgagtatatttacttggattctaaagagatacttggcttagagctccctctgttggctgaaaagtgacttaaaataccttggaagatttggtttactccctaacagaatggggacatgttgacatctgaatttattaaacatgatttttcttctttagtgacaccatattacatttcagtgtttgttcctcagtgacaaaaaatacacttatgtgtactttagaagagatgtgtacataagtagcctttagattttaacaatgaatttaacattttttctttaaaaaatgtgaaagttgggccgggcatggtggctcacgcctgtaatcccagcactttgggaggccgaggcgggtggatcacgaggtcaggagttcaataccagcctggccaatatggtgaaaccccgtctctattaaaaatacaaaaatgagctgggtgtggtggcatgcacctgtagtcccagctgctcgggaggctgaggcagaagaattgcttgaacccaggaggtggacattgcagtgagccaagattgcgccactgcactccagcctgggcgacagagtgagactccatctcaaaaaaaaaaaaatgtgaaagttagggccattctaaatccttttacatgtatctatgatcttatgactgtgagtaagtccacaaaagggctcagtaaatgatgttctgccctatagactggccaggagctaaaggatattccaagagccagtcactgacctgacctctcttctgccagtctgaaagagactctattttagggaggaagcttgctttcatttcctagcaaacattctgggcctcagacaaagagctttaaaggttagaaaccttataaaatgatgccttgctcttgtgagaggagcctacctagagtccagcttcagttcttgagctaaatacatttgttttatccaaccacctactcaagctcagcatagggggcattccaggtaaattgatgataacagctctacctctagtgactttaaaatctcattgagttctgtaggccagggttaattaaaagaaaaaaaaatactaaaaatgtcactgaggagaagaaacacaacagcaaatgtagagaaaaagaatacatgatgctggccgggtgctgtgactcacacctgtaattccagcactttgggagaccaaagtgtggatcacttgagcccaggattttgagagtagcctgggcagtattgcaaaacctcgtctctacaaaaattagctgggcagagtggcacatgcctgtgctcctaggtactcgggaggctaaggtaggacgattgcttgagcccaggaggttgaggctacagtgagccaagatcatgccacagcattccagcctgggtgacagagcaagaccctgtctcaaaaaaaataataataaaattaaagaacacatgatgctgactatgtacttggtgagggaaattgcatggagtggaggatgggagtcaggcagtgggacaaacgcaaggggctacagtgacctgagcaggatttttggaggggcctggagtttgaaccgggtctggaagggtgagaaaggtccaactatgcaaacaacagttgaccatgtagagcagggaagctgcttagacacatggatgtgaaaataagaatgaccagttatggagaaaaccaggaggcctgcctgtccaagtcagaagccctgtgtttgggtatagtggggcatgagatcagatagtgaagtacaaggaacaacaggctttagataaggaaccggcaaactttttctttaaggatccgctgtaaatatttcagtctttatagccacatacagtctctgttacatgttcttcttcttctctttacaaccctttaaaaatgtgaaaaccattcttagcttgttggctttataaaacagaccttggaaaatagccaacccctagtttggatagtggggagcaggtaagagcagaaggaatatctaaagggcttgccactgtacaatggtatgaattcttttagtgaggagaatctggcagtcaagtagaagaagggttgaaggcgtgcagggggaaaaagaaaatgtagaaattaatcaatccaggcatggcataatgagaacttggatagagcaagtggtgaggacggagaggaacgtcagagtcttggggccactgtagggagaatagcaagtaccaggtcagcagatgaaagaaagtgagtaatacaagtctaggaatttggatctggaagataggaagtatggtggtgacacggaaagaaggagcttggaaaaggaccaggttgtggggggaccgatattatggtaactgttataacttgaatctgagttgagggtgaatctcctgaggcagacagaaattttgaagctgccatattgaatcagttagtctctaatagagtagagcagtaaggaggaaatgatgggcaaaattggggatagcaaaaagggagtctagaatgtttcccaaactaatctccagtttctcacagtaattatttgtccaacttcattccataaaggatttgaagcaccttccagaactcattatgaattattgtgattagtgtaatattctattcaagattcattcacaagtccctgtttcttcaacccaagcaagcaattgctacgatttactgagtactttttatgcaccaggcgttaataggctttttataaacgtcagttcatttgctcctcagaagtttcattctctttattttctaaaacttttttcttgatcacaacagtgtatgacttttaggaaatgttcaataagtgtttgactaattataatacatagtcattgaagaagctttagaaaacagaccaaaaaatgctgtaatcacaacactcagataacagttgggttaacggttggctgtatctcctcgtcttgttctatcatccttaaagtcagttctcatggacagacatgctgatcttaggagagatgctggaagttgcttttttgagtatttttaaatcactcgatactggatataagcttgttcggctttatttgcctttctcccaaaagcagaggatactctgtgactgtgtatcagaacagataccaaccctggtgagaaggtgctgaccattctcccctctcctcctcatacctccaggcctgctatggcatcctcaaggtcccagaaggcagctggctgtgtcgctcctgtgtcctgggcatttatccgcaatgtgtgttatgtccaaagaaaggtggagccctgaagaccaccaagacagggactaaatgggctcatgtcagctgtgccctgtggatcccagaggtaagaattcatccaggcccgtgagaccatttgctccagggtgtccctgttccccacagcattcagactgactcaggctcagtatggaaatgcttcatgcttgcccatgtttctgaagtaatagtacttccacttgagctacctcagatccttattggatgcacacttgcatgtaagcccatggtgattaatatataggtggtattcccagtggtatttgggataatacccgaatatatacacgatatttgggataatacccaaatatatacatgatatttgggtatatcatgtataaattgataaatttgtatgagaggagagacacaaaagaccagggtgtgagcagcagaattttttaaggtaaaacttatatttagatgccaaattttaagtgtagagttttgtgatattttacacgtttgtatctgtaaccacaactcagaccaagacatgaaataccctaaaaatagacataaagcaccccagaaagatcctctatacccactttccagtctctatcccccaagaataaccaccatttttgtcttgatcatgatagattaattttatctggttttaaacttcatacagtatgtatttttttcggtctggctaacactccatgttgtggtgtatatcaatagtttattcctttctattgctaatattccattgtatggatatactctgatttattcattttcctttgatgggcatttgggttgtttacaggtttaggctattacaaataaagtgagcagtaactctttgtctactgtgatgatgccctttacttttttatttttatttattttattttatttttgagacagagtctcgctctgtcacccaggctggagtgcagtggcgctatctcggctcactgcaaacttcacctctcaggttcacgccattcttctgcctcagcctcccgagtagctgggactacaggtgcccgccaccatgcctggctaattttttttttttttttttggtatttttagtagagacggggtttcaccgtgttagccagcatggtctcgatctcctgacctcacgtgatccacctgtctaggcctcccaaagtgctgggattacaggcgtgagccactgcgcccggccgatgccctttactttttgaagctctttttagggcttacactcaacacctgccaaagaccttctttactcaaaattcaattttttatcattatctagcctggtccttcagttgctggtatttcctgagtggctacatgtacactaacttaattaaaatggggcttgaagacatttcttcttatggctgcctttttttttctttagctgtgtggatatcccactcatgccctctctccccagccactatccaaaccagcaaatttgttaggcagtttaactgcatgacaagagagactgcagaatctagttaatggggagctgacattatatcagtaactcattctcctttaagattttcttgtttttaatcttgttaatattggttccaggggagttattgtctaataaagaagctcagagttacactaaaagtcccatatatatacttttgtattcctatggctatagacatcagtattttaaaaaaatatttgaatagtagtttctttttctcactaagaacatctagacataaaataaactcaggtttctggcttgagaatgactgttttccaacagcaaatccctcagctaatagagtaggctctctcagcttataaaagtccagaacatgactcaggaagagctctttaaaaacaaaatagactttctcagttattgacattctcttatgatttctagttcttggtttccagtgccttctggactactcaagatctgttagtttcctgatgtgggcagaaccagtactagtttggcatccttatttgacagttcttcaccttttaaagctgtatctctcttagaaactcatgtatatatttggcggggtggggggaatgaaaatactttttaccagcagttgcttgaccccttattttcacatggaaaagaatatttccatctttttaaaaaacatccctttctgctgggtgtggtgactcacgcctataatcccagcactttgggaggtcgaggcaggcagatcacttgagtccaggagtttgagaccagcctgggcaacatggcaaaaccccatctctactacaaatacaaaaaattagccaggtgtggtggtgcatgcctgtagtcccagatattcagggggctgaggcggcaggatcacttgagcctgggaggtcgaggctgcagtgagccctgatcctgccactgcactctagcctgggtgacagagtgagaccctgattcaaaaaggaaaacagaaaaagcatcccttttttgatggggttgtttgtttttttcttgtaaatttggttgagttcattgtagattctggatattagccctttgtcagatgagtaggttgtgaaaattttctcccattttgtaggttgcctgttcactcatgaacagacacttctcaaaagaagacatttatgcagccaaaaaacacatgaaaaaatgctcatcatcactggccatcagagaaatgcaaatcaaaaccacgatgagataccatctcacaccagttagaatggcaatcattaaaaaagtcaggaaacaacaggtgctggagaggatgtggagaaataggaacacttttacactgttggtgggactgtaaactagttcaaccattgtggaagtcagtgtggcgattcctcagggatctagaagtagaaataccatttgacccagccatcccattactgggtatatacccaaaggactataaatcttgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtagggggaggggggagggatagcattgggagatatacctaatgctagatgacgagttggtgggtgcagcgcaccagcatggcacatgtatacatctgtaactaacctgcacaatgtgcacatgtaccctaaaacttaaagtataataaaaaaaaaaaggaaaaaaaaaaagcatccctttcttttcagcactctcccaaagacttaatttcactttgaagctactttggctgagggagtagggtaagctcatgatagttatgtggttttaaagacttttgttttaaaatgtcatcctcctcctttctacttacattctgcagtctcttcattacacggatgtgctgtttttcaacaatatcatggttcctttgtaaatcaaatggaaagacttgtcactccctctgttttttatccttagttgattaaatgaaacaacaaggcatgtagcaccatctcttaacataatagatactcgatttagttactttcagtagctttctttggttcctaagtaaaagtgtccattacggtaaccttggctgggcgcagtggctcatgcctgtaatcccagtactttgggaggccaaggcaggaggatcacttgaggccaggagttcaagaccagcctgaggtaacatagcaagacctggtctctacaaaaaaaataataataatttttaattttgtgggtacatattaggtgtatatatttacgggatgcatgagattttgatacaggcatgtaatgcctaataatgacatcatgaaacatggggtattcatccccttcaagcatttatcctttttgtgttacaaacaatccagttatgttcttgtagttatttttatatgtacagttaagttattttgactatagtcaccctgttgtgccatcaaatagtaggtcttattcattctttctgactatcctttttgtacccattaattatcgtcaccctcctcctgccctgttccccccactacccttcccaccctctggtaaccatcctcctacagtctatctccttgagttcagttgtttttatttttagatcccacaaataaatgagaacatgcaatgtgtgtctttctgtgcctggcttatttcacttgacgtaatgacctccagttctgtccacgttgttggaaatgacaggatttcgttcttttatatggttgaatagtactccattgtatatatgtaccacattttctttatccattcgtctgttgatggacacttagcttatttccaaatcttgactatcgtgaacattgctgcaaaaaatatgggagtgcagatacctctttgatataccgttttcctttcttttgggtatatacccaacagtgggattgctggataatatggtagctctattttttgtgttttttttagaatcctccaaactattctccatagtggttgtactaatttacattcccaccaacagtgtataaacatttccttttctccacagtgtttgagggttcccttttctccactcctcaccagcatttgttattgcctgtcatttagataaaagccaaaaatatttttttttaattagccaggtgtggtagaggctgtggtgggaggatcacttgaacccagcagttcaaggctgtagtaagccatgattgcaccactgaactctagcctgagtgacagagggagaccttgtctctaaaaaaaaaaaaaaaaaagaagaaagaaagaaagaaaagtaaaaggtaatcatgcctagtctatactcctgctctctcatcccatatgtgaattatttacattactggaaatgagtgaaggactgagcagtggaaataagttttgtttattcttgattccatattaaccttaagagatgtgacttacctcattgttttgatgttcttagctttatgtaacatcgtttatggtttgtgaaaggtacttctgggatgccttggtacttctgccttatggtggtattttatttgtaggtcagcattgcttgtcctgagaggatggaaccgatcacgaagatctcccacatcccacccagtcggtgggccttagtctgcaacttgtgcaagttgaagacgggggcttgtattcaggtaagtccccatgagaagtggtagagtgggctaacaccaaattagctggactcaccctcccagtgagagtgtcctgtcgactgaaaggtcactcaggagatcgcccacccactcttagggctctgccattgtacggaccatttctggaaatcccttttttggatattgcctctggaccattcagcttattcttttcaatattcgtagtgatagtttatcttcatcctttgctgtcagagctgatgaattaagtgagttctaaagctagttgataccatcctgggtggaaatcggctataattctgaaacaaccaggcccatgttcttttttttttttttaatttcaacttttattttcaattttggggttacatgtgcacatttgttacatgggtatattgtgtaatgctgaggtttgaaatacatttggttgtatcacccatatagtgagcatagtaagtacccaataggtagttttttaacccttgtactctccctcctccctctagtaatccccactgtctatttttcctgtctttatgtctgtgtatacccactgtttagctcccgtttgtaagtgagaacatgtggtatttggttttctgtttctgaattaatttgcttagaataatggcctccagctgcacccatgttgctgcaaaggacatgatttctttttttgttttttctgtctttccaacttttattttctgttcaagggtacatgtccaggtttgttacatgggtaaattgtgtgttgcagaggtttggtgtacagataattttctcacccaggtaatcagcataatacccaacaggtagtttttcaatcctaaccctcaagtaggccccaatgtctgttgttcccttctttgtgtccatgcctactcaatgtttagctccacttataagtgagaacatgcagtatatggttttctgcaattaggggagacgtggatgggattgggaagggccagttacctccagcaaaggcacaaaggttgctttctctttccatgttatttctccttctatcccaaatgtaataagatggctcttctggctagagggatggaagggctgacctttcacctctcagacctcctacatgtgaactgcaagctggttggagttatatttgcctgccgaccttctttggtgaagaggggacattgcacagtgcaggggtccgcaacctgccacagacaggtactggtccatggcctgttaggaaccgggccgcacagcaggagataagtggtgagcaagtgagcattaccacttgaactccgcctcctgtcagatcagcagtggcattagattctcataggagtgtgaaccgtgttgtgaactgcgcatgcgagggatctaggttgagcactccttatgagaatgtaatgcctgatgatctgtcaccgtctcccatcacccccagatgggatcgtctagttgcaggaaaacaagctcagggctcccactgattctacattatggtgagttgtatagttatttcattatatattacaatgtaataataatagaaataaagtgtacaataaatgtaatgtgcttgaatcatcccaaaaccatctccctccagtccatggaaaaattatctttcacaaaactggtccctggtgccaaaaaggctggggaccactggctttagggataatgactctaggtgctttgtgacatttcttgctgtctggcatgataatattttccaggcttatcgtgtagatttcttgctctagacctgggattagctattcttccaaggaacccagggtcttttactgggaagttgtaattgaagaacacaatctggacccccaaaggcccttttaattttttgaattcattcttatatttgacagaattggctacttcttcttttttttaacctttcttggatgattttatttattttaactatggcactttaaaaatcataaaggaaaaatatttaaaggaaaactctttccatggagactactaccctaggacattgcctgtgtgtttatctaagctctctcctggttgctgcccatgtgtgagtcccttgagggccaagattgtgcatcatttttctgtgaatttccctggcacaaagtagagagcctgcccattgttagtacttaattatggtttatcaaataaatacattcatgttttattgtaccatggattcatttgtgatatgcatttccccctctaaaaataatatatttttcatttttcagttattggtcattttatagtagcacattggatttatatccagtaacttattttctttattgtggtcactgtagtttcccccatttttgcttttgttgtgggacagggtctcactctgtcacctaggctggagtgcagtgacacaatcatagctcactgcagccttgaactcccgggctcaaatgatcctcccgagtagctgataccacaggtacacgccactacacctggctcatttaaaaaattttttttttgtagagacaggatttcgctgtgttgtccaggctggtctcgaactcctggcctcaagtgagcctcctgccttggccttccaatccaaagtgctgggattacaggcatgagcactgtgctcttttttttttttggtccgagtctctccttgttgcccaggcttgagtgcaatggcgcaatctcagctcactgcaacctctgcctcctgggttcaagtgattcccctgcctcagcctcccaagtagctgggattacaggcacacaccaccacacccagctaattttttgtatctttagtagagatgagatttcaccatgttggccaggctggtctcgaacctcaggtgatccactcgccttggcctcccaaagtgctgggattacaggcatgagccaccacacctggcctttttttttcttttctttctttttttcttttttttttaaagagagacagagccttgctttgtcacttaggctggagtgcagtggtgagatcatagctcactataaccttgaacttctgagctcaagcaatccttccacctcagtctcccaagtagctaggtctgtaggcacatgccaccatggctggctaatttttttgttttgtagagatagggtcttgctgtgttgcccaggcttatttttttctacaataattagtaattggcaataagactttggtgagagaaaatattggccttgaccttaacagacctggatttgtattacagccctgatgtaccacattctgccactattatggttatttatctatgagttttatctgccctagtagactgtaaacttagactttcatccttagatcccctatacccgaatctagtagacagacaattaatagattgatggatggatgatggatgaacagtttgagagatgaaacattctggtgtaagtttctcatttgcagagcaatgattcttactttcattacttgagttcagcttctttattttataaaggtcttaccaaattgagactcttacaattttgattataaggaatttcattacagagactcctctgcatgaggaaaggggaggaaacgtagaaaggactttgtcatacagcttgggtgccagctcagccacagtagaagaaagcatcagataagattcctaaggttcttgactccaggccttgggtcccagatagtatctctggacccacccaaggccaggaggaattcgccaccctgaaaggaaggacacaagccttgctggatttgccacctactgattgtagagcccttgggatgtgaacgaacataggtagtagccaggcagtgatcactgcaggccttgggcgagacccaatgctgtgctggctttagatctgactgggtgcagtcccagtggtggtggccataggggtgcttgtattagccctcctccatctccaggcaactcagcacagagagagacttcatttgtttagagggaagtaagggagaagaacaagaatctctgcctgttaatccagggagttcttccagatattacccagtaacaccaacgtagtatatctacaagtctgcaagagccatggcattactaggcttgcagtgcctcctaaagcagatatggccgtagtgaccaaagacttagatcacaacacccaagtccctctgaatacctggaaagtcttccgaagaaggatggatacaaacaagcccagactgcaaagactacaataaatgctgactcttcaatgcccagacactgatgaacatccacaagcatcaagaccatccaggaaaacatgacctcacaaaatgaactaaataaggcaacagtgattaatcctggagagacagatatataacctttcagatggaaaattcaatgtagctattttgaggaagctcagcaaaatccaagataacacagagaaggaattcagaatcccatcaggtaaatttaacaaagacattgaagtaatggaaaagaggctgggtgcagtggctcacgcctgtaatcccagcactttgggaggccaaggcgggtggatcgcaaggtcaggagattgagaccatcctggctaacatggtgaaaccccgtctctactaaaaatacaaaaaattagccaggtgtggtggtgggcgcctgtagtcccagctacccgggaggctgaggcaggagaatagtgtgaacctgggaggcggagcttgcagtgagccaagatcatgccactgcactccagcctgggcgacagagtgagactctgtttcaaaaaaaaaaaaaaaagaaagaaataatggaaaagaatcaagcagaaattctggagctgaaaaatgcaattgacagactgaagaatacatcagagtctcttaacagcagacttaagcagaagaattagtgagcctgaagacaagctatttgaaaatgcacaatgagaggtgacaaaaggaaaaagaatgaagcatgcctacaagatgtagaaaatagcctcagaagggcaaatctaagaatgactggccttaaagaggaggtagagagagagatcagagtagaaagtttattcaaagggataataacagagaacttcccaaatgtagagaaatgtatatcaatattcaagtacaagaagattataaaacatcaagcatatttaactgaaataagactacctcaagacatgtaataatcaaactcccaaaggtcaaggataaagaaaggaccctaaaaacagcaagagaaaagaaacaaataacatacaatggagctccaatacatctagcagcagacttttcattggaaaccttacaggccaggagagagtggcatgacatattaaaagttttgaaggagaaaaacttttatcctagaatagtatatccagtgaaaatatcattcaaacgtgaaggagaaataaggactttcccaaataaacaaaagctgagggatttcatcaacaccaggcctgtcctacaaaaaatgttaaagggagttcttcagtcttgaaagaaaaggatgttaatggcaataagaaatcatctgaaggtgcaaaactcactggtaatagtacacagaaaaacatggaatattataatattgtaattgtggtatgaaaactcctatcttgaatagaaagactaaaagattagccagtcaaaaataataattacaacaacttttgaagacatggacagtataataagatgtaagtagaaacagcaaaaagttaaggggatgaagttgaagtgtagagtttttgttttctccttgcttctttgttaatttgtttatgcaatcagtgttaagttgtcatcagtttaaaataatgggttataagatattatccgcaaggcccatggtaaacctcaaatcaaaaacatacaacagatacacacaaaaataaaaagcaagaagttaagacataccacctgagaatatcaccttcactaaaaggaagacaagaacaaaagaaggaaggaagaaaagaccacaagacaaccagaaaacaaataaaatggcaggaataagtccttacttatcaataacattgaatgtaaatggacaaaactctccaaaagacacagagtggctgaatcaatacaaaaaacaaggcccaatgatctgttgcttacaggaaacatgcttcactatacatacacatataggctgaaaataaagggatggaaaaatatattccatgcaaatggaaatcaaaaagcaggagtagctatacttaatagaaaaaaactataaaaggagacaaaaagatcattatataatgataaaggattcagttcagcaagaagatagaacagttgtaaatatatatacacccaattctggagcaaccagaaatataaagcaaatattattagagttaaagagatagacctcaataaaataatagctagagactttaataccttgctttcagcattggacaaatcatccagataaaaaatgaagtatcagacttaatctgtactgtagaccaaatcaaccaagtagatatttacagaacatttcatccaacagctgcagaatatacattcttctcctcagcacatggagtattctcaaggatagaccatgtgtcaggtgccaaaacaagtcttaaaataatttttaaaaattgaaatcatcaattatcttctctggccacagtggaataaaactagaaatcaataacgaagaattttggaaactatacaaacacttagaaattaaacaacatgctcctgaacgaccagtaggtcaatgaaggaattaagaagaaaatttaaaactgtcttgaaacaaaaaaaaaaaaatgggaacacaacataccaaaacctatgggatatagcaaaagcagtactaagaggaaagtttataacaataagcatgtatatcaaaaaagtagaaaaacttcaaccttatgatgcatcttaaagaactagaaaaacgagcaaacaaaaccctaaattagtagaagaaaggaaatataaagatcagagcagaaataagtgaagttgaaatggaaaaaaaagatcaacaaaacaaaaagttggttttttgaaaagataaaatcaccaaacctttagcccaactcactgagaaaaaaaaagagagaaaccccaaataaataaaatcagagatgaaaaaggagacattgctactgatactgcagaaattcaaaggatcattagaggctgctatgagcaactatatatgccaacaaactggaaaacctagaagaagtgaacagattcctagacacatacaacctaccaagattgaaccatgatgaaatttaaaatctgaacggaccagtaacagatggtgagattgaagtcgttataaaaagtttcccttcaaagaaaatcctgggacccagtggcttctctactgaattttacaaaacatttaaagaagaactagtaccagtgttactcaaactattccaaaaaatagaagagaagggaatacttttaaactcattctacaaagccagtattaccctgataccaaaatcagacaaagacacatcaaaaaaagaaaactacaggccagtattctggatgaacattgatgcagaaatcctcaacaaagtactggaacaccaaatttaacaatactttgaaaagatcattcaccatgaccagtttattgagggtttttatcatgaaggatgttgaattttatcaaatgctttttcagcatcagttgaaacgatcatacggtttttgtccctcatgctgaagatacgatttttcacactgcttgatttgcatatgttgagccatccttgcatccctaggataaatcccacttggtcatgatgaatgattgttttaaaataactaaaagggtataattggattgtttgtaacataaaggataaatgcttgaggtgtgggatagaaattgaataacatagagtggctagaataaaaatcttgaaaaagaacaccagagactgatttaggaattaaggcatatcattcctctttgaagaaactttgggttggatgcagtggctcatacctaaaatcccagtgctttgggagcccgaggcaagaggattgtttaaagccagaagttcaagataagcctgggcacggaaactcttcttataaatgtggatttgtaaaaggtagcatttttcctctagtgaaagcatttgaaaaagtatttttcttctacaattcctgaagaatatgtagaaaattgtttttccagctgggcacggttgctcatgcctgtaatcccagcacttcgggaggccaaggtgagcagatcacctgaggccaggagttcaagaccagcctgaccaacttgatgaaactccgtctctactaaaaatacaaaaagtagttgggcatggtggcatgtgcctgtaatcccagctacttgggaggctgagacaggagaatcgcttgaacccaggagaggcagaggttgcggtgagccgagatcgcaccattgcactccagcctgggcaacaagagcgaaactccattacaaaaaaaaaaaaaaagtaaataaaccacagtgagataccatttcatacctactagggtggcagtaataagaaaggcaaacaatcaaggatgtgggaaaattggaaccctcatgcattgttggtggaagtaaaaacgatgcagctgctgtgaaaaaagtttggcagctcctcaaaatgttaaacatagagttaccttataaaccagtaattctactcctaagtatatactgcagtttaagagatcaccaagaccattctcaggttcagtaattcactagaaggactcacagaactcagaagaacagttatactcacagttatagtttattatagtgaaaagatacagatttaaaattagccaaggatagaggcacataaggcatggtccaggagagacctggaatgcagcttccagttacccctgccagtggagtggtgcagatagtgcttatttctcccagcagcaatgtataatacacatagagtattgctagccaggaaagctcacccttggtgttcagcgattttattgagagttggccacgtaggcattgctcaccatccacgtggctgatgttactctccagtccctccagaggtcaggctgatagaaggtgccccaaagtctctaccataaatcacatcgttagcatagactatctcacttggcccaaggacccaaggtaaacaaagacactcttatcaggcaggacattccaggggcttaaaggttacttctaaggagctaaagacaaacagccaaactttttttttagacaaggttatcctttaccgcacaatacccaagagaaacaaaaacatatatccacacaaaaactgctgcatgaattttcatagcaccattatttcataacagacaaaaagttaaaacaacccaaatgtccatcaactcgatgaaatggggtatatccatacaattattttttgcccataaaaaggaatgaagttataatacatgctacaacatagaggaacctgaagaacatgctaagtgaaagaagccagactcacacagccacatattgttgtaattccacttatatgaaatgtccagaataggcacatcaatagagacagaaagtagattagtagttgcttggggctggagttggtaacagggagtaactacaaatggacacaagatttggggttggtggtgatgaaaatatcctgggattaggtagtggcaatggttgcatgactgtaaatatattgaaaaccattgaaatgtacacattaaactggtgaactttatggtatataaaatatatcttaataaagctatttctgtcatttcagtgaatgaatataatgaccatgctgtaatgcacgtagtaaagtgtttaaagacacatgtataaaagatgctttgtacaagtgctatttgcttgccacaatgagaacagtgctatctcaattttttattttaaatttgtaaagataaaaatattttttaaatgggcataataaaacctctctatcaccttccgtggttacagtggaaataagtgagatgtatgcaaaggcattttgtttaatagaatgcgccagacatatgttttagaagaaaacaaataggtatctggtatctgactggcacctttcttcttcttttttttttttttttttttccctgagactgagtcttgctctgtcgcccaggctggagtgcagtggcgcgatctcggctcactgcaacctccacctcccaggttcaagcaattctctgcctcagcctcctgagtagctgggattacaggtgcccgcctgtaatttttagtagggatggggtttcaccatcttggccaggctggtcttgaactcctgacccatgatccaactgcctcagcctcccaaaatgctgggattataggcgtgagccaccgcgcccaaccctttttttttttcagggtctcactcctatcgcccaggccggagtgcagtggcacaatcacggctcactgcagcctcaacttcccaggctcccacctcagcctccctagtagctgagaccacaggtgtgcaccaccacacccagctaatttttgtattttttgtagagacagggtttcgtcatgtttcccaggctggtcttgaactcctggactgtaacagtccttgcgtcttggcctcccaaagtgctgggattataggcgtgagccactgcgcctggctcttcttcttcttttttttttttttttttttttttgagagggagtctcgccctgtcgtccaggctggagtgcaatggcgcgatcttggctcactgcaacctctgcctcctgggttcaagcaattctcctgcctcagcctcccaagtagctgggattacaggcgtgtgtcactgcacccggcactcttcttcttttttttaatggtaatattattgtacgttttttgttgttttacagtctagctggagtgcagtggcacaatcgtggctccttttagcctcgacctcctgagctcaagtaatcctcccacctcagccttccgagtaccacaggcgtgcaccaccacactctgctagtttttttatttttattagagacgaggtctcactatgttacccaggctggtctcaaacctttgagctcaagcgatcctcttgcctcagcctcccaaggtgctgggattataggcatgagccaccatgctcagcccaagttttatcttttaaattgcaatttttattaacacattgtagttgtacatatttgtggggtataatttgatgtctttatatatgttgtatagtcaaatcaggatatttagcatatctgtcatctcatgcgtttatcatttgtttatggtgagaacattcaaaagcctctcttctagctattttgtaaaatataatacccttctgttaactgtcgtcaccctgtgcaatggaacaccagaacttattcctcccaattataacttcgtacccattgaccagcatttttcaccaccaaaatatatagatctccagctataaataccacagaattacctttttttgaaaagagttggattttatggcagtttcctaaaaggtattatatttttcatataagtacccaattcttacctatgcattatcttttattttgagtaatttatgtttatatttgtctctacattctataaacattctataaatttgacctgagaagatctgtttttagcttcccaataatagtagtttgatgtcacttactcattcccttgaatagaaaatcatttgctttttcttcccatatctttaacagttattaaacagcaaaagagtactgtgcccaacactttaaatcttttactaaagaataccttttactttgtttttcaaacgtctgactagtttcttagccaagtgataacaaaaggtacccaggtaaaagtacatcttgaactttcatcatcctcattttcgagaggcttcagtgtaatataacaaacttttctgatagtggtgttaaaagccggggtggaccatcttaggagcttcttatctggaagaattcagtaagtggctagattaccacttaattggaaagtggagggggaggtgtatagagtgggggatggaggcagaaaatcaggtactctcgaggaaattcaagcaataataaatgtaaggctggattagatgatcttagaattatatttcatccctggaattctttatcatatgaaattagtttaaatgaaatatggaatatgcccctttaaaactttgacagttgccagtatcctcttaggtgttgaatttctcaatctaagatgatctattgggcctttgcattctttttgtctttattcatatgtaagaattaacacttggctttaaccataagaattcccaatatttccttagaaacgaatcttcccttactttccccacttcctctacataaacacatagatgcactcatgcattttaaatctttgggcagcagggtgcagtggctcatgcctgtaatcccagcactttgggaggccaaggtgggcggataacttgaggccaggagttcaagaccagaccagcctggccaacatggtgaaaccccgtctctactataaatacaaaaattagccaggcatggtggtgcacacctgtagtcccagctactcgggaggctgaggcaagagaatcgattgaacccaggaggcagaggttacagtgagccgagatcacgccactgcactccagcctgggcaacagagtgagactctgtctcccaaaaaaaaaaaattaggcctggcacagtggcttatgcctgtaatcccagcactttgggaggccgaggtgggcagatcatttgaggtcaggagtttgagaccagcctggctaattggtgaaaccccgtctctactaaaatacaaaaattagcaggacttggtggcgcacgcctataatcccagctactcacaaggctaaggtgggaggatcacttgagcctgggaggcagaggttgcagcgagccaaaatcgcgccactgcactccagcctgggcaacagagtgagacccagtctcaatcaatcagtcagtctttggaaggaaagctgtaacattgtaaccataacaaatagtaattaaggctaactgaagcacaggagtatagtagtcatgggccaggtccttccccctttgcccccccctatgaatagtcagtacatactgcatagtaatgcttaataaatgtgttaaatctatgactgaatggcagaatattataaacttaatttcagattgtctgtaaccatattgttcaatagaactttccacagtgggccaggcacagtggctcacacctgtaatcccagcactttggcatgctgaggcgggcggatcacctgaggccaagcattcgagaccaggctggccaacatagtgaaaccctgtctctaccaaaaatacaaaaaaattagccaggtgtggtggcaggcacgtgtagtcccagctacttgggaggctgaggcaggagaatcacttgaaccctggaggtggaggttgcaatgagccgagattgtgccactgccctccagcctcagcaacagagtgagactctgtctcaaaaaaaaaaaaaaaaaaaaaaaaaactttccacagtgatggaaatgttttatgtctgtgctgtctagtgtagttaaaatgtggctactgtgactgagaaactaaattttttaattatacataattttaattaaatttaaggctaagcgcagtggctcacacctgtaatcccagcactttgggaggctaaggcagtcaaatcacttgaggtcaggagtttgagaccagcctgaccaacatagtgaaaccccatctctactaaaaatacaaaaattagccgggcatggtggcacatgcctgtaatcccagctactcgggaggctgaggcaggagaattgcttgaacctgggaggcagaggttgcagtgagccgagattgcaccactgcactccagcctgggtgacaaagtgagacaccgtctaaaaaaatttttttaaaaaatgaaatagccactcatggctacttggccaccaagttggacagctcagttctataacaacaatttcacggggcatggtggctcacacctgtaatcccaacgctttaggaggctgaggctggtggatcacttgagcccaggagttcaagaccagcctgagcaacatagattctctatttttaaatattttaaaaaattctttttgagataggttctcactctgttgcccaggctggagtacattggtgtgatctcggctcactgcagcttggacctcccgggttcaggcaattctcatgcctcagcctcccaagtagctgggactacagacatgcaccaccatgcccagaaagcttttgtatttttagtagagacagggtttcgccatgttgcccaagctggtctcgaactcctggcctcaagtgatccacctgccttggcctcccaaagtgctgggatcacaggcgtaagccactgtgctctggcctaaaatttttatgtttaaaaaaaaaattcaagaagttaggttacttagatattggaattcctatgacttttttagaaccagtggatgctctagcaataatactcactttgtgtgttttcttttgtttgtttagaaacattttctgagcaactgcttcttcaatagttaatgacgatgcaaaatgaaagacacagcttctgtttttaagatctatccctaaggacttgacaattgttataggtacagtgtgaaaagtaccattttaaaagcattcatagggtgatgtgggagacacagagaagagactacatgactgtttacaggagcccaggaaagcatctcagaaaacttgatgcttgaatgcttgagctgaaacctcaaaaggagtgtttgaattatttttggcctctgtgtttgctgttttctgtaagaacaggtttcttgggttacttgtaaagcatctgttatggtcagtttaggactaactttctcccggtctttcttttgcttcctacaagctatcaatttaggtccagaaacataggtctctcccttttcctccaactctgctaccttgacacctattttcttcctacagtgctctataaaaagctgcatcactgccttccacgtcacctgtgcctttgagcacggcctagagatgaagaccatcctagatgagggagacgaagtgaagttcaagtcatattgcctcaagcatagccaaaacaggcagaaacttggagaagctgagtacccccaccacagggctaaagagcagagccaggccaaaagtgagaaaaccagcctgcgggcacagaagcttcgggagctggaggaggagttctattccttggtacgagtggaagatgtggccgcagagctgggtatgcccacgctagctgtggactttatctataactactggaaactgaagcggaaaagtaacttcaataagccattatttcctccaaaggaggatgaagaaaatgggctggtgcagccaaaagaggaaagcattcacactcgaatgagaatgtttatgcatctacgccaggacctggagagggtaaggtgaccagctgtgactagtatataggcctcggtctgtgtagaaatggaggtcccacttctggtttaataatggtcagtcagctcataatagtgtgggcttctgtgtccttgcttatcttctgatctctttatggccccagacattgggctctgtgtaaattctgacaggcacatccaggggatttgggaggcctcgggtatatgctctatgaactttacatttgaaataaactctcatttggtttactttttattcactgttgagcctaaattggcccatccatattttactgacatatttatgagactttaggctgaagaaagagtgaattttgttcaggaaaacaccaaattagagtttcacaaacttggcactgttgacattttggactggatagttgtttgttgttagggggctgtcctttgttgtaggggcaatttaagatgtttaccagcatccctggcctctacccactagatgccagtagcacccgcacacacacccccagcgtgacaaccaaaaatgtctgcaaattaccaaatttgctctccagttgagagccactccacatgataattcaatataactcatggtatatttatcaggtatctactaaatgagatactgcagggcttcaaaggtaagttaagccctgtgtttatcctagagaattttctaattaaatgtaaatctataaatggcttgtgtttttttttctctgctaccagaatttgaaagagaactaatagatttggctcacttttaaaaatttaagacactcacatatagcacctactattactattattgccaacactgtcctaagcattttataaatattaattcatttaattctaacatgcccatgaaaaactattattatcatcatcactatttacagatgaacaaactggggcaaagaaagtttgtgtaacttgcctaggtagggagtatgagagagagagtatttcacctttgtggctgtggaaacttggttgagctgaaagtgtgagcaaaaaaaacacttctagtcttcccagtggaactgtatcctgctcgtccggcactgattagaaaattgtactggatacagccagcattgccatcattcgtactcagggatctaaagggaaggctgaattgttaaaccattattcagcttcccaacctggctgtgcaaataaatatcaagcccatgacactgcaaagagagtaggtttcagaaggcagatttggagcattttgcttttactattggttgatagatcccagaattgaccatgctgtgtgaattcctgtggagtgggtctcattctgcagctcttggattctgtcttctctcctcacccccacctgactttaggtctttattttagccaaacaatttcagttgtcaggtttgcttaacatgacaaacatctctatttgttggggattgggctttcaggtccgaaatctgtgctatatgataagcagacgagagaagctgaagctgtcacacaacaaaatacaggaacagatcttcggtttgcaagtccagcttcttaaccaagaaattgatgcaggtaacctgtatatttaaaatgtcctaacaaatatgtagactctggttatatcctatcttaacaatttaaatttcatgccagtcattccacttaaaaatcttttaaaattcttgtcagatatctcatttgcttcagtctaatcttaatataacctggcccatttcactgtcagttcataaggcaagaaatcccagggtggggtaggaggagttgcaggtctagggcaggtaatctaggtcccaaacagatattcgaggccattagtggaagccatgaaattattctgtaattatcaaattcatttagaaattgacgggataggatctaacacgtttccagaaaacacttaattctagggttactcatcttaacaatagtctattaaaacaaatccttagccagaagtaagtttggagatctgagttgttatcttttcatttattcactaatatttgttgagcacctacagtggactaagagctgagctacaagatacagtagaaagcaagacaaaatccctgcctgtagggtacactgcccacttggtgagcaagacaggtgagcataattatagtgccctaagcatagggagctgggctggaatgatgacagtcatattcagtgacacctgtaaactccctgtgcctcatttaacacagaggtcaatggcagagcctgggcaactaggggtcactggacagggtgtgcagaatcagctcctgccaagggagggtcagccatggagcatgagagagactcagaaatgaggtgacaggtgggtgtcagaggccttggggtatctgagtgtcatgggtctcaacagagtagtgtagcaggaggcagcaagactgctcagccacaaagggcaacatgacaagcaaaacaaggagaagcagaggacaacagggagagtccctgcatgccaaggaaattggctcctacccacatgccttctgatgtgtaggagtcaacctcattatgacttgcagcatcagcaggtgacagctcctgacagagatgggggttgtgggtgttcaaggtggacctttggggaacaaatgctgcccactgggatacctaagagctgtcctcttgatatctcatttttgtgagggtacagtaagatggtaatgggcaaaggtcaagtccatatacaaggaggaattgtttgatagtgctttttaaatttcaaagtacttgaaataatagaagaagacctgctctgactgtgattgtaggatgacttaactgagaaactgattgccgatactccccaaccaatcctatagcaggctggttggcaggaatgttatgattcttttctgctggccttaccactacaaaacctcccaccaccataatgttcatttgtagtcaggaaattattctaggttaaggatataaaatttatgggaaccacccaactatcacctctaatgccaagttcaaacacatacatactcttcacccaccaaaacccttgcaacgtttctgaaggtttgtgtttgccttgcttcaggaaggccagaagagattagaggatggggcctgaaatgtgtgtgtttaagacacatactaagtgctgtgccataccaacacatgcatgcacagacacacaaataggaagaccctattctaaaccattgctagagacattcttctcagaaatggaagggcagagatgggacgcaggaggcaacacactagtttgtgatcattttacagactgaaagagcagaggtgaagaggtgtggagccatatagcaaacagtggcattgctgagttcattcttggccccaacctctagttcagctcactccagctgctacaccatgatatacatacatagcagagccaggtgcttgttaaacatttggaagagtaggtatgtgaactcactctgccataagcacaaaagccattatttaaatcggttgttaaaacgaatctttcttttttatctcagggcttcctttgacaaatgcacttgaaaactcactgttttacccaccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccagggtatttgctcagtaaatattttggggcagctttccggttatataacacattgacaagtatatgtattaagagtccttgcattgttaactgatttgcaagagaccatgattatcagacactaaaactacttatcttttgaagctacagcatgtgactccccagagctcctgtctgtaggaagtttctaattccctggtatctataaacccttttcaggggagagaccggagaccccatcttagatactgtcaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcccctttttaccaatactttttcattaaattatgaaaactgct

SEQ ID NO: 5672 - DNA, 148772 bp, human; identical to SEQ ID NO: 5671

SEQ ID NO: 5673 - DNA, 148772 bp, human; identical to SEQ ID NO: 5671

SEQ ID NO: 5674 - DNA, 111954 bp, human
tccgggagtggaagcgggcggcgcggagcgcacagtcccggcccggcctcgccgcgctccgggtcgctccggttccacatcgtggtcgcctccggcgtccccggcgccttggggccgagagcgtgtgtgggctgaggtaaagtgcctggtggcccctctgcccgcccgggtagtgcctggtggcccgggcggggggcgggggcggacgcgcgagctcggctgcagctcccggctacaccgggcaggaattgagcgccataactgttgcggctctttcctccggtgccccctcctggcgccccctcctccgttcctgccctttgcctggcttcggggctgacggggccagacccgtggcgggaggacctgctctgtcggccgccaggggtcggatgctccagggagcgagggcgcgccctggctgtttagctgttggggggcggaaagaaccgagtgcctggagaggggagaacgggtggtgctgggtgcggcgaggcaccccgggaagcccgggtgcccacccggcgggagcgggagcgcgggcgcccggcgggctggcgaactttccctcccactggcggcattgttcgaactgcgggtccgtggccgccgagcgtcgggcggtccgggggtgggaaaatcgtgagggctttgctagtcttccggggaaattttcccaccgctgggcacggcaaagttaacttttctccagctttcgagttcgttttattccctccgccccgggggccgtagtttgtttttttgttttgttttgttttgttttttgtttgtttgttgttttttttaatagccttcaatctttttctcccgcttttcacagcagagccagtgcttcggtggagtctagctttaaattgcacagggcagcctgagtttgttatttgtgaggagggggtggcgggatctggagtgagtgaccacaatggtggtatgtggaggcatgtttcaaagtttttatcgctgtgcggccctgggacatatgtggctactagggatttggcaagaaacttgtttggccgcttctccgactttgagttgcaaggaaatccgtggcctcagatgtgcgcgagttgtttgtgtgtgtgtgccgtgaggtgcgtttatctatgaagctgaggatgagattcccccctcccgccgtctgattgtgtaagaagtcaaaaccgtgttgaaggtgattccagtggtggcctggagggaaaggcgacctcattccctgtgttcagtctgataaagtgaactgctgctctctaaacttgggaagtaatgaaaaataatttaggtaaaaactggttgcacaacgtctttgcttagtttaagcaacccacaatccactttcccagaccagttctcctgttaaatactttccctttagccacttcttgtcagcctaggctgggagggggaaagagtagggctgagagaggagtcggtctgaacaaagcattgtgtttttatttagtttaatacttccaaaacatctgtagacaatgggagtatgggtcccggccttcgtaccctttgagtagtgtggttctcatgcttttgtagcatcatgtgattactcttcggatacgtaaaaatagattttttttcttttttgtttaacctaagagtattctacctccataacatatcattttctctttcgtttaaagtgagctctgagcttaaatacttgaactgtaaaaggataataccctctcttcaaggattacctgagaccgttgagaagtgtttcagtgcccagcgtgtattcaactttcaatcgatgttagccaccatctttgccaccttttctccagttgtgctcttctttatgcttttgtttgctagagaatagcttttaacccaatattgttgccttgctttctgtccagtcaattctggaatactcaggggtgcaagtctggctctagaattcacactttctctctcccctcttctctgagtcatgttgcttgccctcggcaatgcgatgtgaatctggtcataggtagaaaaaagtagagaaaggcttcccactcctccctgaagtgttgtgacccaccttcaggcccgtaggggagattcccaggagcaggacaggtgatggtgcagggctggcatcatagctaagaagtatggattggtgaaagttaaagaagaaagggtgttgaagacttgtaggtttagtattgtcctctcctttaataatgcttgtcttttccctctcttgtgttccaccaaccataacaacccattttttcccctaacctacacaaagccatatcttctttctgcccactgctttgaggtctggctggaactaggcaagtattttggaagaggtgggggaggtaggaggcatcaggtgctggtaaagacatggcattagggagggctcttacaagccttgatcagagttacagagagccagtccaaaaatgaagctgagcattatcaggggacataatgcacctacctccttgtggagcttacacaaaataggagctgagaagacagaggtaatatgctgtcttacattaagaaaatctctcattgaggtatgatttactatgatcttgacttgtcccacaatataggtgagaagtgagtgttaggtgacacctgtctggcactctcctaacatggggacactttaatggctcacaagtttctgttgttccagttacagtggctgggaaagctgaaacattctggtttgtatggtggggaggatctagggtgaatgggtaaaagtgatgaacaaataaacgggtactagcaagtaagtggtcattacaaaccaaataactaccactttgagttttctgatttctggaatctttatgactccctcatggttatttttgccttgttcctgtaggtctttccatagataataacaacaaaattcttaccattagaactgcctctgtgcttttcttgggagaaagtaaaaaaaaaaaaagggtcctgggaaaaacttgcccgatttcatagctaggcttgtgaaaaggaaggtgataagtcagaagacagccgactgaataaaggacctggtgtgaggaaatagtactggggctttgaccaataggaaacacctatgagttcatcaatgcttttcaagcagcaaataatttaatctttgccaaaacccaggaactatggctgtgccctgctacccaaggagctccttttcccttggtattggctgatgggcaaggaaacccaagcctagaatgtgtttttttgttttgttttgttttgttttgttttgagacacatgacaagaatatatgataccagcatggccaatacactagactttgtgtgttggaatcttctgggacacattcttttttaaattttaaaaacttattttgataattacaaactgttataagaatagtacaaagaactcactatattcccaattagtaacggtttgctctcatttgctttatcacttgctcttttagttctctttccaaaccatttgttagtaatcactgaaatttattatttgttgtttctttcaagccatttgttagtaatcactgagagattggtacttatcaagggcatcctgtcctgaacagtggctcagttgcagccactgggtatagcagaacagtggtggtgaggcagggtccagaggtagagcaaagtctacctacagctgtgaagcacacagtttgtaaaccgtgtagaatctctagggctagatatagaaatcattatcgattgtaaaagtggttaagataaactccacttttctcaccattcttgtcaagtttgttcttaactatgccaaactttaatactgttaatgaaaattcactccactccccaactttgcaacaataatatattctccaagattttcatttaattcattcagcaaacatgtattaaataccttctgtttgctaggggtataagaggtgaaagatacccccttaacagctcaacttccagtggaaaggaattaagtcatcttctcacagtcaggaggaagagtgctctgctgaaggggttcacagggagtgatgggagcaccatcctggttaaggatctgagaagtagatctctgggagtcatttgggatgggtgtaactatgaagatctgtcttctctgaggcctgctcttagatgacaaggttcatgagttagagaagcctttggtgtcatatacccagcacaggctgtgaggtcaggccaacttggattcaaatcctaactctaccacttgctcttggccagttatttaacttctctgtgcctcaatttctttgtcaaaccatatctctgagggtggtagtgagaattgatcaatgctctgtaaacattcatttcatcttactctacaaaaatgcaatgtatggggaaattgcctgaaaagtaataggtattaaggtgggatccaagctggtgggggcgggtgggggtggctcggtgtgtttctattttttcaacaaataaatatctaattgcactaagagctatgatggacattaccatataggataataacaataacagcagcaatgatttcttaaacatttcctgtgtcccgagtactgtgctaagtgcttaactaacagaggatctctctctctgaggtgtgagactcagaaaggtgaagcaaaggtaacttgcccaaggtcacgcagcaagtataaggtagaatgtccctgtgagggagaccagcatggtgccctgagccttgagaatgagcaggaataagcaaggtaagggttagagagaagggattgccaggcaggggtagcagcaggtgttgtgagggcactgaggtggaagagagatgtggaaaggatccacagaggtttggctaggacttggggtaagagagatgaggtgggcagggaaagattgacagggccttacgggacctcattaaagagcttgtgttttattccaagtacaatgagaggtgtttctttctctctctctctctctctctaatgggaggtctgtctctctctctctctctctctcactctctctcatcctctctctctctctctctctcatcctctctctctctctctctctctctctcatcctctctctctctcatcctctctcatcctctctcatccagggaagcatatagtgaggcctaaacaaaaatggtttaagaaagtcatttccccttcagtgtcccaccttgcaatccaatagaggcaatgtctctggaccaaatgtgtaggtcttaaacagtttttatcgactgccattaacatggctaaaaagagtttctatgatgctggaagaagctggtccttcagaatgcttctagaaggaggtttaattaggctcatatagctgatgctttttaggctgcattaagggagctctttcagctctcactgatccctgtcacatggggaaaaagtagaattgagagaaaacataattcctggaaacctgagttgttgttcagtgttagaaatggaactatcgagtataagactttggtttaaatatatcatgataaagatacttcagtgactaaatggaaatttttttatgttttttgttttttgcatgtgtgtgccatctgtgatggcagacagcacatttgttagaatctgggaagacttaagtattttttcaatacttatatatttatatttattctcatccaggtactagaagtttttctgtttgaaactatttcttatctacagagtaaacttcacaggaggaaaaccagtgttctgttccccttcccataagtactaggccacaaacatatttacttttaagtagcctgtgtcaattagctttttgggggagggtggttagctggtggctagatgatctgggatagccttactcacacatctggtggttggcaggctggttggtctaggaggccctaagccgggatggttcatctccattctatgtggtctgccctccagctggctagtctggacttactaacatggtggtcttgaagtcacagagtagcaagtgagagcaagcaccagtgcacaagcacttttcaaatgtttgctgtgtcacatttgctattgtcccataagctaaagcatggaagtgcttctgtggccaagcccagagtcattgtgggtggtgaccattcaaaggtgtggatacagggagatgtgaaaaaattgggggccattactgcaataattcataataattagcaatgaatgtaagctgttaagctttgataaatcttgttaaacacccatttctgaatgtagtgtattctagagactaaataatgtgattgtgccattggtaacacctcttccaccaagtgtggaatggagtgatggtttttctgggaagaagccaaaggcagacagtgtggttttggacatagatattcttgtgagtggcttaactgctttctgatcttgtgtggctattatcaaaggagtctctagatttcctcaaccttccattcaagcattatcacgaaaaccctagtgtattagactctactagattttgtggtcaagccaaaagaccgttatttgggaaccaccaccacttaagagatgaaagaaacatttgcagtctttccttggaacctttatatgatttataatttgtacctaagagaggaaatccgtatttgagcattggtaataaggacaagggattctctgtaaatgtgttttaattggttaagatttaaaaatcttcctgtggttgcagtgaaaaatccagcattgtactgtgaagtgagtggccaggaattaccaatttggggcatcagcctttgacctttgcttgtgaagatctcagaagtaacactttccacataactgaaataggcttcacaacagcttgtggcctgaaatatattacatgaaaatgcaactggaccccaggaagtatgtgtgggaaactatacaaggctcattttgtatgtcttagagatgtacattcccccagaaaattgcctggtggtagaatgttagcttttcttctttcctcctaggataaaaattaaaaatctctgacattttaaaagtcagtgacttgaaagagcaatcaaaatttataaacacacacatcattagaccccacaaacacttccaggaatttattcaacaaatatttgcatattaattggagtattgcttgtagtagcaaaagattggtaatatcctaagggtcaatcaagaatattgaagacactgatagttttggaacacgcatgaccaagcaggtagagggtgagagggagacttttcactacataaacttttacgtatgtgttttgaattttaagcaatgtgaatatattttcttattttaaaagttaaatacattttttaaagagatgatatatagtgatgcaaaattccatagactcctatccgagttgacctgatcagagctattcctgttcaaaaaaaatctagccagtttttccccctagaaatgcctcacgatagtgtacttctgaatttttaactataattctgccttttccagaatatcacatgagtggaatcatgcaatatgtagcctttttttggtcttgcttttagtggattcatccatattatgtgaatgaatagcctgttccttttcattactgaatactattccattgtatggatgtaccacagtttgttcattcacctgtcgaaggacgacttagttgttaccagttttttggtggttttcaatagagctgtggtaaacattagtgtacagatctctgtgtggacataagtttgcagtttattggggtaaatacgtaggaatgggattagtggatttttctttgacagaaattaccaaactatgttccaaagtggttctaccattttatattctcctgccatgaatgtgattccacgtatggatgtctagttgtcccagcaccacttgttgaaaagactaccctttctccattgaattgcctttgcatatgtgtcaaaaatcagttgactatccttctgtggatctatttctgggctctctgttgcattgatctatatatctatcatttctccattaacacacagtcttgattattatagctttataataagcctagaaatcaggtaatagagtactctggctttttaaaatctttctctcagggtatgcttaagttactttttaaaaaaatttttttatagaaacagggtctcactgtattggccaggctagtctcaaactcttggtcttaagcagtcttcccactttggcttcccaaagtgctgagattacaggcatgagccaccacgtctggctttttttgctttttaagagacagggtcttgctctgtcacctaggctagagtgcagtggccccatcatagctcactgcagccttgaactcctgggctcaagtgatcctcctgcctcagcgtcttgagtagatggggctatgggcacatgccactatgcccacctatttttaaatattttttgtgcagagataaggtcttgctatgttccccgggctggtcttgaactcctgcctcaagtgatcctcctgctttggcttcccaaagtgttggaattacaggcgtcagccactgcacctggcctggcttttttcttctttttcagagttgtagtggtgagagaggacatccttaacttgttccaatcttggaaagcattccatctctcaccatcaagtatgatgttgtaggatttttttttaatatactgtgttgtgcagaaaagagttaacatagcagacctgaggctgctgtctttagaaggccaacgtgcacgattggcccttagctggtgtttgggaaattggcttttcaaatgtttaaaaagaaaagattatattctaccttcatttattccttttccaatgcttttcatttctttatggtaatccaggtttcctaccttgatcacagtctttctgcttaaagaatcccctttaacctatcttttgagggcagatctgctggcagtaaattctctgtttttggttgtctgagaaagttttcattttccttcacttttgaaaggacacttttgtgggttgacagttgtttttcctctttcaacatagtactccaccattgcctggcttacgtgatttctgatgagaaggctgctgtaatccttttttttttttttaataccttaagttctgggatacatgtacagaatgtgcaggtctgccacataggtatatatgtgtcatggtggcccgctgcacccatcaacccgtcacccacttcaggcacctctcccaatgctatccctcccccagtcccccatcccccaacagactccagtgtgtgatgctcccctccctgcgtcgatatgttcccattgttcgactctcccacccatgaatgagaacatgtggtgtttggctgtctgttcccgcgttagtttgaggctgctttaattcttatccttgttcctccatagttaatgtgtcttttttcctctgactactttgaagattttctttttgtctttggttttcagcagcttgaatatgatatgcctaattgtggcttttaaaattttttcatttttgtcctgctttgtgttctctaaactttattatatctgtggtttgttgcctgtcactaattttggaaagtttctcagccattatttcttcaaataattctatcttgttcttttttttttctctttctgggattctaattacaagtgtgttatactgtttgttattgccccacagttcttgagtgctcttcagtattttcattcgtctctttttaatttttattgactgatcaataaccttgatcttcaagctcactgagtctttccttggctatgtcaagtctactgttcagcccattgtttttcttactgttttttttttaatttctagcatttccctttgattcattcttacagtttctatctctttgctgaaattatctgtctggtcttgcatattgtctattttttacattagagtctttaagatattaatcatagttcttttacatttttttctgatagtctcaacatctgcatttactgagtctggatttagtaattcctttgtcacttggaatgttttcttgccttttgttacgcctcctaaatatgctgaaagctgaacatgggcaggagatgcttaggtaaatatttgatatgtttggagaagaacatatttatggaaatttgtgttaatttggtcaggagttggcctgtgtttttttgtttttgtgtttttgcttttgagataaggtctctctccgttacccaggctggagtgcagtggcatgatcatggctcactgcagcctcgacctcctgggctcaagctatcctcccatctcaggctcccaagtagctgggactataggtgtgctccaccatgtccagctagtttttaagatcttttgtagagatggggtttcaccatgttgcccagagtaggtctggaactcctgggttcaggtgatctgcccgccttgacctctcaaagtgctgggattacaagtgtgagccactgcgcccagcaagagttgacctgtttgatattgggtttgttttgttttgctgtgggtaccagagatttcttttctctctctctctctctcttttttttttttttttttttttttttttgaggcagggtcttcctctgtcacccaaactggagtacagtgacacgatcatggctcactgcagcctcagcctctcaaccttctgggctcaagcagtcctccaacctcagcctcctgagtatctgggaccacaagtgcatgctaccatgcccagctaatttttaaatttttttttgtagggatggggtttccctgtgttgcccagtctggtcttgaatttctaggttcaagcgatcctcctgccttggcttcccaaagtgctgagattacaggcatgagccactgtgctccaccaggcaccagagatttctgatttctctagtgatacattcattttgactcttgcttagctttgggtttttactttgtgctgcttcccaagagctagctctaacagctctcccagttgtattctattgttcttaaccatggagctggtttgccaggttgtggttagtaggggaggagggagttctctgatgatctgattaaaccttacttagacaggtactagagcctgggtcttgagtgtgtccttggcaagatttacttttcctcctcctggactggagcttctttttctttttcccatgttcctttaccctagctgcagtgggtatccaccagtgttctccaaccatgggtttcaagtccttcccccaaagactaagcctttttttctgtattggggataaagggatctgggtaggtttcacagtgggtgctgttttcctcagccagctagccagcaccatggtgggcgctttctctgagatttttccctgatcttccctgtgagagcctggtggaattcctgtaggaaaagcttgtaagagtgtagcaacctcttacaagcttcacactctcatgccagctcatactctggtctccagtaatttgtcagaacttctagtttggtcctcctacaagtttatatgctcggatcctgtgtctccctgcgggtatgagtatttccatatattgggattgtgggacagtggtttgtcctaggacctcagttctgtcatattgaagaaaagtagttgcttttcagtttgtctagcatttttcttttagtgagagtggagatggtagcatcccagtgctttatatccaagctgaaacctggaagttttaatctatataaatgtctaatgcaatgcatggtacatagaaactcagtacaggttagttttcctttatgtttctttttcttactctcttgaattttatggttttatgactagggagccaggaataattgattctagtttggtttctccctgttttaggcttaaaaatcctctataccacttaaacattatacgtttgtcttgctttcttccaaaattcaatgtatgcctttgtagtttttgaatatgtcattagcactcagtaatttgcgtcactgaaaattagagcatgattttatctatttagattgtagattttgttagtgaccatgtttttgtcatttttgttatccacatcgccaggtgccattcgcttcagcagacatttgttgagtgcccactgtactatgagtgaggcactaggtattgagtagaatacaaacctgactaggtaagtggaataaccaaggggtccccaagggcagtggaaactccatggagggaaggatattgcaacttgcacagtatctccatttcaatctagaaaggtttaattcttttaagaattctatttttatactaatgatacatgaatgcatcctagcaaaaaattgaaaaattgtagaaagagccatggttgttcttgacatcctcctcctatcacattctccttcccagggttaattttgattactatttctgtttgactgtagaaattgctgtgtgaaatatcatgccatctaataacttagtaaatacttttatttttaagggaataagctctcaaatttatttaacttttaaggaatgcttatttaaagagatgactattatcattcagtggggatgtgtgacctgatgatagttctttgtttcactttatagtatagctattttaattgttaaatcctacgttagtggtcagtggaaatgttgtagtaaatgggaaacacagaaattagtagtgaccaaaaagatgacctattggctgggcgcagtggctcacgcctgtcatcccagcactctgggaggctgaggcagggggatcatgaggtcaggagatcgagaccatcctggctaacacagtgaaacccggtctctactaaaaatacaaaaagaaattagctgggcgtggtggcaggcgcctgtagtcccagctacctgggaggctgaggcaggagaatggcgtgaacccgggaggcagagcttgcagtgagccgagatcacagtactgcactccagcctgggcaacagagcaagactccgtctaaaaaaaaaaaaaaaaaagatgacctattgacttttttttttcttttttgagagtcagggtcttactccatcacccaggctggagtgcactggccctatcatagctgactgcagcctcaaactcctgggctcaagtaatcttcccacctcagcttcctgagtagctaggactacaggtgtacaccaccatgcccagctaattttattttattttattttattttattttattttattttattttattttattttaagagatgggaccttactgtgttgcccaggctggtcttgaactcctgggctcaagcaatccttctgcctcagcttcccaaagtgctgggattgtaggcctgaggcactacacctggcctattgacttaaaaaaattatacagtaggttggacttttttggggttatttatggttctgtggattttttttttaagacagggtgtcactttgttgcccaagctggagtgtcacagttgtcactcactgtagcttcgaactcctgggctcaagcaatcctcctaccttagcctcctgagtagctaggcctacaggcacgcattaccacacctagctaatgttttagtttttttgtagagacgaggtctcactatgttgcccaggctagtcttgaactcctgggctcaagtgatcctcccaccttggcctcccaaagtgctgggattacaggcgtgagccaccacacctgaccccgttctgtggatttttaacacataaatagatcagtgcaaccaccaccacaatccaccacaatcaaggtgcagaacagttctattacccaaaaaattcctttgtgctgactctttagtcatactctctttccatcctaaactctggcagccactgatctgtgttctatcactacagttttgttattttgagagtatcacataaatggagtcaaactgtaatcttttgagtctcattttcctctctcagggtaatgcttttgagattcatccaagttgtatatatcaatggtttgttcctttttattgctgagtagtattccattgtccaaatataccacagcttgtttaatcattcaccattgaaaggcatttgagttgtttccagtttttgttgattgagtagagccgctataaaaattcatgtacatgtgtttgtgtgcatataagtttgcatttctctaggataaatacctgggagtatgatggctagaattgtactaccattcatggtaaaactagttagctagagtttgaatgctaggatggatagagtagcagagacccaagtttgaatcctgctttttctttttactagctctgcaaccttgagtcagtttaacctctttgtgcctcagtttcctcgtttgtaaaatgaagttaaccactggtattgtgtgaaataaatgacatattaaggataaaatgctgagcaatgtatgacatactgaatatattattatctcatgtttaatagaaccctttttgtgagaaacattcatctttgatgaattaaaatggagaaattaagtaatctataagtgtggcgtgtttggtaggcaagccttcaaaatatgttgtccctggggaaaatttcagaagtcctcagtggtgaaaaggtttaggaacatagatgtatgagagtcttgtataacatccaaaggttggaccagatgcccaagtttggtggtttgacttgccctgtcaacactgaagaatcagattcaccaaaaattgagtacattgctatatttcatgtaagaagctgcaaaaagtagctcagaatcagtgaacacttattgagctcaggagatccacctgctttggcctcagaaagtgctgggattacaggtgggagccaccacctggcttaatctccccagttttgagaaacacattgaggtcggaattacagaaatactcagcaagtcttgccctagagcactataccattagaaaatgcagtggagaccctttcttgcataactgccacatagtatggtctggctcagtctgagcaggcaccaagggcagagaggatatgttttcccctggagaattttcccgtatcctatgaggtgcgcacagaagactacccattcactcaccaggcagtggatgaaattcagcatttgcaataaggaacctaaatgttcttttattgtctgttcatcattttgtaatgttttcacatggtacagtccatcaactgtgacagttctttatctgggatttcagcagaactgggtggaacaaaaagtcttgagcacacaatcttaagagatgtcacctctggactgtttctgcactgccttccctctcccgtaccatcaacaatccaacactcatgtttacctgcacctttcctcacagctgggaaatccttccctctttgccctgccaatcctgcctgggccaattcttccaaattcctgtaaattctatctcagcgagagattttccactatccccaactctattcttttggatgccatcccctactacatatttcctcattaagtcctgtcttttctattcactttggccctaatgccatacttccttactctgtgacctatttgtgtacatgtgacttgcaggtatacagctagacagagtgatagaaaaccttcaggttctctgcatcttatctcccacaaatacctgaaggggacttgctgcctcttattcaattaacaaaccaaatatcgattatcattttgtgtaaaaaaaaattacatgtaacatgttcttatttgtgttttttggtttttcttaaagacaggatttcactctgtcaccgaggctggagtacagtggtgctatcatagctcactgtaaccttgaacttctgggctcaagcaattgttctacctcagcttcctgagtagctaggactacaggtgcacaccaccatgcctagctaattaaatggtgggttttgttttgttttgttttgttttgttttttgtagagacagggtctcactatattgtgcaggctggtcttaaattcctggcctcaagtgattctcctgcctcagcctcccaaagtgctgagattacaaatgtgagccaccctccccagctgcatgtagcgtgatctaatggctatatacttcctgtggaaaacaatagttaggaaaagaaatacacattttgcagattgtcaaaactgctgctttgccatgctaccgttgtgaaaagtgtggctgtacagtctgcctgggtaaagtatggcttcagagtgtagattgcagacagctcttccctggctccagtttggtttctagccttcctcatgattccttgcccacttaaacaatgttaacaccaggaattttgtcttttcaaatatagacaaaactttgactataaacagctgtatcctacttgtctcacatgaaacttatacaggagcggtgtttgtgtatgtgtgtgtgataagcctaaatttagctctctttggaataactaacataaatccagaagaaacttttttctttctttagttgatagtatggattagaaaattaacatgcaagaaggagcttttttagacttctaaataaacttacttgaaagagctccaattatgccccttagcctcttaaggataatccgtgtagacacttgcctttagggtaattgtctctaggctactttcttcccataatctctgtgtcaccatattccaagtccgactcaacttccttctggactgctgtccataaagatgcagactcaaaaggctttttcactatacccttgtttcccaccctcaccactaggctaccactgacctctggctgtgcactgcacagtaagtagtgtgtgtaccctctagaacctgacattcaaggtcccccatacccaatcataatctttcccactacccttgactcctctcaaatacttttctctagccactctgtccaagcatgtattcactagagtctaaacataccatgagtcattctgaccgtctgcctctgcctggagtgttctccatattgctctgagtttgttccatcctgtgtgttcttcaggacccagtgaaaagctcatcttttcactacagtggtttcttccacctctgaagccccacaggactaaatgtgctcaacactcatttacccagatgggatagtgtggtagagtacttactggctacaatgtcctttcatctctgtatgtacacttagagtgtgattttgcagatccttgcaacaagaggtggagtctgtttctctactccttgaatctgggctgtccttgtgactcactttggtcagtaaaacatggcacaggtaactccagatgacttatgagcctaggtctcaagaagtgttgtagcttctttcttactctccattctgaggcaaccatgtgaggaagccccagctaacctgctggaggaagagagatggtatggagagggagagagagatccagtcatcaaccagccatcagatatgtgagtgaagccatcttagaacattcagccccagtcacattggcagatgactgtaaccatatgaaggaccacagaaaagaccagcagaacaaccacctagctgattctagccgaaattgctaatccacagaattgtgagctaataaaatggttattattttaagctactaagttttggggtgaattacatagcaataaataactgaaagggcagggtttgtactgctatatccccagggcctagagggcatgaccatggcaggttttcagtaaaagactgttgtggattactgtcattgtggtgtcactcctctctttgcttaatagacaaccaaacttcccagtcctcttggctctcacaaaagttcaaagcttgacttcaacacattcttccagaataacaccttgaagttcttctttgccccactgcaccagcatccatccatttgcccccatcacagccctatgacagacagttcattacaccccacctcagctccatgttgcgtccctcctacttacccttattctctaaccctgtggggtcaacccattgaccacctcagtgccataaagctcttctcaacttcccagccccccatccataccctgaacgcgcactacctgaatcacatgtgcttataattaggaggaaccttagaaattgagacagccccttctagttatgaatgaggaaaggaaggcccagataagaaataataataaatggcttattcaaagtcacatggaggcaatgtcaaaagtagagcccacatctcacacagatgattacctagtggattgcctgtgttttcctgcatctggtgcttggtttatgtgtaggacaatgcctttaatgattaaactatgggaattctttggaggcaggcataataccttttacttatgccttttctcattgccagcatatctccacttaaagactaaccagcgactactagacacatcagtagtcaataaatacctgttgattaattgacattttaaaaacaattatgcctggaactttttaatatattgtttgtggtagtgattacaatagtatacatttgtcaaaactttaactgtacgttaaaaagggtaaattagagtatatgtaaatttttttttttttatttgagacagagtcttgctcttgttgcccaggctggaatgcaatggcacgatctcagctcactgcaacctctgcctcccgggttcaagcgattctcctgcctcagcctcctgagtagctgggattacaggtgcccgccaccatgcccagctaattttttgtatttttagtagagacgggggtttcactatgttggccaggctggtcttgaactcctaacctcaggcgatccacctgcctcggcctcccaaagtgctgcgattacaggcatgagccactacgcccagcctatataaatttttttaaattaaagcgtaatcaaagcaattatgctgaagaaatccatttatttgataaatgtggctaaatatataggtaacatgttactatgtgaaaagaagtttggccctttgaaaataaacttgcatataataggcactcaatgttagtttccttcttccttgtataccaatgcttcatgatcacctgtcaaggctactaaagaaagcattcttgtactagaagatagctggatctgatctgacttctaagattctatgatttgtttaaaaggtaaataaatgactgttttgaaatgcctgtgtaaagtaaaaatacgtaagcactacaacactgttctaaaaggtggccccctaggaccttaattttactttcaaagacttagttacaaaataactagtcccctgttaatagaagttacttaaagcaaaaggatgtctgaatatcctttcagtgtcgtactggagcattggctgacgggcccacccaagaattacttagttctctaggggattgcatctttgtttggctcactgttcactaatgattagagtcgagaccttttcaagcaacatgttaacttatagatttttgcctggtagagatgtaaaattttctgtttggtagaagaaattatcctaaagactacagattaattttcctatagggcataaccacttttctaatttagcaattttattcgagcattctttcaaggcctatatatagcaagtctctcaaatattctttgaataagctttaaatcctgttagttccctaataagttaaatgtctttgacatgtgttcagtctacatttgtatgagtcatgtttttaattttgaaaattatatttcgatacccaaacattctacaacattgcctgtgggtcatgacccatcctgtacagagtccctgaaatccattactgactgttggttttgatgctgtgctagcaccttcaaatacctttgtgatcatgctagtacttgaagaggtcttcacaggaataattttggatacctctgcaggtactcaagaacactgcagaaagactttctgggacttctctcacaaaatgagaaactaatgttccttcctatcatgttattgttctgtctataagctgagaggatgacattaagagcctttgttttaggagatccatggcaaacagactcacagggtctttcttgttaaacaatatttctataatctggctttcctagtaatggccataaaataactatatcatagcaataaaaattgataaactatcagctgcctcaaaaatctaatagctttggcaaaatatactatagctcatgtatatcctctttttctctaacagattttaatacttttccttttcatactactgaacagcataatcaaatcaacaaattcagctaatggccattgtgttgtgggcactgtgcttggccctgcacatccccatgttccctctcccctttgtcaaaaactagctccactggttgttaatgtcaatcactgatttgcggttgtccagaataaaaatggagagcagagcccaaacggagggtggcagtcggccttgtcattacccaaagaactaaaaatggagtaatgcaaaagagtggaactccttcacattaacaaaagcttagttatatacagtataagaccactgaatattaaacacacaaatttgaaatatgcagagaaccaggaagaacaggttaaaacatggttcactaattctggtatttataagtattctgagtcagcttgacaactttattgaaagaagcatgaaacatcttacaataaaaattcaaactcagaagtaatccaggtgtgattcccattcatacaaaaggatcaaagtgccaacttcgtatgcagtatagggaatcctctgcagaggaagtgtgaaccaaacttttaaaataccagggaggatgaggtggagtggattgagaacaggagtggaagaaaaaatttcaacccacttttcctggtgattatttaaaaacaaaaaatctactatttaatgtttcacaataaagtgttttagaaaaagtaattagctcggccagcttctgccccaggatgtagaaagctggaagcagtgttgttcacatccttaaaattaaaaaaaaaaaaatgctgggctaatttcaaattcatgacttttgtcaaacccatcagagagaagtattttgcccaagtattagttcagagaagtatttgttcaagtgtttcttatttaagttgggttgtttcttactgttgtttttgaggttttttccctaatagtctgggtaaaaatcctttggttatttgatttatcagcaaatattttttgtatgtaacttggcttttcattgtcttaatggtgtcattcactaagcaagattttcattttgttttttttaagacggagtctcggctctgtcacccaagctggagtgcagtggtacaatcttggctcactgcaacctctgcctcccagattcaagcaattctcatgcctcagcctcccgagtaggtgggactacaggcgcacaccaccacgcctggcaaattttttttttttttgagacggagtctccctctgtcacccaggctggagtacagtggcgcgatctcggctcactgcaagctccgcctcccgggttcaagcgattctcctgcctcagcctcccgagtagctgggactacaggtgcctgccaccacgcctggctaattttttatatttttagtagagacggggtttcactgtgttagccaggatggtctcgatctcctgacctcgtgatctgcccgcctcggcctcccaaagtgctgggattacaggcgtgagtcaccgcgcccggcctttttttttgtatttttagtagatgtgaggttttaccatgttggccaggctggtctccaactcctgatctcaagcgatccaactacctcggcctcccaaagtgctgggattacaagcctgagccaccgtgcccggccttcttctatgtttataagaaaaacttgcttataaaagttttataattttacatttatgtctattttgagttaatctttgtaaatggagtgaggtttaggtgaaggtctatttttgtgtatatggatgtctttaatttacttttgcatctttgttgaaaatcagttgcctatatttatgagggtcagtttctggtctctcttttgttctgttggtttattctcagtctcactctggctcccaggctggcgtgtacagtggtgcgatctcagcacactgcaacctccacctcccaggttcaagccattctcgtgcctcagcctcccgagtagctggtattataggtgcccaccaccatgcccagctaatttttgtatttttagtagagacggggttttgccatgttggccaggctggtctcaaactcctgacctcaagtgattcacctgcttcaacctcccaaagtgctgggattacagacatgagccactgtgcccagcttgctggtctgtttttaatcactttgccaataccactatcttgattactatagctttatagtaagttttaaattcaattgttattattcctccaattttattcttctttttaaaaagcgtttttggctcttctagttcttttgctgttctttataaattttagaagctgcttgtctctctctacaaaaaataggctgtggactcttaccagtctgtggcctgttaggaaccaggccacacaggaggaggtgaacagtgggcaagcaaacattcctgcctgagctccacctcctatcagatcagtggttgcattagattctcataggagcacaaaccctgttgtgaaccgctaatgtgagggatctaggttgcacactccttatgagaatctaatacctgatgatctgagatggaacagtttcatctggaaaatcatcctcccttcccccgtccgtggaaaattgaaacctgtccctggtgccaaaaaggttggggactgctgccttattgtacaggctgatacttccagtatgacattgaataggagtcatgagaaagggcatctttttcttgtttcaactttaagtctttcacttttttttttttttttttttttgaggcaaggtttctctctgtcacccaggctggagtgcagtggcgtgaacacggctcactgcagccttgatctcctgggctaaagcctcgacctcctgagattacaggtatgagccaccacgcctggctgatttttctttttttagatttaacgtggttgaatacattgatttttttttttttttttttgagatagagtctcactctgtcacccaggctggagtgcagtggcacgatcttggctcactgaaacctccgcttcctgggttcaagcaattctcctgcctcagcctcctgagtagctgggattacaggcgcctgctaccatacccagctaatttttgtatttttagtagaaacggggtttcgccatgttggccaagctggtcttgaattcctgatctcaggtgatccgcccatctcagcctcccaagaatacattgatttttgaacactgaacccaacctgccttacattcctagggtaaaccccacttggttgaggggtattattatttttacatattgctgttagatttgctaatattttgttggaggtgtttgtttctatgttcatgagggatattggtctgtagttttctctttttgtatgtattgtctgtgtttggtatcaaggcttcataaaatgagttgggaaagcttccctccttgcccatattctggaagagatcttgtagattttttttttatgtttgttggaatttgccagtaaaactatctgggtctgggcatttcttttttaaaaggttttaaactttgaattcagtttccttagtagttatgggagtattcaggttatttattttattttcaatgagttttagtagtttgttatttacaggggattgctccatttcatttaagttgtctatgtgtgcagttgttcatagtgtccatttattatccttttaatatctgcaggacctgtagtaatatcccctctttcattcttgatattagtaatttgagtgttcttttttgcttttcaattgtgctagaggtttatcaattttgttgatcttttcaaagaaccaacttttggcttcatcgatttttctctgttgtttttctgtttagtcctttatcttgactgtttcctaatcatcttgctttggatttattttgctcttcttttcatagttccctaaggtaaaagtgtaggttgtttttttgagaccttttttcctcctaaaagagaatttaatcctataaatttctctctaagcactgtttccactgtagtccacaaaatgggttatatttttggttttcttgagttcaaaatattttataatttatcttgaaagtttctctttgattcgtggattatttaaatatatgctgtctaatatccaagtgtttggagatcttcctcttatgtctctgttgttgattcttaattcctttatggtcagggaacatgctctttatgatttccatattttatattttggaaggtttgttttatgatctaggatatggtctatcttattgaaagaacacgtattctgctattttggggtgaagtgttctgtacatgtcaggtaatgacggttgatgatggtgttcagttcttgtatatttttgctgattttctgtctactagttctgtatattaattagagtgttgaaacctccaagtgtaattggatttttctattattttagatcttagagttttgcttcacgtattttgaaacactattgtaaatgtttacacatttaggattgttaagtcttttgggtatgttaacccttttaacattatgtcatgtccctctgcatccctcttctatcttggtaattttctttgctctaaattactccttttggccaggcgtggtggctcacgcctgtaatcccagcactttgggaggccgaggcgggcagatcacctgaggtcaggagtttgaaaccagcctgaccaacatggtgaaaccccatctctattaaaaatacaaaaagtagccgggcatggtggtgggcgcctataattccagctgcttgggagctgaggcaggagaatcatttgaacctgggaggtggaggttgcagtgagctgagatcacgccactgcactccatcctgggcgatgagcaaaactgcatctcaaataaataaacaaataaataaattgtttcttttaatcagtgtttgcatcacatatctttttccatccttttgcttttcacttacttatatcattgtatttgaagtgattttcttacagatagtgtgtagttgggtcatgttttaaaaatccattctaaaaatctgtctttaaattgtaatgtttagaccactacatttaatgtaattattgatatgattgttttacatctgtcgttttttatttttgatacctgtttttatttcctcttttttcccattttcctgtcttcttttggttatgtgaacatttttagtgctactacatttttatttacctactgtgattttttagttatctctttgttttttgtggttgttctagggattataatatacatagttttatacagtctacttagagtaagtgctttaccacttcaagaggaatgcagaaaccttaccaccctataggtccctttatcctcctttctttatgtcatagttgtcttatatattacacctatacctgttgaaaattccttcacacattgttaccatttttgctgtcagccaccaaacatattttaaagaactcaagaaaaggatagtatattgtatttatccaaatattcaccatttatgttgctcttttcattcctaatattctaagtttccttctggtatcatttaccaattgtctgaagaacatcctctagcagttcgtttagagtaggtctgctggctataaattctcatttctgaaggacatttttgctgagtatagaattctgtgttgacattttttttacccccagcacttcaaacgtgttgtgccacttccttctgacctccatggtttcttttttgagacggagtctcgctctgttgcccaggccggtgtgcagtagcatgatctcagctcactgcaacctccgcctccctggttcaagtgattctcctgtctctgcctcctgagtaagtgggactacaggcacgtgccaccatgcagctaattttttgtatctttagtagagatgaggtttcaccatgtttgccaggctggtctcaaactcctgacctcaagtgatccactcaccttggcctcccaaagtactggggttacaggcgtgagccaccacacccagcctggcctccatggtttctgattaaaaatccactgtcattctaaatgttgtacccccataaggtaatgtaatagctgctgctttcaagatttttttctttgtattactttcagcagtttgatttaggtatgcctggacgtgggttaattttttttttttctgttgggatttttcactgctcaggctattgaaagtataagtcagctctagattttataatagactggaataatattgataaaagacttcttttgaaagtggcttggcatcatagggaattgcacagtgaaatatataagtatttactatacatctcagacagaatttaacgttagtaaattctagttgtaactcctgctctctttcaatgatgtggaagattgttaaaaacggactagaatggaaggaattaagccccagaaaaaataagtgagttttgtagctttacatacctagtaagttgcaggtcttattttcaggtactgtttccactgtaatgtattgctgtgtacttacagaattttcgcctccctcaagctgaaactttaacataggtttatggtgagatactggtttgaaatatctactttttatcaggaaaagtctaaattttcagtttcttcagtgaggcatcaagtcttagttaagagcacgattggcaccctgtggcctgccagccaaatctagtctgctacctgtttttgtacagtccataagctaagaatgggcttttcatttttaaatggttgggaaaaaactcagaatagttcatgacatgtaaaaattatatgaaattcaaatttcagtgtccataagtcaaattttattggaacccaaccacatcagtttgtttacatattgcccatggtttattttacactacaatggcagaattgattaggacacagaccaaatagcctgcaaagcaaaaaatatttactgattagccctttacagaaaaagttcgctaactcctggtttacaataatgttgagtgaattaggttagagtgtcagtaatctgaactgtgtgaaaagggtagctaggattcaaactttactctttgaataagtatcttagatgtgagaaaattagaagatgagagttaactgattataatcctagtctattaacatatattaaacattatcagtcctacagcaatattccacattatctgtactttttaaattagcccatcagatcaggagaggttgataggaggaaaagttggagttgtttctacctaggtatttgaaaattgttggaggcattgagactcatgcataagggacttaggaagcctttactggctggaggagataaaggctcttatttaaaattctgtgttttcctggttatatttctgttttcctagagttgggctttttataggtctagttagttacctagttgcctttctgcaggcttcttttgtgagggtgtttctctatggctagtgggaggaaatggctggtcatttttaaatgaagaggaaagcccaactcttaccaggacctcagcctgacattgtcccttacccctatagaggcctttcttctgagcctatagacccaccttgccagctgacatcagaagcctattgagatgtccatagcctgttgttcccaacctcttcccgttttctccccttcttttcaaagaccaaatgagctacatctacactacgtatacatttaaggattttttttaaggcacaaatcatcttgttacccactgaaatttaagcttagttgggtcacctaagaaacaacctagaaactgccaattttattttttcatttaaaaatataatttcagcttttattttagattgagaagatacatgtgcaggtctgtcacgtgggtttgttgcatgacatcgaggtttagggcacagatggtcctgtcacccaggcagtgagcatagtacctgataggtagtgtttcagcccttcctcttccctctctccccatctagtagtccccatctttatgtctgtgtgtacccagtgtttagctcctgcttatagacgacaacatgcggtatttggttttctgtattaattcacttaggataatggcctccagctgcatccatgttgctgcagagaacatgatttcattcttttttatggctacatagtattctatggtatataagtaccatattttctttatccagtcctcctaggttgataccgtgtctttgctattgtgaatagtgctgtgatgaacatatgagtgcatgtgtctttatggtagaataatttattttcctttgggtgatatacctagtagtggaattgctgggttgaatagtggtttgatttcacattctttgagaactccccaaaccactttccacagtggctggactaatttacattcccatcaacagtgtctaagttcctttttctctgcagcctcaccagcatctgttactttttgactttttaataatagccattctgactggagtgagatggtatctcattgtggttttgatttgcatttctctgacaattagttttgttgagcatttttttcatatgtctgttggccacttgtatatgacttcttttaagaagtgtccatgtcctttgcccacattttttttttttttggatacagggactcactctgttgcccaggctggagtgcagttgtacagtcagtctcagctcactgcagactcaagctcccaggctcaggtgatccccctgcctcagcccctcgagtagctgggactataggcaggtgccaccatgcctggctaattttttttttttttttttgtagaggcagggtttcaccatgttgcccaggctagtcttgaactcctggtctcaagcaatctgcccactttaacctcccaaaagtgctgggattacaggcgtgagccattgtgcctggccttttgtccaccttttaatggggttgttttttcacttgttgaattttttaagttccttatagattctagatattagacctttgttggatgcacagtttgtgaatatttttctcccatttgttagggtgtctgtttactctgttgatggtttcttttgctgtgcagaagctcttattaggtcccactggtcaatttttggttttgttgcagttgcttttgaagacttaaccataaattctttggcaaggctgatgtccagaaggtatttcctagattttcttcttgtatatttatagtttgaggtcttacatttaaatctttaatccagcttgagttaatttttgtatatggtgaaaggtaagggttcagtttcttcggcatatggctagctaattatcccagcaccatttattgagtagggagtcctttccccgttgcttatttttaactttgtcaaagatcagatagttgtaggtgtgtggctttatttctgggttttctgttttgttccattggtctatttgtcttttcgtaccagtaccatcctgttttggttattgtagccttatgttttgaagttgggtgatgtgatgtctccagctttgttctttttgactaggattgctttggctatttaggctcttttttgttgttgttgttccatatgaattttagaatatttttctaattctgtgaaaaatgatgttgctaatttgataggaacagtgttgaatccgtaaattgctttgggcattatggccattttaatgatattgattcttccaatccatgagcatggcatgttttttcatttgtttatgtcattgtgatttctttcagcagtgttttgtagttctccttgtaaagatctttaacctccttggttagatgtattctaggtattttatttttgtgtgtctggctattgtaaatgggattgcattcttgatttatttctcagtttgaatgttattggtgtatagaaatgctactgattttcatatattgattatcctaaaactttactgaattcatttacagaatctaagagtcttttggagaattctttagggttttctagacataagatcatataatcagaaaacagataatttggcttcctcttttccaatttggatgccttttatttttttctcttgcctaatggctctggctaagactcctggtactatgttgaataatagtggtgagaatgggcatccttgtcttgttcctgttcttaaggggaatgcttccagcttttgcccattgattatggtgttggctttgggtttgtcataggtggctcttattattttgaggtattttttttgatgcctagtttattgaaggtttttatcatgaagagatgttggattttatcaaaagcttttgctgcatctatttggcataaatgcatctatttagatgatcatatggtttttgtttttaattgtttatgtggtgaatcacatttattgaattgcatatgttgaactaacctagtatcccaggaataaagcctacttgatcatggtgaattaactttttaatgtgttgctggatttggtttgctagtattttgttgaggatttttgtctaccttcatcagggattttggcctatagttttcttttgttttgcctttgcctgatttggttatcaggatgatgttggcttcatagaatgcattagggaggagcccctcctcctcaatttttttggaataatttcagtaggattggtactagttcttctttgtatatctggtggaatttggctgtgaatacatctgttccagagcgttttttggttggtagattttttttattattgatttagttttagaacttgatctgtttagggtttaaatttcttcatgattcaatcctgggaggttgtatttttccaggaattcatccgtttcctctagattttttagtttgtgtgcatagaggtgtttataatagtctctgaggatctcttgtatttctgtggggtcagtgtaatgttacccttgtcatttctgattgtgcttatttggatcttctctcctttttgttagtctagtaagcagtctatcagtcttatttagcctttcaaataaccaactttttgttaattctgtgtgtggatttccgggtctcagtttcatttggttctgctctgattttagttattttcttctgctagtttttggggttcttgtttttctagttcttctaggtgggctgttagatcattgaattgagatctttctcacttctttttttttttttttgagactgagtattgctgttgtcgcccaggctggagtgcaatggtgtgatcttggctcactgcaacctccgcctcctgggttcaagcgattctcctacctcagcctcccaagtagctaggattacaggtgcccaccaccatgcccaactaatgtttttgtatttttagtagagatggggtttcaccatattgtccaggctgatctcgaactcctgacctcagatgatccacccgccttggcctcccaaagttctgggattacaggagtgagccaccacgcctggccttttctcacttcttgatataggcatttagtactgtaaactttcctcttaacactgccttttttacatcccagagattttggtataccgtgtctctggaaaccaccaattttaaatgttctgtacacattaatttttaggctaataaaaatgttactctcttgatttggaaacttatcttttaggtgacagaaaaacaaattttgtactattcatgcatatgtattttcaatacatatgtgtgttctttttgtttaagaccgggtctcactctgtcagccaggttggagtgcagtggcataattatggctcagtacagcctcgacctcctgggctcaagcaatcctcccacttcagcctcccaagtagctgagactacaggcgcacaccaccacacctggctgaatttttttttttttttgataatttttgtaaagatgagatttcaccatgttgcccaggctagtctcaaactcctaggctcaaacagttcctcccaccttgacctcccaaagtgctgggaggtgcccagtccatatgtgtattttatagctattcactcttggatctgttactaccatgaaatacagctgtcctaaatgccctgggccacatcatccaggagggtaaaaccagagtctggatgatagtcactcatagactttagctgttatagttctccagcttccagagcagtcttcagctatacccattttgccctggaggtatctgctatgttttcctgactaggtactttatagcacctaatgtcccttctctcttctttcctcttagcacttttggtgacctcttgggcagggtctttcctggactactattgatttcaacctctggaagcttctcttctattaatatgtttgcacagcccccagtgctgctgctaccactgacttgcttgacttcccatttggctgacccactcatgcagtactcaactaagggtactagtgtctgtgctaaggttcttggctctctcatctttctgctgtagctgggactcctggagctgtgggagctgcatgtcagcttgtttaggtttctgtgaagagcctctcactaggattctgaactgagtccttgcaagctagctgagctaaagaatgaacctgagtaacacacttcacacagttttatgaattactgctccctcacgccttggaatattgccaccagattcagttggtgagctaccattttctcttggggccccttctttaacaggagattcctgttccctcaataatacaaatttctggtaggataggccgctcctaggcactccctaacaggtgagaatcctcctggtgtgttcatctccttatgcttaagtagggcatatgtgaggatttgtgtatgtattgatagtatattccttatagtgcatacattcctgttggaaagcaagacttcagagtagcaggtaaagaattacgattactaaccttgcaaaagagaagatcaagagggtgccctttcagtacttggaacattttaaatgaaaataggtagtagccagttataattatgggtactgagaataatataaagactttcttgctatgataggtttaagaaaataaggaagtatttctgacaactgttgaaatgggtcccaaaggaatatagtagaatttcctggctaggcctgagaaaaaaatgtccatattctcccttttggaagttaaggtaaatgtagaggacttaagaggcagttggcaggatgggggtgggggtgtgttcttacgtcatcacccagccctcccatggaggtagcataatgtagtggaaagatgtgtctttgggaatcagtccatgggttcagatctcagctccctgaagctgttctgtgtaaatagatactatcatgtggcatgtatgattaaatgaattaaaatagtgcctccatgagtatatcctcctgtacttggggagggacttgaggtcacctagctcttgagatctgatctgtatgagctaagatggcagtttattgatatatagtgaagattcaactgtgattgcattttcatatgatggagccacctcacaccggattgcaagagccgatttgcgtgcatggctttcaaattccatgatgagtgacatcatcttagtagcttgaaattgaccatcttgggagtatctatatcacaggaatcagtaaactacaaatcagggctttttctccctcttgaagagcctgatgataaacatttatcagcatatcactgatactatctctctgtctttgggtgagttgtgtggtaggccaagccatcttcacaagattacatcccaagtgtggacttggaccagggactttagttccatgattctcatgtttgatgccatcagcatgagagttgcttttggtccttttcttttctcttcttttcttttcttttctctttgagacggagtctcactctgtcacccaggctggagtgcagtggcacaatctcagctcactgcaacctccccctcccaggctcaagtgattctcatgtctcagcctcctgagtagctgggattataggtgcgcgccaccatgcccggctaatttttgtgttttttgtagagacagggtttcaccatgttggccaggctagtcttgaactcctggcctcaagtgatcacctacctcagcctcctaaggtgctgggattacaggcatgagccaccgcgcctggccttttggtctttttctgaaactgcggtgttcttgtccttgagcccggaggggtagatacttggacatggactgtatctcctctggaccatgcttacataggaatttcaagctgtgtaactttcgtttttgtactccttcagactgatcccccttttatttttagtctttttccatcctaagtagaatataaactacagttgcttgtttttactaaactgtagtcatattctaatcctgcctccctgaaatgaagtcagacgtaactgttttttgtatccatgccattcccaaattaatttggagttttggatattgatgagcttttttggctcctatataggcaatatcagggtttgtccccttagctgtccaattacatctgaatgcagattttaccagtttatctttcataataaaaatctgcattttgctcatccccagcatgagaggtaccgtgccgtttggtccatgtcctgataatgtgtcacttccaacatggagcctccatgccgtctctggacagatttagtcaatattctatcatgcccccaggaaatttggagccttcctttcttcctctgttatacaacctgttactctgggttctggtaatttgttttcctttcttccttatccctccaccagagcccacgttcctggagattacagacctgcaattatctgtccctggtatctgataccacaactgtatcaggcctctagatgaatttggcatgtggatagattaataaaattatgtgaaattaaagggtcggtgaaagttgttagcctgtgggagtttttaagattaagatcactgtctaaattcaagttgtgtactgtcagttaagaatcaattcctgggcagctttttgcctcctttataatatttctcagctttgataattgctaaagtatgtgaaagtgcctttggacagattccctatataggaaggagcacgcaaaggaatgtcactcctgacctacacctttgtcctggaattatgtggataaataaactaatccttctatttaaaggatggtttcccttctatggatagacaggccagattgtttgatgctaactcatgaaattctgcctgtgtaaaggatgcctgtattctccctgcattcattttgtgggctcgctttatttgcatcagttttgacttaagtgttcctaatcattggcaatgaagatacaggttaaatacaatatattattgatagttcagcagacaagaatgtagagagagaatgcaaagaaggataaagatagtgtcaaagagggaaagccttaaatatatgtacatagagcataaaggaaagtatatagcatataagtagaagtataatatacctgaagaaaaagtgaacaagtcataagggtacaacgctattaataatctcaaagtgaacttacacattcaaccagtgccccagtcaagaagaacattataagcacctcagaggccttcttcctgagtacccctttcttctaccgcaggggttaccaggttactgctatcttgaattctgtcactatagactaatgtcattttcacactttgtgtagatggacaatacacatacacaaacatatcacaattttttaaaaaaactctacttttttttttgagacagggtctttgtcacccagactggaatgcagtggcacaatcatggcccactgcagccttgactcactggacttaagtgatcctcccacctcaacttccagagtagttgggactacaggtacatgccaccatgcccggctaatttttgtattttttttttggtagagatggggtttcgccatgttgcccaggctggtctcaaactcctgggcttaagtgatctgcctgccttggcctcccaaagagctgggattataggcatgagccaccatgcccagccaaatctactctactagtgatgaacatttctgggttgtttctagcttggggctgttacatatagtgcttatctgagcattctcatacatgtcttcaggaacatttgtgtacatttctgttgtatatataattaggagtaaagtagctgggtcatagggtgtgcacatgttaagtaagcttcagtagctattgtaaaacagctttccgaagattttatcctaatttacattctcaccagcagcataaagaggcactttgccaacaacacttgtattgttgatgtttcgaattttagccattttgatgagtagtagtggtgacttccttatttctcttttattgaggcataatttacgtatagtaaaatgcagagattttaagagtacagtttgagttttgacaaatgtatgtacccacatagcccacaccctaatcaagatataaaacatttctatgtccctgaaagtatcattgtgtctcttttcagtcagtcccctctaagcggaggtagctactcctattctgatttctgtcaccatatagtttttcctatgactgaacttcatgtaaatgaaataatatagtatatatattcttgtatctggcttatttttggtttattttcctcaatataatgtttctgagattcatccatgatgtagaggaatattcatatcagctatatttctaataaccaaagactggaaacaacccaaatgccctccagtaagtaaatggttaaactgtggtgcattcataaaatgtaataaaagaaacaaactattcataagtggatcaacttgggtggctctcaaaagcattatgctgaatgaaaaatagcctatctcaaaagtttacatactgtatagtttcacttatgtaaaattattaaaatgacaactttattgaagtataatttatataccacaaaattcacctgcataagtatataattcaatgccttttaatgaatttactaagttgtgcaaccatctccataactcagttttagaatatttccatcacgctaataaaatcccttgtactcatttgcagtcactccactcttctcccctcagccctaagcaactactaatctactttctgccattgtagatgtggacatttcatataaatagaagcgtataacatatggtcttgtgtgtccagattctttcacgtagtataatgttttgggggtttatctgtggtggtacaacatatcaataattcattcctttttgttgctgaataatattccatcatgtggatgtaccacatcgtggttattcctttgctagcagatgggtatttgggatagttccagcttttggttctcatgaacagtgctgcagtgagcattcatgtacatatccttgtgtagacataagttttcatttctcttgggtagaattttaggagtagaattgctgggctgtatgttaaatttatatttaattttttaaagaaactgccagttttccaaggtggctgaacccttttatagtcctaccaataattcctgggaaatatagcttgtgtacttgaaaagcatgtatattttgcttttcttggagtgttttgtagataccagttaggtcaatttttaaaatagttcttgtttaggttttgtatattctttatttttttctagttctatttattaccaagagtggaatgttaaactctgttagtgtccaattgtctgtttcttcagttctttgtctttagttttcagcagtttgatcatgatgtgcctaggtgtagattcctttgtatttattctgtttggtgttcttagtgtcttggcagttttaaacttttttttatttttattttttatttttatttatttttttgagacagagtctcgctctgttgcccaggctgtagtgcagtggcacagtctcggctcactgcaacctccgcctcccgggttcaagcgatttctggctaacttttgtgtttttaatagagacggagtttcaccatgttggccaggctggtctcgaactcctgacgtcccagctacttgggaggctgaggcatgagaattgcttgaaccccggaggttgaggttgcggtgagcggagattgccccactgcctccatcctggcaacagagtgagactccgtctctactaaaaatacaaaaattagctgggcatggtggcagtcgcctgtaatcccacttactcgggaggctgaggctggagaattgcttgaacccaggaggcagaggttgcagtgagccgagatcgcgccattgcactccagcctgggcaacaatagtgaaactccgtttcaaaaaaaaaaaaaaaaaaaaaatttcaactacccagataagtcaacttggtatcttaagaataaaaagatatatacatgtacaaaacaagtccctttaagataaaataccatttgcagataagacctcttaagagtaaagtaaatcaataagagatgcttttactatgaaatacacaattctttctccagatagaaactcaaacgatttaaaaaaacgatttcccattgttttatctgctgctgtgagttgtttccacactgaaatttttacccacatgtacccattatacatttacaataacgttcatgtgatttaaagtaatcatcccaatttattagaaggaaaaacaacctttatcccaggttttcgtaacaacgtaacatgccttatatgtgaggcatgtaaacctcacatataaggttaaacacacagaaatgaccccaaacttactgagcaagttcaaatccactgcacaccaacttttaatactgtgctaacagagggcaggcactgtactggccaccagaaagaggacagacaaggaaaaaactgagaaaccaagtcctttggctcccacagagccagggtcacaggaccaggtgcaccaaacactgtggcttgggtgatcacagcctaaaactgttaaccaatgatgtgtgacaaaccaattagaggggggtttgagttaatcccaagatcaatcaaataggatatgggtgtgacatgaaggagggttactgttaaaccctcacctctggtcagatcaatgcccatggcaaaggagcagtcagacatggaagttaacatacaagtcagtactgactttgaaggcaacaaaaaatgagggaaaatgaaatggcaacaaatttccctggggagaaatcaaagggtctggtagataaatgccaatacatgttaaatcccaaaaaaatgtatttggcctccccagcagaggttctcaacccccattacacatgggaatcatatggagaacttacaaaaatcccaatgtccaaattgcacccattaccaattaagtcagaatctctcttttggaagaaccagtttttagatggattgctttttctgtttttctgtttttgattacattgacttttgttcttttattatttccttccttcacttactttgggtttatcttgctcttctttttctagttaaagtgggagcttagattattcatttgaggcctttcatcttttcctcatataagcattcagtgctctaaatttccttcttagcactcatttaagttacaccccacaagtttttctttttgagatggagtttcgctcttgtcacccaggctggagtgcagtggagcgatcttggctcactgcaacctctgcctcccgggttcgagcaattcttgtgcctcagcctcctgagtagctgggtgcctgccaccacactcacctaatttttgtattttaagtagagacagggtttcgccatgttggccaggctggtcttgaactcctgacctcaggtgatctgtccgccttggcctcccaaagtgctgggattacaggcgtgagccactgcgccctgccacgagttttgatatggtatattttcatctacattcaggcattcaagccactgtactgatgagaagtgtgacgcttagtttccaagtgtttggagaacttcttgtagtctttctgttttgttttgtttttttccttttttgagacagagtctcactctgttgcccaggctggagggcagtggcacgatctcagctcactgcaacctccgcctcctgggttaaagcaattctcgtgcctcagcctcctgagcagctgggattacaggcatgtgccaccacgcccggctgatttttgtatttttagtagagaggggatttcaccatgttggccaggctggtctcgaactcctgaccttaagtgatctgtccgccttggcctcccaaagtgctaggattagaggcgtgagccaccacacccagccgtctttctgtttttgatttctactttgattctattatggtctgagaatatactctatatgatttcacttcttttccatttgttgaggtttgttttatgacctgggatgtagtcaaccttggtgaatgttgcttgtgcacttgaaaagtaagtatattatgctgttgttgggtgaagcattctataaatgtcaattaaatctggttgactggtggtgttatttcttctatatctttgctgattttctgtctactggttctatcaattactgaaagaggggtattaacattctcaagcataattgtgggtttgggtttgtctatttctcaattcaggtctgttgggttttgctttgtgttctttgaagctctgttatgtggtgcatacacatttaaaattgctatgccttcttggtggatcgaccctttgtatcattcttttagtccctggtaattttctttgctgtgatatctaattatctgatattagtatagccactccagttttcttttgattggtgtttgcatgatattttttttccatccatttactttttattttgagatacggtcttgctctgtcacacaggctggagtgcagtggcacaatcgtagctcaccataacctccaattcctgggctcaagcaatcctcctgcctcagcctcccaggtagctaggactacaggtgtgcactactgtgcctggttaattttccatttacctttaaactcactgtatcattactttgaattggaatagactgaaatgtgtctactccatcctgtctggaatgggaagtttgctctctgcactatttttgcaactcctgtctaaatttattatctcaaaatctcttaactcaaaataaaaaattaactcaaaatttaaaaattaactattaaaaaagcaagtatatgataaaaagagcagtttattaatgttcctacatatctggaaagtattaatttgagaaagagaaagaatcaacctatcattttgtgagattttcacttactgtactcttccagagtgaggaaacaaacaggctaagaaacgggtaaaacttacaagcctggggataattgggaggctgaccccctatctgtgggcccagaagaaagcaagtcactttgtaacaaggaagtatatctatttttcctcaaaagataaatattcaccacacctggtattcctggttttgccttgggagcggggagctgttttctcagtccttgcattttctagtctccctgcctggattttagtcatttcactacttattagcattctgaaaggttaacagaatttaaaatgtgtaactcgagaagaaataaaaggctaatcagttagttacaacacttgttagttctgtaaaagcaatgatgagtgagaaagctggaaagtactgactaaaatatggctttctgagaattagttgagttcagtcatttttgctgttcatgctccagtagccgccccaggaagccagatttggaaacagtacctgagtcatttgagacaaaacaacaagttacccctgaattgttttaaatgttaacgaaagagatcactaaaagatctaagtcatggatggaacctaattacctccccttggccctagaaaaccaaaaacatccagataggaatatgaaacacagaagaaagcaggtttttcctttctattcatttctcctattatcttagccctattttaattattctgagttaacgccattttacaaaaatggacagataaaaaattaaactcaaaattttgaaacaaagactctttgttgctgtgtgtggaaagtgaccatcttgtcaaaaaaatacctgtgagcctacagcatgattgattgttcaatgtgatgaaactttcctggaccctaagcctcaatattttgttatctgaaaatctgcagtttaatttcatccttcaagatcaaaggcaaataaattaacttggtctagtgattccacaaatctctagagagctgccaggcaaggcagatccacagaataactcattaacttataatgcttaaagcaactttgggaaaactgttaggaattgaacacaggctaaaactcctgaaggcactcaccaatgtatctttctacacagttgaccagaaaacagctaagctctgcttgactactccagtgaccaggagctcactatctaacaagcaatttattctaatgtctagacagctctaaacatatggatgattttctatgaacagaaaaaatctgccttttaacttccaaattctgcctttatgctggatttctttctgttaacaggttccaacctctctacctttattcccaaaccatctcttgaccctacttcatttttctctagctaatatccactttctttctttctttgccttctcttgcaaactcctcaaaaagtagtttacagtctgtaactccttccttactctcaatctctccttaattgcttctatctcaccagaattcttggaaaaatgtgcatacttcccaaccctcatctttaagtatctgtatgctgcatttgacacgctgatcactctggccttcttgaaactactcctttggcttccagaagcttttttcaagttccctgtgttgctaacactttttttcttcctctaaccatcttgtaggtgatggtggttccctgaagtgccctacccacatgcttatggctcccaaaacaaggtcctctggtccagagctggagatagaaaggaaaggcgaaagagacaggaaggtaggagggaaaagcaaagcaaagaaggaaggaagaaagaataggaaagatacatcaacaaaaagaaaaaagtcctgacaaccagatacatcaagctggaagacgatcaacactgaggaaactatgttctgttttccactagttcttcctaccttctaactggtctcagttggcaccttcctctatgccatcacaaaatctagaaaaatctctgaactctttcctatatcttaccctggaacatccaatcaattattaagccctgtcagttaacctctaaaataatcttccaaatcaatgttcctttcccatctcagctgtcattttcttagtttaggacctatctatttcctcaaacctagaatgcaagagcagtttcctaactggctttaaaagtcctaatcttgttgtccccaaatttaccctccacccaactgccagagacctatctaaaacacaaattggatcatgtgcctccacggtcaagagatttcaatggctgtcctttgctcctaggatctttattaaggtcctcatcaaggccaacacagccctccacaatcaagccatgtctacttctgcagctttatccctcaccacattctgccccagttttatgctcaaacaatgctgaacctctgcagttcctacctctaggctttataccatcccttctcccaggaggaccctcttcttgcttcctcacttttaaaacatataaactaattcttataaggctcagcaaacaggagccttatccttataaggcacagcaaatctcttctaggatgcctcccctactatgactcacccacactttgacaatcaacagcagtatgctctcagagtggcctgtgtatagtaccatcactaacttaaagtatttttaaccactaatattatcaaatctccgagaatgagttcctaccaggtatggactggactttaaaaattttgtaatggatgttattcttcctttatctctttgaaaatcttccagatttagacagtgagccaataatacatttgtccctggtcctaagtctctctctgctctcctgcctgccactctgaacagaagcaacatctttttactgtctctgttcatgggcaatctctgacttcacagtcagggatcatttcctccattcactgaatgttttaatcccattatctacagaaatacaattcccagccatctctacctttttctggacctaagagtccagaatgtccataactataggcctgtaactaataatcctcacttattgtctgatctgtttctggtccagagatttatactttcttgaccacagatatgtctaattttttactttattatcacttttaaagaaaggagatatgaatttaaagtatgaaatcagagccatcttgacgagaagccctcaagtttaaattttatgactattacacaaccttttagatcggggtcagcaaactacagcccatgggccaaatctagcatactgcttatttttagtatggcctggaggctaagaatggtttttacatttttaaatggttgaaaacaatttaaaaaatattttgtgacatataaaaattatgtgaaattcatatttcagtgtccataaacttttattggaacacacccatgaccattcacttatgctgttccagttactgactgttgtgcaacaaacaactgcaaaatttagtggcataaaaccaccaccactttatcacttcatgaattttgtgggtcaggaattcagataggcacagcagtgatgacttttttctactccacaatgtatgggacctcagttgggaagattcaaacagctggatcatctggagacgtcttcactcatctggcatctttgactgggatggctgggcttagcagagactacctccagagtgcctatctaaggcctctctggcataggtggcttctcaatagtcaaacttcttacatggcagctcaggagtcctagtatgagtgttccaatgaacaaggcagattgccttttatgatttagcctcagaagtctcatactctattgtattgaagtagtcacaagctcacccagatttaagtggaaggaggcacagatcctacctcccgaggagaagagaataaaaaaatttgcagctgtgttttaaaccttcatttatgggtttcacatcattttattgcaaggatccaggattaatgactgatttaaaatgtgatacacatccaggtctcagagcatccaagcttcaaaacaatttagcttcacaagaggaccatcatcagggtcatgacatgtgaacaattttaatactttcctatttgcttctggtcagtctttaattccaaacacatagaacacatgtgtttttaagtgttataggagtagactggtgccttaaaaaagagtaatttgtatctgtgtgatagatagcaaaaatggccccaattctttatccatgccctttccttatggatgctccttgaatctggactggctttgtggcttgcttagggcaatcgagtacagtatgaggtgatggtgtgccagttcagagcctaggcctcaagaggccttgctgcttctattcactcttagaaacctgaccaactaccatgagaacaagtctgggctagcctgctgcaggatgagagatgcatagctctgtgctcctacctcctaccactgccccagttgacagccgttggacttcaaaagcagagctccctgctgacctgtagttgaccataggcataaggggagaccagctgagaacagcagaactgctcagctgaacccagcccaaatgactgacccatagaatgaactaagtaattactattttaagccactaacttttgaagtggtcgttatacagcaatagttaactgacagaatttgaaacacagcttttaatgattaactgtagagtggaaatttcatcacaaacctcagtcgtactacactaaatcactttgggtactaattttccaaagtaggcattactgctgggatccacagaggaaggcactgtagctaatgccaagatcacagatgggtcaagcacttgacccaaaagaagtacataacagcagccatacgagtagcaaatgtcactctatctggaagtttctaatcctgtctgatgccaaggcagccataaggtacctcccctgtccagagataagcgtggcacctgcaaccagtggttaactatttaactggaatgtcagagtaacacatcagagcacccctataatcccagcactttgggaggccgaggcgggtggaccacaaggtcaggagttcgagaccagcctggccaacatggtgaaaccccgtctctactaacaatacaaaaattagctgggcgtggcggcaggcacgcataatcccagctacttgggaggcttaggcaggagaatcgtttgaacctgggaggcagaggttgcagtgagcggagactgagccagtgcacttcagcctgggagacagggcaagactctttctccaaaaaaaaaaaaaaaattagtttatattaggttgaaccatatgaaactgccattgttgcaagtcaaaatgtttgcatatcagcaatttcatagggttcaatctaatactgcaggatttggctcatgaacaaaaataagcaaaaaataaaagcttccttcctttgcttctcttagtctccaaagccctcacatattctagagaagtttaattcctatgaacttttaaggacatatattaagaaatacataaagcctcgcttataaatacatttttttttctcaattcaaaacacctagtttcctttaggagttgtattccacttaccagacttaaggtaattagcctgtgggtccccagtggagtattaggtctctctacctacatctcaaatttctagatcagatctgagcaccctcttttcatgtgccatttgtacacggcgaaccaggattccagaatgttgtttaacacaagaggaggttgttgacaaaaaagtattctgattattactatcagtgtgtgcttggtgtcagtggggggaggatatatttgattttattctagtttctgctttttctgccccagagttgcaaccagatggctagactatcatctctgggtctcttgtcagtcagagcaggagaagcctaagaggcaggattcctacccctgcatatgtgactagagtggtgaggcagttttcctccatcttcctgggcagccacaacaagaccctgtgaggaggcgcaggtgcttcgaataactggcactctcccaggccacagccgaagccacatgctcagaacagaggctcaattttaatccttctgagacaccatttcagggattggccaatatacaaacatgtaatcaatgtaatgcttttgtgtgctcgtgtgggtcttgagcttgtgaattttttgcattaacggttttagaattttctgcctagaaatttttagaattacccaagtataaacgcagtcttttttatggtaaatgttatttcatgagaaacactgcatacataatttcagcttcaatggtcagaagatcctgtgctttcaagcttactgttagaaatgcaaaacagggacaccaaaactccatcatcccacctcagttccctcagtacaggatgtttccctccttcaaaggttttttataagatctttcgtccagtgtattttacataaccagctttctctatttcccaaagaaaattattgcacagtctaattaagttttcccttaggaaacaccactcctgacacacaaaggaagacaaaacaatggtggcagactgtggaaacagaaatatttcatttttaccagctgaaaaactataaaaattaaaactacccctaagctattaatatgcaacgatttgaaatatcagcaattcacaggagactggtaaaaagtcctttgttcatttactgtttttatcaagttctgaattcagaaccccacataactactttgacaactgatagcatcacaaccacctaaaaacaagttcagagcgttccgttgtagacagtataaatgatgcttgtttttgcatgatctgtctcagaagtacagccaaggaggaactaagtctcacatgttcactctcacagggcccatcaaagaactcaataaagatctgatgaaggaacttaggctggaatttggaaaatgtggataacaccaatttctagtccattatcatattatttttattataatggctttgtagtaagttttaatttgataaagcaaactcccctcacaaattttcctgcttctggggcatttattctttccaaaatgcaaacctgattatgatacttgatgtaaaacccttctgttgcttcccagtgctcacagactcccttttaggcccctgcagaactgcggtttagtagagtggagagtgcgagtttagggtgaaatctgactgctcaacaggagagtcactgccaccatcagagaacctctctctctgacctggttccttaccaggctcactctctcctttaaatatgcattgaacaaataatggtttttgcaagggtgctgtgtaaggggttcccaagatcacccctaggttcagtgattcacaaggaagactcacaggattcggcatataatcatactcatggctatgatttattacactgtaaggatacaaagcaaaattagcaaagggaaaaggctcatgggatgcagtgcaggggagacaaggcacaagcttctaagagtcctctcctagtgcatacacagaacacaatttccctagcaacaagttgtgatgatacatgtgaaatgttgtctactagggaagcccactagagactctgccccagggtttttattggtgactggtcacataggcaccctctgactggtacagaccaaaattttagacttcaagaaataaagcaggtattcagcataaaccatattacttgtataaacaattccggcacaatgagccacccttatccgttctgggaaggtcaagaaccatccccaaaataaagttcttattcgccagcccagagtcaaccttgtaagcaggccttttcaaagtcaggtctgctatgataacatttttttttttttttgttgcacagatgccaatcattagcttggctgggcacctacacattctgcccagacctggatggggtaaacaaaactgtgacagtactctgagcaggggactaagggaacaggaatagaggaacacccatccttttccagtggcttgaaagaaggggcaatgaggactgcttcttgggagaggcaatgcctgagcccagtttgaacatgatagatattgtggtgtccatagatttaaatgctaaccaggtaagtgagcttggtaaattaatgagactaagctgtatctcagaaagtgagttacccatatggaccagggctattaatcactttgattccctgctttaaactttgtatggcttctaaatctcctgcaaagcatgcagctctgtcagaggtggtgccaacctaattttccagtcctacctgtgatactctgccccttcagtctctgtggtcccaacatccggtattcttttcagtgcctggagtatgttcctttctacctccaatactatcctaccccctactctggactgctcatcatcaccctatcctacttcacatggctatctcctagtcatgtcagatttcaatccaaacaacatttcctcaggatagccttctgtcccctaccccagagtaggtagggacccatgtcatttgcttcccagcaccaagtaacttctcctttatcactgtgggcacattaaagtccatttccttacacattgacacttcaagagggcagagactatgcctgtgttgttcactgtgataaccacagagcctaacacggtgcctggtacatactgggcactcatcaaacatatgaatgaagaatgaatcagggctcactccccttccccaacactacacacctcctgtgtctaaggcacatggcctaagctaggtcgacaagtcagccaagtgttttgacagaggtattgggaaagaggcactgcattgctacagatacagtctgcctgagagtgaaactaaatcacaggaacacacaggtgagaaaaggagatttggggctgcaataacagcctggatgttgccattcctaaagtcagcagcctgtggacttcatttaccagtaaaccctctttctgttacttaggctaatttaagtcaggactctgagatgtataactaagaatccttatagaaaaatagtaactggaattaggcacgtggttggtcctaaagaacaagagaaagactaccaggaagcctaacttgtgatgtcccaagctactggcctagggagtccttacagttccttaaattataaaaagggttggttattgttcagggagaaaagatgccctggctgggaagtagagcacaagcatcctggctggtcattatcctaaaaactactttatttgtggaaactcaaaccagatctcccaataggctacagagagacaaaaatctcccttattttcaatgggggtagatataattattgcaaataaaaagcttgaatatcacttcaaactagattctaaaccacattaataaagcattggctggataagcacttgaaaaagaaaacagtcactagcagccagcataggctctctaagaacatgacacacccaacttactttaggctcttttctgttccagtcactcatttattgagaaaattgtttataggtacagtaatacgtggaggcagctgacaggattttcctgctgatagattaaaaaaaatgcaggctgcaggcaggtaatcctgaaggtaggagtcttctggtgggacacagagctatgcccttggccctatcttgatcaaaactttgatgagtaacatagatgaatttagggttattgaccctaagagggataacattcatcaaagaaaagaggagaattcaaaagcaaatattataagcaaaaacaggatgaaatttaactagaacatatgtaaagtcactgcaattaaattgtttcccaaatacaggatgatagcagtttcagcttttgatgtcagtaaacaccacagtttagtgatgcagctactaaactcgggctgaattcagaaacataatgtctacctcagttggacaacaactggacaaccatgttccaatctgagtaccattaatggtgaccaatgaaagtgcatccagagaggggaaccaagactagaaaaagtttggggatcatatcacataaatgaccattgaaagggtgagagatggtgtagccgcctgggaaagcaaagacagaatcctataaaactgaaaatatccaaaccctatgacccagcaatcctatttctaaacatatatctggagaaactctcacaaatttgcacaatgatcaacatagaactgtttataaaagcaaaattcagaaagtagttaggtttccatcaatagaacggctagacagaataaggttcattcatactctggaatactttgcagcagttaaaaacaatgaagtgggtctataatcaatcaggatagactaagtttgccaaggtaacaaaaggaacctaaaatctgagtggcttaacacaaccaaagtctgtttattccgtatgctacatatttaaagtgagttggtaggagagcttattgtagttattcttgacctaagctgtcagaagctccatctctaccggccaggggaatggaatgtggcaaatctcatattagctcttaaaatttccatttggaagtgcattcattacttttactgacatttcaatgaccaaagcaagtcacagggccacgcctaacctcaaaagggacaggaactacaatcctaccacatgcccaaatggcagacagccaaaaacatcatgtgacatataataatacatactatgcaaagattaatagaaaacatatgaaaagatctaagatattttgctgtgtagaaaaaacagacacattcataataccaccatttatgtaaattaaaacatagatccaaaacaaatctatatatcgtttatatctatctatctatctatctatctatctatctatctatctatctaatctatctgaaactgaggagggaggaggatgacattagaagaggtgaccaaaggagaaataagcatttctgtaatgttttagtccctttatttaaaaatggtggctcatgcctataatcccggcactttgggaggctgaggcaggtggactgcttgagctcaggagtttgagatcagccttggcaacatggagaaacctcatttctaccaaaaattaaaaaaaaattagctggaagtggtggtgcacatctgtggtcccagctactcaggaggctgaggtgggaggctcactggagcccgggaggcagaggtttcagtgagccgagatcatgccactgcactccagcctgggcaacagagaccctgagaaagaaaagaaaagaaaaaagaaaggaaaggggaggggaggggaaggggaaggggagaaaacaaaggggaaaaggaaaaggaaagaaaagaaagaaaaaaaagaaaaaaggaaggaaggaaagaaagaaaggaaaggaagggaaggaagaaagtagctgggcatagtgatgcacacctgcagtaccagctacttgggagtctgaggtgggaggatcgcttgagcccaggagttcgaggctgcactgagccatgattgcgccaccgcactccagcctgggtgacagagtgaaaccctgtctctaaaataaacaagcaagaaaaaaagaaaaaaagatattacaaaatcttaattgttgataattctggctggtagagaatatgagtatttatcatattattctttgaatttttccattatattaaaatccttgaaataagttgttacatgaatcagaaatgttttagcttaaaaggccacgggggccaagcgcggtggctcagcctgtaatcccagcactttgggaggccgaggcaggtggatcacttgaggtcacgagttcaaggccagcctggccaacatggtgaaaccccttgtctactaaaaatacaaaaattagccaggtgtggtggtgtgtgcctctaatcccagctacttgggaggctgaggcaggagaatcacttgaacccgggaggcagaggtttcagtgagccaagatggcaccactacactccagcctgggcaacagagcgagactctgtctcaaacaaaacaaaacaaaacacacaaaaaaaggccacgggtgggagaaaggggaatgggaagtaggaaaatagatagctttaaatattttggacaaaagagatttgctgtgtgtgactatggagaggagagccaggaatgatactgacagttcctgaaaggcagattttggcttgggaataaagaaccaccaatctattaaggtttttggtcttattttttttagtagcctcaaaactgtatggaggaaaaatatgtattctttggggtaaaaaataatgttgtcaagagtcagacaaccacctgtctgacaaatactgtggcaaggattcctgcactgggaaggaatttggatttggtaatctccaagttccctacaattctcaggttccatcaaccttggactggaacctctcagtttctaaattctagttcacaggctctgggaaatgcaccacagttatcccaaggaaaacttcaaaagataatgcaacagtctgaacacaatacaaatctgaattgtgttacctgggaatatttcacaatcaataaggaataaatcacttaattgggactaatagttattataggcaagagagtcacaagaattatactggccttgaataaagctagctttaattctcacaccccgatcaaccttatgcacataattaaatcagtattatttggagaactattgcctgtttaattactgtttctgtgacttgttatttgttctcccagtaccaaaggcaaattgctcccacagctaaagagatctccacagaaacatcccactgaaataaacattcctttataaaatggaagagtaagaataatgaatgtgttttcttttaaactagttgctttggctgctgtcaaaagaaaaaataaaagtcttagcaatggaaaacaagtatcacttctatgaggagggccagtctggcataaagatagtgaggtaaaaactcaagcagctctctgctgctaccctgctcccagccaagaagataagggatttcaataggagtaaatgagacaacatgttatagctgaggattttctttcaaaaaggtaccataccttttaaaccagtaaggttctttgctgtacacagttaatatatgcctagaaggttataagttgagcagcctttgcatgcctggaacctgacagatctcaacagacacctgggaagcccactgtggcttttaaagaatgcatatttctggctgggtgcggtggctcacacctataatcctagcactttgggaggccaaggtgggcagatcacttgaggtcaggagtttgagaccagcctggccaacatggcgaaactttgtctctattaaaaatataaaaattagctgggtgtggtggtgcatgcctgtaatcccagctactcaggaggctgaggtaggagaatagcttgaacccgggaggcagaggctgcagcgagccgagatcgcaccactgcactccagcctgggcaacaaagtgagactccatctcaaaaaataaaaataaaaataaaaaataaagaatgcatatttctaccacaaaaatactgaaagcatgctgcaacataaaaacatgtgctctgcccatgtgtttttgctcgtttaggatttccttccttcagtgattctgtaccacataactaacaataggaaatactttcataaaagtgactgttatttagtagtttcttctattaactttcaaaactaaaaccaaaccaaacaaaaccaaaaaacagcccacaaagctcttaaatattcccaagttaatgaggttagtatggcttaaatataccttctttctagacccacattcctgactgtgctggagtttcatgtgtcctggtctctgttacccaccagaaataccatgtgaggcagaaagccccaatatgctggaaaagcagctgcctagaccaccacaatgccttgcagagacacagttggggccctaatctatgagcaaaacctgattcccacccccctccaggtttctccatccttcaaatgcaagcacttaacatcctaaaatgtcacaaagcagtgcatttatccttgggagatagaatttggtgataaaatgcaagactgtaatgttaggaaggacagagtgtggggaaagccagagacaaacaggagagggaggaggagaaaggggttgaggaatgaagttctgcagggcaaaggttactggaaaacagcaggacagaagcaagagactacgacagagaggcagggccaaggaaaacaacgaggtcaatgatatgctacacaaagacaaagaactgtgcttccagatgagattaccacatatgcctttagagaagtggttctgtttttcagggggtcattatgtattcagccaatagtgcagctaatctgcttactcttagcaacttttgtccacctaactgcaccaaacactacatatctgaaactattatttcagagatataaatactttaagggggagggaaagcaacccaaaacatccattaaaatatcagtgaagacttccggttccaagtaagatggtataaacacacacgtaacctttctgttgaccaaatgcaactataaaatctgtaaagaaaatatgggcaactattagagaactcttaaaagtatataacagcaggcgatcaagaaagaatgccagaatgcggagtacaactgaactggcagtgacttaaccactttttttcttccagtattcactggcctgaattcaacacaatgaaatctgaaagtgagcactgtggttagagcacatgttctggttcaaggtgcttttttggaaaagggaactactaatgctcagagaaactggagtggtgaggtggcggtggggggcggtggggggggaatcccctgggtttttctctcctttttctcccctttctaatgtctagaaaatcccatggtagaggctgtggcagcagcaacaaaaagtaactggcatagggagactgtacgagctaaaactctgaaagagagagaagaaacttctgtccatttggtggaactatggctccaaaagggcaaagccaaatcccattgctttttttttttttgagacagtctcgctctgtcacccaggctggactgcagcgatattggctcactgccacctctgcctcctgggctcaagagattctcctgcctcagcctcctgagtagctgggattacaggcacacaccaccatgcccggctaaattttatattttcagtagagatggggtttcaccatgttggccaggctggtctcaaactcctgacctcacgtgatccatacgcctcggcctcccaaagtgctgggattacaggcgtgagccaccgcacctggcctcccattgatttttcctactttttttctctctgtttgcctgccccttgtgccctagaggcagtgtattgtgaaagtgtgtagtttctcactggaggactaaaaaggaaagccctggaaaagtagaaagtaccagagaaataacaacgaaggaagagctcaggaaaacaaactcacaaaaagttgcttacaaactcctgggaaggcctccacttcctcacaggtggatctgattctaattagcatatcaaagacttggagaaatgagttaacacacacttaggtccctgactgacaggtgggtggcacacacacgacagaggtgaacagcactgcaaagccattgaatactgaactgatatttgaactacaccccacagaaagtgagatggaacttgcagtctgaacctaaccagaccaactgctgctgaaacaaatacattgacattctccatggggttgaaacaagatccagagtctcataacataatatccaaaacatccaggataaaatccaaaattatgcgatatacaaagaaccatgaaaatgccagctcacatgagaaaagacaacagatgccaacaatgagatgacacaaatgttgaaattatctaacaaggactttaaagcagctactctaaaaatgctcagattgccatgcatggtggtctgcacctatagtttcagctacccaggaggctgaggtgggcagatcacttgagcccaggagtttgagtccagcctgggcaatagaacaagatcttgcttctaaaacaaccaccaccacacactcaaacaggcaatcaccaaacctgaacactcttgaaagaatgttaaaatagaaaatatcagtaaaaagaagatataatgataaccaaatggaaactctagaactgaaaaaacaaccgaaataaaaattaactggaagaacacaacagcagaatggaggaggcaggcaacctgaagacagataaactggccaatctaaacgaaaaaaagattggaaaaaaaaaataacaaagcctcagggacctgtgggataacaataaaggatctaacatctaacatttgtataactagaatctaacacagagacgaaaaagagtgtgatgataattttttttttttttttttttgagacggagtctcactctgttgccaggctggagtgcagtggtgcaatctccgctcaccgcaacctccacctcccgggttcaagcaattctcctgcctcagcctcccaagtagctgggactacaggcgcatgccaccatgcctggctaatttttgtatttttagtagagacggggtttcaccatgttggccaggctggtctgaaactcctgacctcaagtgatccgctagcctcacctcccaacgtggtgggataaacaggggaaaactcccgcgccagttgtaatttttggatatatgtacttaaatttaggaatgtgctgcaaaatttttaaaagttattggaactggggctttttttttaaaagacataaagctggccgggcaaatttggtcacgcctttaatcccagcattttggacggttttggcgggcagatcacgaggtcaggaggttgagaccctcttggctaaaacggtgaaaccttgtttttactaaaaaagacaaaaaatttcccgggggtggtggcgggcgcctgtagtcccagttaattgggaggctgaggcaggagaatggcgtgaacctgggaggcggggtttgcagtgagctgagattgggcatttgcactcccccctggggtacagtgggtgtcttctttttaaaaaaaaaaaaaaagacataaagcagattttaatttagaaagggctagcaccattaaaatctgtcaagataacattatagagttgaccaccgagtgaggtctatagcagccaaacagtgagctgagaaattagggattggggtggggagtgttaggagagtgataattcaattgtattcttcaaattttcaatattctttctttcagtaaacattttttttagtttagaccggaggttgacaaatcagcgtgtgagctaaatctagcttgtcacttattttgatatggcctacaagcatacagaatggtttttacatttttaaatcattgaaaaataatgaaaggaagaataatatttcataacacatgaaaattatatgaaattcaaatagtataataaagtttttttttcttttttgagacagagtctcactctgttgcccaggctggagtgcagtgcatgatcttggctcactgcgacctccacctcctgggttcaagcaattctcatgcctcagcttcctgaatagctgggattataggcattcaccaccacgcctggctaatttttgtattttaagtagagatgtggttttgccgtgttgtccaggctgatctcgaactcctgacctcaggttatctgtctgcctcggcctcccaaaatgctgggattacaggcgtgagccactgcacccggccacaagttttgatatgctgtattttcatctacattcaggcattcaagtcactgtattgagagaagtgtgatgtttagtttccaagtgtttggagaacttgtagtctttctgtttttttctttttttgagacagtctcactctgtcgcccaggctggagtgcagtggcacgatctcggctcactgcaatctccgcctcccaggttaaagcatttcttgtgcctcagcctcccgagcagctgggattacaggcatgtgccccatgcctggctaatttttgtatttttagtagagaggggatttcaccatgttggccaggctggtctcaaacccctgatctcaggtgatccactgcctcagtgtcccaaagtgctaggattataggcgtgagccaccgcgcccggctggaataaagttttattccgaagagagttgtgttcatttgtttatgtactgtctatggctgccttcatgctacaatggcagatttgagtagttgtgacagagaccatgtggccctcaaagccaaagatatttcctatctggtcctttacagaaaaagttgggtgacccctggtttagacacacttcccaacctggccttctcatgcaaggtgatttctactcacagagtttgaaattcccaaataatttgctaacaagtctttatattaaagagggtaagcctggttcctggtgacagagataattgtggttgacaaagaaatacttgtctgtggcaggaatctgcctaggtaaatttgtatgttcttcctttatttttccttggatgttttttgagggctttggaaaagagttgacctccagactcctcatctggtcacaagattcatgagtcatatggtatatcttaattttaaaaaataagctttgaaatgctgagataaagtcttcatttagaaaagttcattatcccaacttctgctatctctttcaaagatttgttaggggtgaggagaagcagtgacatatgtagaatatgttctcttcttattttttgtttattcaatctctagatagatgtttatggctttaattactggactactgagaagtggtagaaatgaaagatacacaagatgaacagatttgaaggatagagttttgtttccatgacattgaagcagggatagaattgttttgtagagaggggtgaattctgaattaaagcacaggcacttaaactgtcttactatagaggttaggattgtttgccccaaagcagaggataatcagctcaagaaacacatttatagcattcatgacttctatttaagaaatagttggccggacgtggtggcttatgcctgtaatcccagcactttgggaggccgaagtgggtggatcacctgaggtcaggagttcgagaccagcctgaccaacatgacaaaaccccatctctactaaaaatacaaaattaaccaggtatggtggtgcatgcctgcaatcccagctactagggaggctgaggcaggacaatcgcttgaaccagggaggcggaggttgcagtgagccaagattgcgctattgcactccagcctgggcaacaagagcgaaactccatctcagaaaacaaaacaaaacaaaacaaaacaaagaaatagtttgggccgggtgcagtagctcacgcctgtaatcccagcactttgggaggcccaggcgggcggatcatttgaggtcaggagttcgagaccagcctgaccaacatggtgaaaccccgtctctactaaaaatacaaaaaaattagctgggtgtggtggcgcatgcctgtagtcccagtcctcgggaggctgagacaggagaattgcttgaacctgggaggcggaggttgcagtgagccaagatcgcgccactgtactccagcttgggcgacagagtgagactctgtctcaaaaaaaaaaagtttgggaggttctttgaccacatgggcaggaattcacccttcgggatataagaaacatgctgctctggtctgaccagtggcttaactgaaatgtctgtctctgataatggctctgaatattttcctgaaagcctaagggagctagactttcagatgtttctttccttaaggattacttccaaataccatcacagatttattctgatttttatctcagtccttcttgaacttgtttacattttcattttgtttcacttcttgaactgatgagttctctaagttagttccctaagcatggctgaaagtcctgttttccttttgataaaattgcctttaggtttcagggaatacccctttgttatttaattctataattggatgaataaaatcaagctgatcatttctacactcttcttaatagctcattgatttctgtttcatccctttagagcaagatttctcagccttggcactgttgacattttgagccagataagtctgcacattgtaggggactatttctgtgccttgtaggatgtttaacggcatccctcctgacctctatccctagatgccagtaacatcaattattgtgataaccgataaatgtctccagatattgccaaatgtcccctgggggggcaaaattgtcttcagttaagaatcactgcttagatctttggcttttccaaaatgcaaagtctgtgcgactgtcttgatgacacagagatgtctctgtttaattgattatattgcacttttctggatttctttcagctctggttaatgtccatcttgaatgacagtgatggccacttttatagtttcaatgtttcaagtcagctgaatcatttgggagtgacatgggaacagatatcttgaaatcttagaaaagtattttttccggttgtaaacgtcctatatgtttactctaaaactgtggggaatggaaaaattcagaaagaatgtttttatcaaccagaaatctgtcacttcagtgcaactaatgttagtaaattggtttatggtttttgctttctatatattttatttcatacatgtatagtaatttcactgtaaaaccaatttttatacattttaaaacaacttagcataaatgtttccctgtataccatgtttaaatgactggatgaaataccataatattaatgtaccttaattattcctcttttgtgtgataggtcggttttatttttattataaagttttaatggacattttggttcataaatcattttccgtgtttcaaattatttttctttcttttttctttttcttttttttttttttttttttttttgggacagagtctcgctctgtcacccaggctggtgtgcagtggcatgatctcagctcactgcaacctccgcctcccaggttcaagcgattctcatgcctcagcctcctgagtggctgggattacaggcacctgccaccacacccagctaatttttgtatttttagtagagacgcggtttcaccatgttggccaggctggtctcgaagttatctgatcctggcctcaagtgatctgcccacctcgaccttccaaagttctgggattataggcgtgaaccaccgtgcccagcctgtattaattttcaaggacgaatgttagaaatagaattcctaggtcaaacggtgtgaatatgtttaaagtagagcattattttttaaactgctacatggccctgcagagggcagtgaataggggccccttgcactgaccatgcatttcaaaagtatgtctcatgggtatatagtaggaaaggaaagggctatgtttgagctaatcacttttcctttccttggcctgcatgttcttccgtgggaatattaatggggagtcaagtagccaccaaaccgcaggcttaggttccagtcccaaataatcccagttgggttgacttccagacagtcctcctttaaaagggtattttactcaaggaagacatttactccagacatttgtattttgcctggtttgcagtcactgttaaaccactgtgctgttaattattgtacttgagatgatagtaggaataagatctgaaaactgccatcaaattactgttcccagtggtgcaaggtgaggtctagtgtacattttgtttctgccaaaatgaaggtaaggaagaaaagaatgcctttataaagtctgtgctctgatctgaggactagaaaataaacagctgaataatataaccaagtgtaagacatcgagatatatcacagttactctaggattacactatactgatttatggttttgtttaacaaaacattttattctaaggtaatttttttcatggtacaaataaatttatttgcttgttttatgttccttattcctcttttcttcccaagaagttactttgacaatcacagaccttattgggcctctttcccttctagttcttaaatgaatattcatgacagggacatcacagaaaacaattgtttgccgtatgctttcaggtgtcatcaagcatcatgctcagcccctgggctgctgtgactttgagatctgcctggtcaactaaagagggctagtccttctatggggcttttctttcttaaaaaaatttttttgacatacaaaaagctgtacatagttaatatatacaactagatgagtttggctgggtgtggtggctcacgcctgcaatcccagcactttgggaggccaaggtgggtgaatcacttgaggtcaggagttggagaccagcctggccagcatggtgaaaccccatctctactaaaaatacaaaaactagccaggtgtggcagagcatgcctgtaattccagctactcaggggctgaggcatgagaatcgcctgaattcgggaggcagaggttgcagtgagctgagattgcaccactgcactctagcctgggtgacggagtgagactctgtctcaaaaacaacaacagctactaaatgagtttggagataagtatatacctataaactatcatcacaatctatgccataaacctatctatcacccccaaaagtttccctttgctctattcttctgtcgtggtaagaacacaatataaaggcctatcctgttagcaaacttttaggtatacaatatagtattgttaactatagcactctgctgtacaaaagatctctaggacttaccttaaattaagtagtacattcttaaaattaccacttaataaggattcacatgttaagtaggggtgcctagaagcagaacctgagacagtattcaaatgcacatgatttattgaggagtgttctcaggagaaacctgtaaggggaagagggtaaccgggtaaggaaggagcagccagttagggtcttaagaaaatctagccatagcctgtttgaggtgatggcagaacaattattgactgcaggctgcctctgggagggagactggaagagtgtaatccccagttcttgggaagagaggggccattgtgagccattagcagccaacaagaagtagctggaaaatgggtacagtatgctagctaggtaaacaggattgggtgggggcagcacagtgtgttattcctttgcctgtttattttgtgcaggatactgtgctaagagctaggggtaaaaaatgaatgtgacacagtccctgctttcaagatgcttgtggtctagtgacaacagggctgaccatgtaaagcagcagtgtccaatcttttggctgccctaggccacattggaagaattctcttgggtcacacataaaatgcactaacacctaacgatagctgatgagctttaaagaatcacaaaaaaaatctcagtgtttaaagaaagtttatgaatgtgtgtttggtggcattcacagccgtcctgtgccacatgcaggctgcgggttggacaagcttgatgtaaagaatattgatggtgcaagtgaggtgcttctttgcatgtacttggatggaaagcaaaggagtgaataattgtgggggagggacgtctgggaagcttcatcgaggacatccaatgaatgaatagaaccagggttggggaaaatgggctggtcaaggaaaacatggggaggaattgtaggtagaaggaagagccctgtgcaaaggctggcaagcaagtatgaaacaagacgaacgtgttcccggaatcacatggggcatagtatatgccaaacaattggagtggattggggggaacagcagttgatgaggcctgagagactgggagccagaactgggcctcgcaagccatgctgaggagattgggcttagaaggggcaccattcttgctgtcatccctccagcctgtcctctggcttctggatcaacttggagtgctcattgtcaatgtacctgactgccccctggtggccatgttgctctaagcatgtcgctttaatgcttctgagccccaatttcctcatctgtaaaatggctgctgctgctatgtgtaggactgttgttgtgcttagaaataataaatagagatataaagatttaccatcattgaattattctgctgatatttattgttttctgtcattttcctacaataattaaaacagcagtatgtcacagaaatggacagacaaatcactggactttaaacagcccatacccaaaaattaacttgctttgttttcttttctaaaagtcattgatgactcattttcttatttcccaggactggtgtaactcgtattagataatctgtttcctaggctttttactgataatacaagattttttgtttccatctataataaaaaatagttgttactgtaattgttttaaaaatgccaaattttgcctattctttaaaatctccctctgtcaagaacagtttgataactcttttacttaaagaacagaatattatagaaaatggagaaactgttttatccaaagtacacatacccagaacttcagatgagaggagtatccatctcacaagaagtcttaggtcttctgaaactctcagggaggtgaggagagagggtccatggtcagttggctttcttcactgagatttttagagaataaaactgttttttctatgacatttgttgcccttgatcccatcatgagtcatccatatggaggttatattcagtgggaacataaactttcatttctctgggataaatgcccaggagtgcaattgctgagtcatagttgcatatttaatttttaaagaaatgaccgaaatattttctagaatagctatactattttacattcccacaagccatgtacgagtgatatagtttctctacactttctccatgatttgatattttcactatttctttatttcagctattgtaataataagtatgtaataatatcttgtggttttaactggcatttccctaatggctggtgatactgaatgtcttttcacgggcttaaatgccatttgcgttcctctttggtaaaatgtctgctgattttttttttttttttttttttttttgagacagagtctcgctgtcacccaggctggagtacagtgatgcaatctaggctcactgcaacctccgcctcccaggttcaagcaattctcatgcctcagcctcccgagtagctgggattacaggtgcatgccaccacacccagctaatttttgtatttttagtacagacggggtttcaccatgttggccaggctggtctcgaactcctgacctcaaatgatccgtccgccttagcctcccaaagtgctgggattacaggtgcgagccaccatgcccggcccatctcttgatttttaattaggtcatttgtttccttactgttgaatttttagagttccttatgcattctgtaatataagttcattgtcagatatgtgttttataataaatattacatgtataatatttctaagaaatgaccaaaatattttctagaatagcgattcctttttacattcccaccagcaatgtatgagtgatagtttcttcacatcttctccagcatttgatattacacgtgtgtgtaatatgtgtaaatattctgtcccattctgcttgcttttgcgtcttcttaacaggggctttctcagagcagaagtttttttaaaaatataagtagatagtttatttgggccaagtttgaagaccacaacccagcagcatagattcaagttgccctggatatgcttctgagagcaaaagtctttaattttgatgaaaacacatttttctttgccaatcatgctttaggtatcaagtctgagaactctttgcttagccctagatcctgaagactttctcttatgctttttgtaaatattttataattttacatttttcatttaagtctgtgatccattttgagttacattttgtatattaggttgtggtaggcagagatgtccgtgtcctaatctctgcaacctatgaatatgttaagattgctatttagctgactataaaatagggacattatcctggattatctgggtgggtccaatgtaattacatgggttcttaaaagtggaagagggaagcagaacagaagggtcagagaatgagatgcgatgacagaaacaggatcagagagattcagtgttgtttgccttgaagatggaagaagacagccgagatcaagggagtaagagtgtcctctaaaagctgtaataggcaaggaaatgagttctcccctgtagcctctagaaaggaacgcagtcctgatgacatcttgattttagctcggtgagacctgtgtcaaaatcctgacccactaaactataagatagtaaatttatgtagttttaagccactgagtttgtgataatttgttactgtaacgttagaaaactaataggtgttttagaaaagcttctattaaaataggattttatacatttgggtatactgtgtatctgaacaatttttatatatgcaacatccccatgatatcagataaatgaagtgctactctaagtagatctgtgcattcagtggggaatagttagaaaatgtattacttttatttctgcttaaatttctacattcattgtgactttaaattccccactactactttttaataggaagtgtcttgttgttactgttggttttgtttgcgtttcagaagagatttgaatgaaattttgcaccagagagccaaatgtagccccaaaaatttatgtgatgggaggctcttttttaaaaatattcaattgactttgactataggacaaacagaaccttagttaatggttctgattcttgtactaattttattagttttttaaatgacagctttgagatataatttgtataccatgcagcttacccacttaaagtatacaattcagttattttaatatattcacagatatgtgcaaccaatcaccaaaggacacaatatgttttcacactgtcttctaattttgtttctgagaaattagctgttaattttattggagttctcttgtaagtgatgagttgttttttttcccgggctgctttcaagattttctccttgtctttggctttcagtaattttactatgaggaatctctttctggatctctttgcatttatcctacttggagttctttgagtttcctgaatatgtaaattaatgtttttcagtaaatttggggagtttttctaatattttttctgctcctttctcattcacttttccttttggtactcccattatgtatatgttgatgaacttaatgatgttctacatttctctgaggctgtttcttcttcttttttccatctgttcttcaacttgcctaatcactgttgacctacttcaagttcattaattcttttttctgcttgttcaatctactgttgaggcccttcagtgaatttttcatttcaattgtgctttcatcaccagaatttctatttggttattttttatacttcctatttctttattgatagtctctgttttgtaaaatattgtcatcataccttcctttacttctttaatcatggttttctttagttcttcgaacatatttatatggctaatttgaaggttttgcctgttaaatctgacatgtggttgtatgggtcatactttcctgtttctttgcatatctcttaagtttttgttggaaactgggcattttggataatatattgtaacaattgtgggtactacccctccaccagggttctttattattatttgcttgtttactgctttagtaactgcctggattattttattgaagtctatttcctcaacccccattctcaccctgcagtatgaagcctctaatgttgctcttcgggggtacaagcttgtgtatgcccacagtcaccctgggatgacagtgggtttggtgaggctctccttggctgtctctttacttgaccacaccatgctgttatggtctactaattgttgactggttgctcttgttttgtttttgtttttttgagatggagtttcactcttgtcgcccaggctggagtgcagtggcgcgatctcagctcactgcaacctccacctcccgggttcaagcagttctcctgactcagcctcccgagtagctgagattacaggcgcctgccaccattcccagctgctctgttgttttaatcatgtcctggaatataaattgctccacaaactgatccaatcaaattagggctcctttgaagatagttcctgagatctgtgtttgagatttcttctgaccgcaagaggctctttccctgctgtctctttctctggttctctctggcatattaggcagcctaggcttgaacttctgtacactcagttgcaaatgaagtcagtttcattgcaggagaattgaagccccctattctatgccctgcctctctccctgggaaaaatctttgagccacagctctggcgcagtggatggagataaatggtgagcttccctctgagtgtcagccccaggtctcccaggtttgcctcttctggtatagaacccccaccccacaaggtaacgccagagcaatcaaggctctggtattcttggtggcacaacacccaaggcatagcctccatcccatgagttgggggctaggtggaagaagggagcccccacctctcagccacattctcctggaacgtagcctcagcaaaagtagctgggaacgggataagagatgccgacatcctgttcttcccaggaagaaaggagcttggagctggggtagaaggaaccctgtgttcttggctactgtactctggcatgagatctttgctgggagggaagatggaggaagtggttctagatccaaatactgcagactttgactttactttatgaattttagtagattttctcgaataagtacttcatttgctgtatgcccttaaaaccatttccagagactttaaatggttgggttttttttaattgaaataactttcaccaattttgctgggaagagggtcgtccatggagctgctcacactgttatgccagaagtggaactctgtgagctttttaatgtaaaattttgttgctgctattcttaattgctcagagtggccttgtatttggatttctacctcctcagtagattgtaaatagcttgaaggcagtagccctgacctttattcattatggaatcatgatagcccctggtagcatgttgtatgttgtggcacataaaagaatgtcagtcactggctatattgctgtcttttcaagtttacattttcagcacttcgtttgtgacttaaagtgcttaactgtgtcttccttttttcttacactccagtgctagtgtgttcccagaagggtgatgcttcttttttatctgtcattggccatactcagggaagtacacttgaaccgttggaagttttagtccaaagcatttttatttacccttcacaatataggagctttgtttaacattccttgtagtgtatatataattttgactttaggctacttatttgggatatggggacaggaagagagtgagagagggataaagggcaggcagaaaatcagtgtggtcgtgttcttaaaggtggatgtgcctcacttgttctttcttcagccaactatgtctcatgcttttcaaccttggctcttgatggccctgccctcatgactgattttttctttcctgttcgtctcttattggggatcactggctggttatggccccatggctgccccaccctttgttttggtggacagtggccatgtggccacatctgaggctccagttagtgctgtaccactcatttgtggcttgggcttcctcctaaggctaatgtggcctttcttagtctttgacatgctttgtattgaaagatctggtagtactcttctgtcattattctaagtcatttgagaatattcttgacaaaaatcattcagtttgtatgatttgcttgctgctatttctgggatccatgggacagtgttgactgccctctgggatgggtgtgtgtgaactgttttattcagtgtttttctttttcccaggatgctccaggatgaaacgccataggcctgtcagcagcagtgacagttcagacgaaagtgagtagaaccggctggcagctggtaacctttctatctatatcccttgaggatttttcctttcatttgaggataaaccatttcatgcttttttcaatggttgaaaaatgtttctgagaaggaaaattcagggcaccattatcttatttaaatttcattagagatagataaattagaagaattgattgtgtgtggcatataacttttcacttttcatttacctaaataacaaaagccagatctagtaatgctttaacagagcttctctagaaagaagaaaagtacaagagcataaattgtaggccctgattctaattgtagcttaggtactaagtgtttgactgtgagtcaatcatcatttgtaaaaggcagtaaccttattagcaatagcctttggggaagtgctgaaggatacacagattacttgctccacatttgtagtttttccagttgtttttggagatactttttcttcaagtggaatatgaattgtgttattgcagaacattatgaggtgtgattataccaaatcagataatctcatccttagcattgttgaagcttttgcactgtaggagatcatctataaatgtcactaaactccattatgaggcactcttcagtgcagtttgactgttttcttcagtggtatgagctctctggtttctccatcatatttttcatattctcttgggtgacatttagttttatgacatttagttatattagtaggtaatgtgtctcagtatttttttctaattatctttcacaggtccttccacttcctttacttctggctcaatgtataggatcaagtcaaaaattccaaatgaacacaagaaacctgctgaggtgagatcgtattctcaatttttagacttaagctatagtttggatgcttgtcttccaaaacctcatgttgaaattatatcccaatgttggaggtgcaggcctaatgggagatgtttggatcatgggaatatatccctcataaatagattaatgccctcccagagcaggggggtaagtgagtttttcactccgttagttcccttcagagctggttgttacaaagagtctggcacctcctcccattctctcttgcttcgtctctggccatgtgatcacatatgctagctctcctttgccttccaccatgagtagaagcagcctgaggcccttaccagctgcccagtcttgaaccttccagccagcagaaccataagctaaataaacctcttttctttataaatacttagcctcaggtattcctttatagcaatactaaataaactaagacaacttttaaaaatataaatgtctgcctcctaactatataccaacaatacccagaatctgaagatgtgaagaataaagaatgtgtcagtgggtaggcttgttttctgatgaacttatttgttttccaagaaagatttcattttctatctcctttaggagaacaataatcttcacactgtgatttcattttgtgatttcaatcatcttcacactgtgatgacacatagtgcctggctttagaatattcctcccctaaccaggaagtcaaagagagccagactaggggaactgggaaggacctagagatctcctggcctatgattgggaaaagctaagttagcaggtgaggagagatagtacagaaaggtataggtgagtaggttgtagatggactacattaaagatcatatgggtcatggtctgtgaagctgtgatgggtccttacagcctttggatcactgctggcccagaaagagtaggtcaatccttatcaggctggtcatcttttccacaaagggcagcaaagtgccagcgttcctcttggacttgataatggtttagtggatcctacagactttcctctgtgataattaaatgataaaatgactttgtatatcttcacttctactatgagtagacttccttagctgtaaaggaacagagaatatattagttatgtattgctacattacaaattatcacaaaattcgtgtcttaaagcagcacacacttatatctcagtttctgtgggtcagtaatctgggcatgatgtgactagattctttgttcaggatctttcagggctgaaatcactgtggaaaatgggatgtgttctcacctggaggcttgcctagggaagaatttgccaccaagctcatgttgtaggcagaatttgtctccttggagctgaaggactgaggtttctgttttccttcttgcttttggcagagagcactctcagtttctaaaagccacttgtagtttcttgccacatggccttttccatagatcctctcacaacatggtagcgtacttattcagcgccagcaaggagagtctttccctccagtcagctaagatgtagtgttacataacataatataatcatgggagtggcatccccaccacatttgctatataatgtgacctaatcaaaggaatgacatcccatcatgtttgccatattctgttgtttagaagcaagtcacaggtcccactgccttagtagaaagggagtgactctttgtgggttacttttgggtgtgtccaccagagagcatttctctcttccttggaggtcacttttcatttgtttcttttgccagggatttttctgggcacaatagaatgtaagagtttatttatatatgtccatgtcatacagaaagacttagggaatataacacacataaacaggagtggaagaaatttcccacctgtctagaggagactttgactacagaatggtgagaaagaaacctcactacctacccttttaggacgacagctggttctaggacataaggcaattcaagggctttgggttttgaggcctactgcctcccaggcagtggtaatagtagtcttttttgttgcaagggataggggacctgggctgctgaaagcaaattgttttcgtttatatttaatattctgttataaaaaggaaaacctggtgatattgtaggacaaaactagcctttgcattagaagagcttgatcccatgttctgctttgctggcttatttcatctctctgagataatttgtcagcataacatggacattatcatacctatctctcatacctatcatttattgaagttttatgtgccaaaagctttacattaaatagtttgtttcccaaatttaaacaattatgagactctccttggatgcctgtttaaaataatgattccagacttaccccaccctgtgacactactgaattagtatttccaagaaaagtgcctgggatctggattttaaaaagtgactcaggtgatttttataatcaagcacgtcggggaagtaatatactcttgttctattcctccagtaacactataaagtaggtactttccggttttttgtttgtttgttttgcaggtgatgaggctcagagaagttacttgcccagggtcattaaaaaaaagcagaactgacattcaagtttttattcatcctgaatcttgttttattaaccagtatgcattggacatattatgtagggtacaataagtatatagtaaacatttgttgaaactttggcagttaagaaatatgggacagcaccagtgttttctcatgagtagttataatcaaagtttccataatggagtgagagcaaaactcaagattagagagaacaaacctggaattgaacaggggctgggaacccaggcagcaaggagaatatggtaggaacccttggtaaaagaagaaaagtaaaagttaagtgggaattggcaaaggtgacaagcacacactactcacaggtgagtctgaaggcagcctttgaggaatcagatggaaccactgtgaattctttcttcctatttggcccctgaaactgaagcaatattgccattggctgctttttatttatttacttattttgagacggagtctcgctctgtcgctcaggctagagtgcagtggtgcgatctcagctcactgcaacctccgcctcccaggttcaagcgattttcctgcctcagcctcccaagtagctgggagtacaggtgcctgccaccgtgcctgggtaatttttgtgtttttagtagagacagggttttaccatcttggtcaggctgttcttgaactcctgacctcgtgatccacccaccttggcctcccaaagtgctgggattacagacgtgagccactgcgccctgccgccattggctgcttttttcaaagcgtcagtttatgccctatttctgatagcagactatcacttttctctcaatttctgattttcctggccttacttgctgcacctgtttgcttcaaacagttgttttaaggttcacttaagaaatatgacatatttgtatgcttctttatttctgatgttcccatttttcttttttgttcatttgtttctgtttgaagaatttcctttagctgttattttaggataggtctgctggtgataaattcgcttagttttccttcatttgaggatgtcttgatttctccttcattcctgaaggatattttcacttgatatagaattctggtttcacagtacttttctttcagcacttggaaaatgttgtgctacttccttctggcctccatggtttctgatgagaaatctgcccccattcaaataggttgttctcctctaggtagtcatttctttcccagttgtttttgagatttttctttgtctttagtttttaaaagttagattatgatgtacctgggcatggatttcttttggcttatcctcttcgggctttagtcagcttcttgaatctgtagatttatatcttccactaagtttgggaaattttcagccattatttcttcaaatatttttcaactccaccttctttttcccctccttttggggcttcagttgcatgaatggtagatcttttgttattttcccacaggtccctcaggcacttttcttttttttttcagtgtatattctgttgaacagattgaataatttctcttgttcattggttccatcttctgtttgttaattccattcattagttgagcctatcttatgagtttgttatttcagtaattgcattattccatcctaaaatttccatttggttattctttatatatatattccatttcttcactgagactttctgtttttttgtttcaaaagtgtttgtaatttcttgttgaaacatttttatcatggatgttttaaaatccttgtcagataattctaacatctgtggatctcagtgttgatgcctgttgattgtctcttctcgttcccagttcttagtatgatgagtgattttcagttgtatcctggacttttttagtattatgtcattagacactgagtcttatttaaatcttctgttttagtagtcctctgctataaccaggcaagtggggaagaggggtcctgactctctactacctgttgtagaattcctgagctccccatcctagctctttcactctctgggaagcagcactggggagtctctactgcttcatagaggtggaaattcccaccactttgttgcccccactgatgatggagggtatggtggtagtgaaggtaccaccttattgatcagtgatggtgacagcccaggctccctacccagtctgccaacatcacattgaggaggagaggtgcctcattattgctgggagagagtgaacatcaagacctctcatgtggtgtacattgataccccaataatcaccctcttttaaaaaccatttttaacatcttttcttgaaatataattcttgtagcatacaattcacccattttaagtgtataattcagtgggttttagtatgttcagagttgtgtaaccattacaatcataatttagaacattttcatcatctcagaaagaaaccccttacccattagcagttactccccaatctccctacctgcaacccctggcaaccactaatttaccttccttctctatggatttgcctattctagacatttcatataaatggaatcatacaatacgtgccctttgtgtctggcttctttcactgaacatagtgttttcacctctcatgttgtaacatgtattagttccttccttccttctttccttccttccctccctccctccctcactccctccctcccccccccccccccactttctttctttcttttggcagagtttcactcttgttgcccaggctggagtgcaatggcgcaatctcggctcactgcaacctccgcctcctacgttcaagcgattctcctgtctcagcctcctgagtagctgggattacaggcatgcaccaccatgcctggctaattttgtatttttaatagagacggagtttctccatgttggtcaggctggtcttgaactcccgacctcaggtgatccacccacctcagcctcccaaagtgctgggattacaggtgtgagtcactgcacctggccacttcatttctttttatgactgaatgatattacattttatcagtacaccacattttgtttatccgttcatcagttggtggacatttgggttgtttccacttttggagtattatgagtaattctgctatgaacattcaggtacaagtttttatgttgacgtacgttttcagttgtcttgactatacacataggagtggaattgttgggtcatatagtaactctacttaaccatttaactacttaaagaactacgagtctgttttccaaaggggctcatcatttttcagtcacaccagcaatatatgagagtgttagaaatttgttattgctgtaacagagacttcaaattcttctagtgacactgtttttgtctctcctcttggctcaaggtctctttgtgcttgtcctcataggaattttgtttcttgcagctctcccaagctgttagccagtgttattatccctggagtctttagcgtagtagagggtatgggggaggggcagtattcgctaatcttctcattaactctttcttagtctttagggtgcatagtggtcctgtttctgggggtggaagtggtggtagggaaggtagtcttcaggtagagcctttttgccactgccccctgttccctcattggcctgtagcaggtatcttctgatgttctcagcctttgtccttgaggttctctctcctgtagattacctttttgcccgttaggtaacacagggaggctgaggctggatgcttttcccttctcccagcagtaatgaaactacaccattgtcctgacttgatacccttcccctgcagatgaagccttttgtttggtaagggaaccagggcactaagcaccaagtacccagacagcaccactctggtgctttctccaggtaccgccccctgccccggccctgcccccaccccagcttccctgtgtgagcctaattgggttcctgaagaaaaagcttgcaagcgggtgggaccccccccccataactacagcccccaagaacttcatattctcatatcagtccccacgcagcatccagcgattcaaaatttctagtttaatgttcctgctgtggcttctgccacaggtaaccaaatgctctgccctgtgtctccctgcaggcacctgtctctctgaattgggtatttgtgctgtgattcacttctctgatgggttcatgaaaatttgttaatttgctgcctgtcctgccatttgcttcttataaaaacgggaggttgttttgttttgttttttgttttctgactacaggtctgagacaaaaccagaattcttgagccttatgattttactgggaattagtcactgacatgcaatataaattaccccttttgcagaggattaattggctgcattaaaagatacatatttttctttgatatttagtgtatcagtgagattcttgtgcaaatctccctctaatttatcctgtagagaagagtttcctagggatatgtgaatcccctgtatggttcaggggctttgtgtaccttctggaaattgtatacagatttttaagggtatgttctttgttaatttttttttctgagatagtagccttatctgattcttaaaagggcccatactcgtaaagttgttgttgttgtttttaatccctagaaaaagtacatagtaactggctgggtgctgtggctcatgcctataatcccagcactttgggagactattaaaaagtcttccattctttatcaaaagctaggatatttttgactactagtctggtgtgtaaaacatatcaacctatcttaaaacattgactgcatatcatctgtaggcctggagtctcattattatccaagactttcatagcaacagaatgaaagctcatatattttaattcagtggagagcactacatactctctagtaaagcctgtttacatcattgtacctatatttctaacaagcttaattacttggttttctgacctacagcagataaaaagcactgagctacaagtgcatacttattacacaaaaagggacattgagggaagggagaataatttgcaaagcagccttcaaatgttatttcttgtgctgaaattgctcagatctctaaatcagactttgttgctcccccttctccgttatacctctgtttgatatgggggaaagggaataatccaacttaagcaacccaaaggtacattgctttatggtaattgatgttgcagttggtgttagcccatagccatcaaaacgttctgtttattctttataagaaacctgagagttattttaaactatttgaaaaatatttccatgggttttaaagtttcaaatttagaaattacataagctttttgattcattgaaaaaaatcaatgtgggatgcaatgtcttgacaaaacaagaacagagtttttaagggttttaggcacagtgttctttgctaagttttctctgctattgattttctggataacctgacaactttttttgcctaaagattgtataattataattaattccttttgcttaaatataattaccagtttgtagctgttttatgcttttggggtgacatgttagtttgtggtcagttatgtgtagcttcagatttcagtgactgaatcaaaattgatcaatctctctgctttattcacacggaccagacagtgttactctttgtgtcatacaggaagttaatgttttgacttttcctatgaaaaatgtcacacaaatgttcagaggagctgtgctttaaaaaactgccaactgagagatgttaatgagagcaataaaagccagagttgtctgcaaagggcattttcattttgtggctctggcaggttaagcattgatgttctaattgaattcatagtgaggcctcctttgtttctgcaagcatctgacaggccagatgtgcacacagtgttgggcttggcatagcttctggactgtatgttagccagtgaatcccctctttgaccataaatgaacagttatctggtaagtacaaagcctttttgtttcaggaacttttgggaaaactaccagtgcatataaaatagacacactattaagaacttgtaaaacttctcaacttcattacctagaaaggtcagggtcagcatctagatccctccttcattatctttaatttagcaacaaatggctgtgttttattttgtgaagtttctacattaccttgtggcctttggaacgttagttaaagttcttgttggggctcttgcttgggaactgtgtctttgggagccaaaccatgcacattttaactgagctgtgaactcatatctctcttaccccatcaacaattactttgtggactatagagaagaactcagttatatacttgtttctgattttagaaggaatgctatggtgatgataataaaataacaccatctagcatttatttggaaattactgtgagctccatactgtgctaagtcctttatacaagttcacccatttaatctttacaacaacccctatgaggtgagtgttattatccccattttatagataagttgagacgcagaatttggataacttgctgaaagctacagtagtgaaatcagtataccaatccaggtggtctgtcccagacccatattcctttaagattttttttttttttttttgagatggagtcttgctctgtcgcccaggctggagtgcagtggtgtgatctcagctcactgcaagctccgcctcctgggttcatgccattctcctgcctcagtctccctagtagctgggtctacaggcacccgccaccacacccagctaattttttgtatttttagtagagacgtggtttcaccgtgttaaccaggatggtctcgatctcctgacctcgtaatccacccgccttggcctcccaaagtgctgggattacaggtgtgagccaccacgcctggcctaagattttttaattatataaagtatttgcctgcttcagactttaaactgtaaaacaaaatatattgagagatccagctagattcagctcaactattttggtaacttttctataagtctctctcccctccctgttttctcctcactctgcagagttaaccttttttgttacgtttttggtttattcttttattgtttctttatgaaaatatatacaaatatgtatgtatgtgtgtgccacttctgtatataaaattctcctcactaatcgggatttgctatagttattttgttttcagttcaaaaactttaaaaatgccttttcttatcaaaagcgggttaatgagaccagtctggtaaatatgttttatatcactttgcagatatcttctgcctgagtactgaactgacattcccatccactcagcattttatgttctgtctcatgcttgagattgacttccatagcaaaataaggcagcctctcacactctgccttaagtaaaaatgcttctctagaaaacttagatctgatgctctttaatctggctagcttgtaaaattgaaatcaggcttatcatatgcctgtttttctctaaaggggaaggaaaaattataatagtcattggattcagttttcatttgcttaagaaaaacaggtatgaattggttggtggtttcccagacttcaccttcgtggaggtttgagtatttctctcttttttttgaggcagagtctcgctctgtcgcccaggctggagtgcagtgacgcgatctcggctcactgcagcctccgcctcctgggttcaagcaattctcctgcctcagcctcccaagtagctgggactacaggcatgcaccgccacacctggctaatttttgtatttttagtagagacgaggtttcaccatgttggccaggatggtcttgatctcctgacctcgtgatccacccacctcggactcccaaagtgctgggattacaggcgtgagccactgcacccggccaggtttgagtatttctgaagccatagacaaggaccacatttcattggcctctgcttttgtatacctttgtctgtagtcttcaagttactcttctgtttggtaaacatgtatattagtttcctagggctataataaattaacataaacgaggtagcttaaaacagtaggaatttattctttcacagtatgaaggccaaaagtaaaaaatcagccagtctgtgctccctccgtaggttttaagggcgattcattctttgcctcttccagcttttggtggatgtcagcattgattgatttgtggatcaatgaatcactctaatctctgcctccatgatcacactaccttctcctcttccatctcaaatctccctccacctttctcttgtaaggacacttgtcaatggacttagagcccacttggatattccagaatgatatcttcacctgaagattcttaacttaattacatctgcaaagaccctttttccaaataaggtaatatccatagtttctgggaactaggatgtggacatatctttttggaggccaccattcaatccactgcaatatgttttcaggttaggaaactatgtagagcagatttcataagcagttatggcaagtatgaaggtacggcttatgctttgtaattagatcatttggcattattcattattagtcaagcccaaagcatgatcttgtaatcaattgatatattttataaagactatcacttggaaaataatgaaatattttaggatgttgacacatactttccagaactaaggaaggatttcccacagcaccatctttcccaaagatagtagtttagcaaattggaaattgccaccactacttaaccactgcctcattaaagatactctgaggccaggcaccgtgcctcacgcctataatcccagcactttgagaggccaaggcgggcagatcacttgagtttagcagtttgagaccagcctgggcaacctgtcgaaaccctgcctctacaaaaattacaaaaaaaaaaattacaaaaattagctgggcatggtggtatgtgcctgtagtcccagctactcaggaggctgaggtgggaggatcgcttgagcctgggaggcagaggttgcagtgagccaaagtcacgctatcgcactccagcctaggtaacatagtgagaccctgtctcaaaaaaataaaattaaattctggaacagaaagacattagggagaaaaatagtgaaaatttgaatgaattctatacattagttaatagtattatagcattgctactttcctggtttaggtaattgaactctggttatataaactgtaaacaattagaggaaactaagtgaaggatatatggaaactttactatttgataacttttctttaagtctaaaattatttctaaataaattttaaaatgaaatgatgcccaaataattattaactatcagtggatacttgttacttaatttaagaaagttaaggattgttttatacaaactgttttgagtaacctgtattgttggtttaaatttagagaacccaagaaaataattcaggaaggactgcattaccctttattaaatcccaaataagctggcttccttgtcagtacttcaaacctttccaaacagaagttgatctggccatttaggaagttagagatgtttctcttgttggaagcagagtggatggggatggtctttttaaaaggagaacattgaatggtatcagttgcatagtgatggtcttctcaagatatgtgcaatatctttccaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggtatttgcatgcttgcacctttgacttagggaatgaatgctctcatgtttgtctgctgcttggggagaaacttagagtggctaattatgcatttatagtacaaagtcacataccattttcaccaattcactcagaccagtggcagattttaccaggctataataagcaataaagtcaggctcatgtatttagggacatagtatgtgcccattattcataggataaaaccatttgaagtccaatctgaaattatgataaaattttggagacaagaatttccaagtcttgactcaacagtcagtagcatttattagtcttctgagagaaacagaattaattacataatgcctgtcttagtctgtttactgttgttataacaatacctgagtctgttttatttatttatttgtttgtttgtttgtttatttattttgagatggagtcttactctgtcacccaggctggagtgcagtggcaccatcttggctcactgcaacctctgcctcccgggttcaagagattctcctgccttaccctcccaagtagttggaattacaggcgtgcaccaccttgcccagctaatttttttggtatttgttttaatagagacagggtttcatcatgctggccaggccgttcttgaactcctgacttcatgatctgcccaccttggcctcccaaagtgctgggattacaggcctgagccaccgcgcctggccgagtctgtataatttataaagaaatatttggctcacagttctaaagactgggaagtccaagggcatggcagcagcttctgaagggcttttatactgtgttataacatgtgagaaaagaagaaggacaagtgaacatgtgtttaagagatcacaagagtgagccaagctcacttttatgatgacccactcttgtgagaattaattcactcctgcaggaactcattcccacaagaactaactgctgctataacagcattagtcaattcatgagcactccaccctcaatacccaattatctcttaaagaccccacctcccaacaccatcacattgggaattaaggttccaatacacaaacttttggtgacacattcaaactatagaaacacctgtgggaagttttatatatatatatataacatatatatacatatataacatatatatatatatataacatatatatacatatataacatatatatatataaaatagggtcttaaagtaatggtatctataaatagagggtcaaaaacatagagtaatggtacctgtaaatagagggccaaaaacatagagtttgtaaatgcataaacccaaataaaaggggattactgaatgattgagttgactctaagcacatggccttcatttgcattagacctgagaagaaaattgaaataggagagggctttggttttagaaagaggagagaaggacttttctgccagaggaagtaataagtaataagttcagttaaagagtagcgactggttttggaagccattttttctttctggtctttgtgtttccaatactttacacaaaggttggcattaaacaaaatgctgagtaaaagtttgagtgaatgaatgaatgggtagaatgtagagtgccaaataaaggggctagtgggacctactggttactgtgagaaattgcagatcttattgtacacccatcaatttctgttacatattagatttttttaagggcagagataacatccttgaattctctgctcctagtactaggtttttaagacctagtcatgctccagaaatgcttgttggaatcatttctagaaacccaggctgtcctacccacagaggctgtcctacccacagagaggctgcctatgctctgttaaggaaagctccacagccttgctcagcacatgtcccaaaactcactggttcatcatcaacaccatctcctgccccctaaaaatcagagtagcatcatgaatgaacatatgagttgagtgttttcatgtccttgttgtcagtatttttatacaaatatagcagccctggtgctgagttgaccatcaccattccattgatactccgaggattattgagtgtgactagcatcttgactttagtctcgttggtaagtcagtatcaattatctacttattggaggtgattttaatcttttaggttgagtggaaaatgtcccctgtaccactttaaaaatgttatctgataagtgagccatgggtaagtagggtagcaagaatggagcaacagtttaagaacagtaatttattttcatttttttaattttttgagatagggtctcgctctgtcactcaggctggagtgcagtggcatgttgtcagctcactgcaacctccgcctcctgagttcaagtgattctcatgcctcagccacttgaatagctggggttacaggcatgtgccaccatgcctggatatttttgtatttttaatagagacggggtttcaccatgttggccaggctggtctcaaactcctagcctcgagtaatttgtccgccttggcctcccaagtgctagaattaaatgtgtgagcccccgccctcagcctaagaacaacagtaattttagaaactaaaagagtttaacttgttttcaaatatagggatgtgcgttcctaattcatgtgtggcttcagtgctctattatttgttccgagggcttcacatatttaccattataagtgctgtgaattgttggtaaatctcttctgtttcccatagttctttgcctatcatacgaaactcttaattttaatggaacaacaaggcagactattaaattattgatcatattgaattccttaatgaaatccttaactggttgctcttggtaggtatatcagtttctgttttttagaaaatatcaataagacttgtactgtagtatgtagcctttcctatggaacagtaattctcaaattttagggtgcatcagaatcatttggagggcttgttagaacagatttcttaacctcacccctagtttttgattcagtagatctgaggtgtgaggtctgagaatttgcatttctaacaactcctgacatgatactgatgccactagtctggggatgacactttgagaacaattttgttatgaaatatgtttatctcatttcctgaatttaatggaaatctccatacttttatcatcttccttggatttctcttttggctttcaatataagccagccatattggaggctcaacctatttaggatttggttggagtacctaaactttgtttggagtacctaatttcctcaaccacagctgcttatcacagcaacccttaactatcatcattttgcatgggtcaaactatgtcttgtgatttttactttctgaattttgtaagtcaccttaaaaattaaatctttgtgatatgaaattatattggaacattaataaataatttgttttcatgtccttcaacagattttcaaaatcaaatgacttcaattaacatttttaagtactatataaattcaggcctatttagataccccatggtatgaagttactctcagacttgccttttaactaggaactagtcttaaggttttttggcagagctttctatttgccatccatatacccttttcagtgaaatatatctttgtcttttgcctgttttctaatcagattctttgtttttttactattgagtgttgagaattacttataaatttgagatatgaatccattgtcaaatatgtggtttgcaaatattttctcccagtctatttatagattgacttttcgtccagttaagagggtcgttcacaaagtataagtttgtgattttgatgaagttcaatttattgattttttttttcttctggatcatgcttttaatgtcatgctgtgaacttttcacttagctctatgtctcaaaaatattcttctatgttttcttttaagagttttatagttttacatttaaatgcgtgaaccattttgaattaattttgtgtaagatatgaggcatagatcaaagttcaaaatcaggtaagttgattcttcccactttattcatttttcaaaattgctgtggctattccactttctttgtctttccattcaaattttataataagctttccatatgtacaaaaaatcttgctggattttcataaggattatattaaacctttatcacttgggaagaattgacatctgtacaagtcctgtacacattttgctaaatttatgcttaagtgttaaaattttttgagcagttgttaatggtattatatttataatttaggtttccacatggtcattgctagtacatacaaatacaaccaatttttgtgtgttgatgttgtgttttctataaccctgctgaattacttagttctggcagttttatttaaaaaaaaaaaaaaaaaagaggttccttaggattttctgtgtagaccatcatgttacctgcaaataaagatggttttatttcttcctttccaatctgtttactttttatttcttttcttgccttattctagtagctaaaatgtcttgtagtatgtcaaatagcagtggagagagcagacatcattgtcttgttcccaatcttaggcggaaggctttcagtctttcaatatattaagtatgatattaactatagggtttttcatagatattctttgtcaagttgaggaagttcacctctactcctaatgtgtggtagtttttttcataaatgggtattgaattttgtcaactgaaatgatccctatcaaatgatatgatcaggtgattttttttcttcttcagcctgttaatgttatagattacattgattgattttttttaatattgaacaagccttgcattgcttgagcaaacctgagtattagtcagcttgggctgccataacaaaatatcacaggctggatagcttaaacaacagaaatttatttctcaaagttctggagtctgaaagtcctagatcaaggtcttgcagagttcagttttggtgagggctctcttccttgcttgctaccttctcactgtgtgctcacatggcctttcccttatgaccttatttaagcttaattacctcctgtaggccttgtctccaaatacagtcacattgggggttaaattttgggggtgacacaattcagtccataacaccaagttgatcagggattatattatatttttatactgcttgatttgacttgcaaatatcttgttggaaatttttatgtctatgtatttttatgtcttatttttatgttcccgaggaatattgacctgtagtcttatatatataaaaataattatatataattaatgtatatatataaatttatatatttatatagatataaatttatatatatattaattatatattataattaatgtatatgttatatataattaatgtatatataaaaattacaaattataattaaatttgtaatttatatataatttatatataaaataattatatataatttatatatgttttatatataattttggtgacatacaccaaaattataaatttatatatatttataaatttatatatataaatttatttttatatatttatatttttatatataaatttattatatatataaatttataaattatttatatatataaataatgtgagagacagggtctcgctctgttgcccaggctggagtgcagtggcaccacctcaagctcagtacaacttccacctcctaggctcaagtgatcctcctgcctcagcctcctgagtagctgggattacaagtgttcatcgccacgcccagctgatttttgtattttttgtagagacagggtttcaccatgttgcccaggctggtctcaagctcctgacctcaagcagccctccagcattggcctcccaaagtgctgggattacaggcaggagccagtgcacccaacctctcatgatatttatatctgtattgtatcagggtagtactggtcttataaaattagttgggaaatattccttcctcttctagtttttggaagaaatggtatagaactggggttaattcttattaaaatgtttgatggaattctccaatgaaacactccagacctggaggcttctctttggggatttgcttaagtataaatttgagttcttttttttgtttgtttgtttgaggccttgctctgtcacccaggctgcagtgaaatggcacaatcacggctcactgcagcctcaacctcctaagcccaagcaatcttcccacctcagcctcccaagagctgggaccacaggcctgtgccgccatatgcggctaattttttaagaattttttgtagagatgaagtcttcctatgttggccagtctggtctgaaactcctgggctcaagtgatcctcccgcctcagcctaccaaaatgttgggattacgggcgtgagccactgcacatggcaaatttgagtcctttaatagataatttgaatagccctgtaactatttcatgttgagtgactttggttagtttgtagtttaaggtactggtttgtttcatctaagttgttgaatttacatgtatagaatggctcatagtattccctgtgttgctttcattttaaaattcaatcttggctagacttctacttccaaaaagatggagtaggtatgcttttccctatgcctcccactaagtacaattaaaaaccctgagcattttatataatgcaaacataagactttgaaagatcaggagaagaaagcagaacagctagagtccttgagacctgaggaacaacccagttttatgttccctgggatttctttttgttcccagagttggtgctggagaagctagcaacccagaagcacaaaccagcaaaaacaaaaaacaaaaactaagaaaagcctgtcctctctagccaaatgaccaggaaagggaccgcctatcagacaggaaaccttttttttattattttattatttttttgagactgaatctctgtcgcccaggctggagtgcaatggtgccatctctgcttactgcaaccttcgcctccctggttaaaatgattctcctgcctcagcctcccaagtagctgggattgcaggtgcacaccatcacacccagctaatttttgtatttttagtagaggtggggtttcaccacgttggccgggctggtctcaaactcttgacctcaagtgatccacccacttcggcctcccaaagggctgggattacaggtgtcaatcactgtgcctggccaacatggaaaacttttagacagaaaactcttctccagtcaaacaccacagaaaaatactttgggccaccccaaccttctccagcaaagatggagtagggagcttagacagcaatgatgtaccccatttggggttgtgttagaggagactgagtggacagtcaggattttcacctctgttcagcagtgtcagtggaggccatgcaggaaacaatagcaaggcattctcaccaatcccagtgatggaggtatccatggaagcctagtggggggctgaaactctcagccccacccaacagtaacagggatgttgacacaggccaaatggtgaactaggtcttatacaaccacctggtggtaacaaggcaatgcccccaaccctgatctccagccagatagtgtcataggaagccagccaaaatcgaaggtttgcataagatccagagtctcataatgccccaaatgtctaggttttagtaaaaaattactcatcaagaatcaggaaggtctcaacttgaccaaagacagatgccgacatcaagatgccagatattagaatagtttaacgaagattttaaaacagccaacataaaaatgcttcagtgaacaattgtgaacatacttgaaataagttaaaaaaaaatagtatccctctttcattcctattattggcaatttttgtattatctttttttcttgctataggttggtcagttatcttgatcatttcacagaacactcttcttatttttgtttgtttttagagacagggtcttactctgtcactcacgctggagtacagtggcatgatcacagctcactacagcctggaccttttgggctcaagtgatcctcctgcctcagcctcctaagtagctgggactacaggcgcatgccaccacgccaggctaatttttgtagttttttttttttttttttttttagagacaggggtttcgccatgttgcccaggctggtcttgaactcccgggctcaagcaatccgaccacctcggcctcccaaagtgctgggattacaagtgtgagccaatgcgcccagcccattacttttctgtttttaatctcattgattcctggtctttattatttttatccttctgcttactttgggtttattttgcttttttctcgtttctagtgttgagaacttaatttattgatttgaagctgtttctcttatctaatgtaagcatgtagtactataaattttcctctcagcacctgctttaactgtgtctcataaattttgatatgttgaatttcattttcgttctcttaagtatatatttttttaacttctcttgaaatttcttctttcacccatggattatttcaaagtgtgatttttggtttccaggtgtttggaggttttcttgttatctttctgttgctgatttctagttttctttttttttttcttttcttttaagagatgagatctcactatattgtccaggctggtctcgaactcctgggctcaagcaatcctcccaccttgacctcccaaagtgctgggattatgggtgtgagccactgcgcgtggccagtttctagttttgattccactgtgatcagaaaacacactctatataattccagttatttaaatttgttgaggtttattttatggcccaggatatggtctgtcatggtacatgttccatgggtgcttaaaaataagtgtatgctgctcttgttgggtagagtattccataaatgtcaattcgttcaactctgttagttggtggtagtgttgagttcttctgtacccttgttgattttctgtttgttggttctatcaattattgagagaggttgaggtctatagctataatcatggatttgtccatttccactttgagttcagttcatttttgcttcacgttttggagcactgttgtttggtgcacacacatttatgattgctatgtcttcttgatgacacttttatcattatataatattcctcttcatctctggtaattttctttactatgcagtctactttatctgatgttagtatagtcacttttgctttcttttgagtgatgtttgcatcatatgtctttctccattattttactttcaacctacttatatccttatattttaagtatgttttatttagacagcatatatttggatcatatttttaaatctgctgtatcaatctgtcttttaattggtttagaccacttatatttgatgcaattattaatatgttaggacttcagcgtgtccttttattttgtgtgtgtgtgtgtgtgtgtgtgtgtgtgtgtgtgtgtgtgtgtgtgttctctgtttttcatttctctgttttatttttcctaccttccttggaggttccctgaacaaactaccaaactcgatccatgtgaaatagatcatttgaatagccccaaagctattagtaacattgaatttgtaattaaaaacttcccctaaaaatacctccaggcccagatggtttcactgagaattctaccaaacattgaaagaaataacaagtgataacagtagaagagaaatttgaatcaaagatgaatagagttataaaagaaatagctaaccatgggaatatggggatatgctgctgttttagaagctctaggtttacagccaaaaagaacttagtgaaggcaaacttatcaacataaatgaagaaaatggttatggtgaaaagaatgaagatgtcccagaggaagtgatactagtgaaaaagtgcacattaaaggaattcttggaagtattttacaacattgaaggtacaaagaacaaaatgttgaaaactaatccacacttagaagggaatatgacaatttgccaaggggtagaaaaggtgcttgctccatgttgtaagttatgcaatgaaaaggagttaagcattgtaatcttgataagtttttacaaataaataaaagtgtaattctcaatgtttctagtgtttcaaattatattatattaaatacatattggttttattattttttatttcactatatgtttatagtcaatgggaagatagctttttaatgttttgacaaaatttttaaaggtcattaatgacagttttccccattgtttattaagattgcttttcacagttttagcttgcacagtcatttttacagtatcataccaccatgcaaagcaaggactatctgtaatctttagtgacagaaagcagatcattggttttctgggaggagacagggaagcaggaggatacaaggaaacttttgggggtgatggacacattatcttggttgtgatgctagttgtacaaatgtatgtagatgtgtgtgtcaaaactttatacatttaagatatatacagtttattgtatacccaaatcatgtatatgatgaatataatacttttatattcatatatacacatagatacattataagtatatgaacaatcatcacaagtagagatgagtatatgtatagatgggtaagaaaatgtgatagtggggtcgagtgtagtggctcacacctgtaatcccagcactttgggaagccaaggcgggaggattacttgagcccaggagttcaagaccagcttgggcaacatagtgagacctcgtctctacaaaaagtaaaaaaattagctgggcatggtggcatgcgcctgtagtggagctgctcgggaggccgagttggaaggatcgcttgagcctaggaggttgaggctgcagtgagccactgcaggctgcagagagtaccactacactccagcctagataacagagcaagaccctgtctcaaaaagaaatgtgatagtggctacatgaagacacaatcatgggtggttagaaaaggagaaagacaagatgtgactgtaaactacctaagggcagaacccctactgttcagataaaaaggttttcagtaaatatgtgttgtaaggagaataggaaaagaaaacaaagaggaaaatggtggatgttaattaagaaaatttgagaagggccaaaatataagtcagaaaaacaaagatgagaacaggaggaaactaagccttccattttcaccatttgcattcctttcttttttttttttttcttttcatttttgagacaggatcttactctcttgcccaggctggagcatggtggcacaatcacagctcactgcagcctcgacctcccaggttcaagggatcctctcacctcagccttccaagtagctaggactacaggcgcacaccaccgtacctggctaatttttgtatcttttgtagagatgggatctccttgtgttgcccaggctggtctcgaactcccaggctcaagcaattctcccacctcggcctcccaaaataccgggattacaggtgtgaaccactatgcctggcccacttgcctttcttatactaaaataaaaagatttttttggccgggcatctcaaaaaaaaaaaagattttttcactttctcaagtgcttgattgaaagagtttaatgtaagtagacataacattacaactaataagtgatgttttaaatcaaaataggggaatgggaggtagggaaattttactaagttcctcagtcagatcaagttttaagtttgtcacatgacctctgtggttttcataaatgtgcagcttgcttttcttagatttttttaagtgagataattcacctattataaatttttatttttatttatttattttgagacggagtttcgctcttgttgcccaggctggagtgcaatggtgcgatctaggctcaccacaacctccgtctccccagttcaaccgattctcctgcctcagcctcccgagtagctgagattacaggcatgtgccaccacaactggctaattttgtagttttagtagagacagggtttctccatgttggtcaggctggtctcgaactcccgacctcaggtgatccgcctggcttggctgggattacaggcgtgagccaccgcgcccggccatgtaaatttttaaatcaagatagaattcacataccataaaattcacccttttaaattatatggtggtttttagtatattcacagagttatacaatcatcatccctgtgtaattccaaaacgtttttatcaccctagaaagaaatcccacatctgttagcagttactagtcattctccgcttcccccagcccctggcaaccactgtattagtctgctagggctgccataacaaaataccacagactgggtggcttaaagaacaaaaatttggactttttcagacgtttctctttctctctctctccctctctttctctctcaaaaaaaaattattttttcatagttctagagtctagaaatccaagatcaaggtgtcatcagggttgacgtctggtgaggcctctcttcctagtgtgtaaacagccaccttctcactgtgtcctcacatggcctttcttctgtacgtgcacagtttgtgggggtggagctctggggtgtctccttctaaggacaccagccctatcagactaaggccccatccttatgacctctcataacctttattacctacttataggccctgtctccaaataaagtcacatcatgggttaggtcttcaacatgaatttgagaagggcctattgagttcataacaaccactagtctgctttctgttcttatggaactgcccactctggacatttcatataaatggaatcatacaatgtatggcattttgagtctgacttttttcatgtagcataatgttttggaagttcatccgtgttatatgtatcagtattcattacttttatgaccaaataatattctgttatatggatacaccacattttgttaatcctttcagcagttgatggatatttgggttgtttccacatatgggctgttacgaataatggtgctataaacatcctcatacagtttttttttaaattttaatcaggtcctctagaagaaaattcatacaggtttttgagtgcacatatgttttcatttctcttgggtacatacctaggaatagaattattgagtcatatggtaactctatctttaacattttgaggaattgtcaaactattttttatagcatctgcaacattttacattcctgtcagtaatgtgtgaaggttacattttctccacatcctcaccaatacttgttattgtctgtctttttgttatagcctttctagtgggtatgaagtgtatttcactgtgattatgatttgcatttgtctaatggctaatgatgttgaacagcttttctcgatgtccttcttagccatttatatatcttttgaagagaccttttctactttatcacacaaaaaagcctttatgaggtcagaaaacacaagattttatctttgtcttctatgaaatgctgctgttcacacagccagaatgagtcgtcttaagtcccatcacattcatttgagtatgtatgtccttggctgctgaaaatctgaccctttaatgaatagggcagcaaagttccctgaccatcagtgttctagaatgtcccattttttaatactgcatccatgcacacctcctatgttgtctttggagaaattattcagatccttaactcaatttttttaaacgggcagtctttttattgagtcataagagttctttacatattctggatacaagtctcttatcagaaatatgatttgcaaatattttctcccattctattgattctctttttactttcctcatggtgtcctttgaggaacgacagtttttaattttgggccaggtgcagtgactcacacctgtaatcccaacactttgggaggctgaggtgggaggatggcttgaaaccaggatctcaaggccatactaggcaacatagcaagtcctcatctctacaaaaaataaaaaattagctagccatggtggcgcatacctatagtcccagctgttcaagagacttacgtggaaggattgcttgagcccaggagtttaaggctgcagtgacctatgatcacaccactgcactccagcctgggtgacagagtgagaccctgcctcaaaaaaaaaagtttttaattgtgatgaagtccagtttatctgtttttttttttgttgttgttgttgttgcttgtccttttgatgttatatccaagaaatagcaaatattgcctaagccaaggtcaagaagttttatacctatattttcttctaagaattttatagtttggctattacatttaggtctttgatccatttgaattcatttttgtatctggcttgaggtattaggggtccaagttcatttttttttatgtgtggatatctagttgtcacaacaccatttgttgggtagcttcctttttgaaaatgatgaacactgtaccccaaacccacctaccttggttccatgtattccttataagtcaggctgctatgaaagaaagcatagttattgaattagcaagaaatcctagttttatattttgaaatcttagttcttttttcagagacagcgtctcgttctctgttgcccagcctggaatgcagtggcacaatcatagctcactgtaatcttgaactcctgggctcaagcaatcctcctgccttagcctccccaattagttgggactacaggcacatgccactgtacccagttattttttattatttttttagagatgggatctcgctatgttgcccaggctggtctcaaactcctggcctcaagcagttatcccatcttggcttcccaaagtgctaagattacaaacatgagccactgcacccagccagttttatttttttaatctcctgtttcacagatctaccaaagtgacttaaaatttttttatctagtttgagatgctaatttctgtactttatgcttcactctgtccaaatataagggaactttttaaaagttaatggaataatggaattaagtgatgaaaattaaaaatataaacttcatttctcaacgtaagctccatcaaggtcaagacacttttgtaagcaatgataccagccatttagttcttccctagagaactgagcgtcctgggaatttaaccatgtcagtgcagtcttttttgcattattaactgaaggaaaatgggtacccttaaagattttttaatattaggacacaaaaagaagtcagaaggaggcaaaacaggaccgtaaggtggatgcttaatgatttcccattgaaactctcacaaaattactcttgtttgatgagaagaatgaactggagcattgttgtgatagcaaaagacgttctggtaaagctttcttgagcagttttctgtaaagctttggctaactctctcaaaacactcataataagcagatgttatcattctttggccctccaaaaagtcaacaagcaaaatgccttgaacatccccaaaaactgttgccatgacctttactcttgactgacccacttttgctttgactgggccactgccgcctcttggtagccattgttttgaatgtgctttgtcttcaggattgtactcataaagccatgtttcatctcctattataattcttcaaagaaatgcttcaggatcttgatcccacttgtttaaaatttccattgaaagctctgcacttgtctgtagctgatctggctgtaaccagtttcagcacccattgagtgaaaggtttgcttaactttaatttttcagtcagaattgtgactgaagaactgtgactgtatgctgaaccagttgagatgtctgtggtgttggctgttgtttgtgctgttaatcatcagtcctctttaattagggcatgaacaagatgaattttttccttgcaaattgatgagatgtaaaaatgatgtgaatgtgggctttatcttcaactttgtctcttcccttcttaaaacaagctatccatttgtaaactgctgatttctttggggcattgtccccatgaactttttgtaaaacagcgatttctcctttcttctacccagatttcaccataaatttgatgtttgttcttgcttcagttttagccaaattcctattgctctaataggggcccttttcaaactgatgtcttatccttcttagtgcctgtaaaagttagtatgaatttatttttgtgtaaatttttgaaatctacatatagttttttattttccatgaactttttgaagacctcttatatgttactgttttcccaccctacatgacaaaacagcattatgttaatttttattggttaattttataacttttgtgttagttttccttttgtgtattttaaacagtttttgaaattaaaaatagctttattctcaaaaaccataaataaaaatgttctcttccaatgtaattgccaagtttaaataaatgtaagtgttctataacaaacccttgcaataattatttttagatttaaaactcttatcttcagtgattatgtattactatgttaataattgttgaattgtaaaaattatctccaccttccaaattttaaaaattgtaagtcagagtgcattgaaagcatgatgacattccttaattctgcactgaaggtttttaataaagaatgttatagcaattcacaataacatgtggaaagtatcagaatgtaaaaacaaaaaattatgaatatattattttgggcttgctacttcatattagttttggtaaaattaaaacccaattggttagtttctgctgatggaaatctcacttctatggagaaaatattacaaaatgtaaatctgttagagaaatttaagaatgaatctggccgggtgtggtggctcacgcctgtaatcccagcactttgggaggccaaggtgagtggatcgcttgagatcaggagttcgagaccagcctggccaacatggtaaaaccccatctctaccaaaaatacaaaaaaattagctgggtgtggtggcttatgcctgtaatcccagctactcgggaggctgaggcatgagaatcgcttgaacctgggaaacagaggttgcagtgagccaagattgtgccactgcactccaccctgagtgacagagcaagactgtctcaaaaaaaaaaaaaaggaattgatctaatgtaatacaatagtaaattaagttaaaatgtacttgaaaatatttggaaataattattatgtattgggatacgccatttgttatagcaaacatcctcaaaagtctcagcatctttttttttttttttttttttgagacaggatctctgtcacttgggctggagtgcagtggcatgatcatagctcactgcagcctcgatctcccaggctcaagagatcctcctatctcagcctcctgagtagctgggactacagacgtgagccactgcacccaaccagtctcagcatcttaatacaatgaagtctttatttttcgcacatgtctccatccaatgtgggtttgaatgtggatcccctctgccccacacagttatttagggacacaagctctttttatgaatggcgcttttatttactacccattctcttttctactctctaacttctcaatccagtcagcatgaaaagagtggagggttatacagttggggtttttttctggtgggggcagcgggggtaggctttgaagtgacttacctacctacatatcattagccagaactcactcctgtggcccacctaacagcaaagggggctggagaacgcagtcttgctatgtgtgcaggtggaaatggaaatagggtttggtgaacacctcgcacttctctgctgctctttgatagtggcattacaaagtcaaagctatgagatcacaggaaccttattggttttattcaccactgtaaccctgtagttgatgctatggtctacactgcacagatttccatatagtcttaggatctttccacctagtgtctcagcaggatagtctgacttcttacagacagttcaggactccaagagtgaatgttttaagaggtaagaagtggaaggtgctcatttcaaagcctaggctcagaaactgacacagtattacttgcactatattttattagagcagttgcagagggcttccaaattgaaggaaaggaaaataggccccatttctcaataaaaggcatatcaaaggatttgtggccgtctttgatctaccacgtcataatatttttaatgtttgtctttttttttttttttaagagacagatcttgctatgttgctcaggctagattcaaactcctgggctcaagctatcctcccgcctcagcctcgtgatgagctggaactacaggcacaagctaccatgcctgtcttgagttacttgttttgttgcctatagacagattagtcagctagagaaactttactaataagactaaagtacactcttgctttttatttattaactaatttataaggttatcaaaatgctttagcatcttatttcctaatggacttagagcagtaattttggatatatgtataaattaattgacatgatccttgggtgctagaattactctactcgagctatagtaactgaaaatggatgagggagaaataagaatagatagagcacatcctttcagaatctttgttctggctttcagatgaggttttcccatctgtttcactgtcctttctgcagtttccctgttagttcagtatagtgtatatatgtggtgattgaggggaggggtacagagattacagagccatcttgcactgtaagttatagctgcttaggtaagtactgatgaccaaaagaaatttttcgacagtgagttcaacaaataaagatggtgttaaccctatttacatgtctctaggtagactgaaggattttgagtcattaacagtgagcttcagatatttctttttgggtattcatttatatattttaatcagtttctattgcagtaagattccaatagaaggaaaacaatgcttcattttttgttgaaagcaaacatacattataagttgtataatacacaatgattaatgaagttttactgtgtgtgtgtgcatgtgtgtatgtttttaaaattacggatgaactatcatacaaataaaaacaatcagaatacaaaaaaattaactgtgtagtgtatgcttatacacatgcatatatgtatatataaatgggattgttctataacttgcttttttcacttaatatatacttctgcatcgttaataaaactgaaagaggaaatgattggatatagataggtccctatttccccttgcaatgtaaactctggacttactgggctatggagatcagtgctttctttactaaactctagactcaaatatacaactgtcaattcaacagttccacttggatgtccagtagacatctcagactaaaaatgtcccaaactgaactactgatcttcccaaaccagttctatttgtagttctctagctttagctgatagaaaaatctatccttctagctgtaactctgtcttttcagtttaagccaaaattcttagtcatctttgattcttcattgtcttatatcccatattcaatataacaggatatcccattaactctactttcaaaatatatccatatttcatatagtaaaagaacaacccctaatgataaatggaaacacatgcctgcctcccactccactgctgtatttggtcatctaggcccctcccatctccccttactctcctcaccccatctccttcttcccacacctccttcttcccacacctcctttttcatcccattttaggcagcagcattctatcacttttactttcaattatgagaattcagtaaggagcacaatgtacagagcactttcttttttttttttgagatggagtctcgctctgtcacccaggctggagtgcagtggcgcgatctgggctcactgcaagctccgcctcccgggttcatgccattctcctgcctcagcctcccgagtagctgggactacaggcacctgccaccacgcccagctaattttttgtattttttagtagagacggggtttcactgtgttagccaggatggtctcgatctcctgacctcgtgatccacccgcctcggcctcccaaagtgctgggattacaggtgtgagccgccgcgcccggcccagagcactttcctacacatttatcttatttaaaatttaaaacagtccttttgcagttttccagttactattgctgatgataatttgcccccaaacttagcagcttagagcagctgtgttatacccattgattctgtgggtcaggaaatcagatagggcacagtggagatggcttccctctgctccatgatgtgtctagggcctcatcaaggaagacaaagtttgagagtgacccaacagctgggcactggaatcaactgaaggcttattcactgcgtgtctgtgtaacagcccatccctgggcttggataacatagactacacatggcctttccattagtttggcttcctcatagcctaacaacctcagcatagtcagatttcttacaggagtcaggcacagggctccaagtgcatgcgttcctgcaaaccaggagggagctacattccattttatgacccagccttgcagttctcatggcatcacttctattgatcaaaaaccatcacaagccctcccctatttaaggggaagggagatagacttcactacttgatgaagatgacaaagtcacattgcagaagaatgtgggatttggaaaataccatctgtcgcaggggttatcattgtcctttgttttgagtcatggagacttggagagaagtgattatcccagagtggtaggatgaacaagggtcatcttgggaaatgattcctagagttgttattacagtaactactatctagttagttttatttgtgtgtttagagatagggtcgcactctgtcacccaggctggagtgcagtggtgtaatcatagctctctacagcctcaaattcctgggctcaagtgatcttcctgcctcagcctcctgagtagctgggactataggaacataccaccacacccaactctatctagttcatttttaaggcatttatttcaaacctttacaaaacctatgaggttttggttttatgcagtttctgcagtgttcacaaatgattctaatccacttattaggaaatgtagcatagtctgtacctgccaaatatttagatcaactgaagagacactgaggggtctctgtacataagacactggaggaggccatagatcaggttagagtgactgcagttacctttttattgcctccttagttggcacagcagtatccacaaaggccagaggtagtagtgttccagccactggtctcccctggagagcagatgtgattgtgggtcctttcaccaaaggctagtcatctggaaagttattacaacattcatttacatgcaagcatccaaattgaaagttgaggttacctcatcctaacaaaattgctcatgcttctgggcttgcgagcttttgctgatttggtcaatggtctagtgaccatttaaagagtatcaggccgggcgcggtggctcacgcctgtaatcccaccactttgggaggctgaggcaggtggatcacctgaggtcaggagtttgagaccagcctggccaacatggtgaaaccccatctctgctaaaaatacaaaaattagcctggcatggtggcatgcacctgtaatcccagctacttgggaggctgaggcaggagaatcatttcaacctggtaggcagaggttacagtaagctgtgatcatgccactgcactctagcctgggcaacagagtgagacttggtctcaaaaaaaaaaaaaaagtgtgtctatccatagtacatagccaagaaagaaaatcacccatccagggaggataatcctgggatttcctccagctttagccatgttatatatactcgaagatattgaagctgcatttaaaaaatcccaaacatattttttttcactaattctcacagcccttccccctctatcattataagtacaataatttctccttgtgagtttatattaacttcatcttttacccatgtattttcttgtagttggtgttactgttttagtatataatttattgtcatggtcttggtccttagatgcagacctttagttcaagatacacgaggaaagatgagtgagatgacattgctgtcattatcattattgtaaattttgcatcgaagtataatatccacacagaaaagtacacaaagctgtacagctgaatgaattttcacaaattaaatgcactcatttatctgccacccagatggggaaataaaacatggctgggcacggtggctcatgcctgtaataccagcactttgcaaggccaagatgggagtatcacttgagcccaggagttcaagactagcctgggcaacacagtgagaccccatctctacaaaagattttaaaactagccatcgtggtggtgtgtacctgtagtttcagctacttaggaggctgaggtggcaggatcacttgagcccaggaggttgaggctgcaggagctttggtcatgccactgagaactacctaaaaaaaaaaaagaaaatattaccaacacccaagaacccctccttcttctccctgccagtaactgacctccctcacccaaggtatcagttttgccagtttttgagcttcctatgaatagactcctacagtgtagtcatttgagactgaattgttttgctcatcagtaggattttgccatccatccatcctgttgcatgtagtaattcattaattttcacttctgtgtcatgcattgtgtgaatatgccacattttttattctgctcttgatatatatttgggttgtttccagtttttacctaccataaaaatgctgatatgagcctttttatttatcatttggcatgcatctgtgtacacttttgctaagtatatacctagtgtgggtttgctaggtcatgggtatgtgtacgttcagctataatatctgctgccaaagtggttgttcaaattcacactcccaccagcagcataagagataatctatttgctccatttccttaccaacatttagtattttcaatttttggacagtctttttaagtttaattattctggtagataatagtgattgtaatttcagtttgcatttccgtgataactaatgaggttgagaaccttttaaaagtttatttgccatctggatagccttacttgtgaagtatctctttaagtttttttgcccagcttttaattgggttgtctttttctaattaatttgtaagagtttattatatattgtagatgtaagtcctttgttgtctatgtgcaattgcaaatatcttctcctgtcccatggattgcctttttattctcttaattgtctcttttgataaccagaagttctagtttcatttttcagtctcttcctttatggttaatggcttttgtgtcttatttaaaatatctttgcctgccccaaggtcataaatatattctcctctgttttcttccagaagcttaatgagcatattggtatagaaaaacatttatagcctaccttgttccatgtagaatttgaggcgattgagatgaatagttagcaaaacggtcttccttttagaagaagataactcttgacaaaaaattgggtattctcccttctaggccatgcactaaagaaacatgacatatttaatctcatagtctctaaagaattcatatgtctgtcctaccctttttagttgggtatgtttcagttggaagcaggcctctaacagcaattcccaaaattttagtttcaattagtatttgaggtttctgcatttttcctcaaatatttgttccctttggctttaaaaactccatatagtagaaaaattaaaatgtgcaaatgtgtgtcgttgttattagctttattcaggttcattatttggaatcaggcttttggaagaatgcttattaggaggcagtattctctacatttatagggtggactatgcctgtatatattttatgtttattcattggaatatgtttgtgtttgtaaatccttccatatatgtgatgactctagagtaaagaaactggctctagaagccttccggagaaatgattttcattattttatgatgacatacgtgtgtttatttctttttttagatggaccaccttgttctttaaaattgccacagaataataatccagatttttctcttggttaaattttctgaggcctcatacagtatttaaaccaccaataataacttgttggcatgaaaaaaatttatttttttctctggtttccttgccttgagcccttggatgtcaggaagggtgaggggaaatatcagtctgcttgggcttagatttatggttgctattgtttatggttgggaaatggattgagtgtgcatagctccatggcctcttggctttaactcatttgcataaatagtgaaaataataaggaatataaaaacaataacaatgacgttattgagcatctatttttactgtacactaagccaaacactttctgtttttttctatataattgttataatagtcctacaaatttggcattttttcccttcaacttttaagttcaggggtacatgtgcaggatgtataggtttgttacataaataaacgtgtgccatggtcgtttgctgcacaaatcatcccatcaccaagctgttaagcctagcatgcattagctattcttcctgatgctctccctcccctcactgacaggcagcagtgtgtgttgttccccctaccatgtgttcatgtgttttcatcattcagctcccacttataagtgagaacatgcaggttttggttttctgttcctgcgttagtttgctgaggataatggcttccaactccatccatgtccctgcaaaggacatgatctcatttttttttggctgcctagtattccatggtgaatatgtaccacattttctttatccagtctatcattgatgggcatttaggttaattccatgtctttgctagatattatttttatcatatttaatgattgttatccttacattttagctaagaaaactgaaccttatataaagtaagtggccaggcacagtggctcacgcctgtaatcccagcgctttgggaggccaaggtgggcggatcatgaggtcaggagttcgagaccagcctggccaacatggtgaaaccccttctctactaaaaatacaaaaaattagctgggcgtggtggcacttgcctgtaatcccagctactgggaggctgaggcaggagaatcacttgaacccgggaggcggaggttgcagtgagccgagaccatgccactgcactctaccctgggcaacagagcaagactccatctcaaaataaatgaataaacaaacaaacaaataaagtaatagcctgagatcaccatgtaagtgagtgacagaaaaaaacaagcctctgtgagactaaagcttgttttctttaccaccatccagtattgtctccgtgacagaaaattattaatttggctgaaatatatctttggtatgggatctggctgtgcctttgtgcagatatcgccccctcccaggttggtttcctcttctaaataaacttggtggccattgtaccaagaacacactaatgtgacgacattttattagaatgaatgggccagtcgtggtggctcacgccagtaatcccaacactttaggaggccaagttagaaggattgcttaaggccaggaattcaagaccagcctggacaacatagtgagaccccatctcttacccaaaaaaaaatttttcaaacgttagccaggcatggtggcatgtgcctgtagtctcagctacttgagaagctgaggcaggaggatcactggagcccaggagttcaaggctatggtaagctatgaccttgccactgcattccagcctgggtggttgagcaagagcttgtctctaaaaatttttttaaaaattagaatgttgggaaccaggatccatgagggtgaataaagaatattgtaagcagtcagtgagttaacagcacatgacaaaactaaatttgtaaaaccatttgctttctagaaaggaatctgccatacctcccagagggcatttagccatccattcagtgcctgaaatctgtcatttgttgattgttatcattgtctttctgttgcttttctaggattatagctgagaaggtaaaggacgttctgtttatccgaccccggaagtatattcactg

SEQ ID NO: 5675 - DNA, 111954 bp, human; identical to SEQ ID NO: 5674

SEQ ID NO: 5676 - DNA, 111954 bp, human; identical to SEQ ID NO: 5674

SEQ ID NO: 5677 - DNA, 222397 bp, human; identical to SEQ ID NO: 4520

SEQ ID NO: 5678 - DNA, 222655 bp, human; identical to SEQ ID NO: 4519

SEQ ID NO: 5679 - DNA, 88464 bp, human; identical to SEQ ID NO: 3417

SEQ ID NO: 5680 - DNA, 88463 bp, human; identical to SEQ ID NO: 3418

SEQ ID NO: 5681 - DNA, 786 bp, human; identical to SEQ ID NO: 3416

SEQ ID NO: 5682 - DNA, 152057 bp, human
tccgcccctcactgcttcgttaggttgtgcgtcatttgcttttcgcttcgcgtagggtgaagctgtagctacttcggctttggtgggagggaggaggggtctggaaagggctgggctcaggcttttcccgtccggtagaggttctcgcgggatcgcgcggaggcggcggtggctcggttactgactgcagtagccgcggaggcggcggcaaggtcttcggctcgtgccgttctaagccggagaattctcgcgggagcagggttacgtcctcgtgggattcgttggcggtggctgaggtagctcgcgggtggggggtgggggggcagtgactagggtcggtccgcctgctgttaagatggcggcggaggctgatgtctgtccggccaggacccagcacagaggtgttggctatctgcctttatgacgcctctgaggtgcccagcgttaaggaggtgacgattggcgaaacgccggggtgccggtaaactagacctgaggcgaagaccacctcgtttcttgtccgttgaggcgacaccatttcctgggcctcggccgcgtgtgggcccgcctttgccccaccgatcggtcaacgcctccgttgtcgccgccgcagtgggcggattgggaagggtgggaggggagtctggagttcgctggggagtggggttgggggttaaattgaacggtgggaaagaggagcaaccaatgaagagtggcccctttcccctaccttttctgccggccaacctccgttctcagcacctccgacgacccggatgaataccctggtttttctcgaggtggggtcatcttcgccaactctcgcggttttagagctaaggcttagggttcaagcagtagtgtcactggtgtactcctcctcctctccccacacccctcctaattctgtcgtcccatctaatcttcatctacgtggatagttgaggctggtatttaagggaggggggagtcaaagcttttccctgtgactccttccccagttctaaattcgagtttagcctaagtcctctagcccgctctgtctcccccttccattggtccccttggcgcaggcgttgaatagagcttatcctgttgcctgcatttactccatctttgtggatggtgccatagtagccttccatttccttaagtcttcatgtttgtatgactctgatccggatttcttagctctgcatgctgctaaaccactattaagcgaaactatgaacgggtcggtgtttggatattgcagtttaagtggccttttcgtttacggccattagccttgccttcctcattcctccccctcagaaggctgtagaggataactctccagtaaacccgctttctgtcttccctgcctcttccatttcccctgcaagcctgggaaccgccccttttccctgccttgctctgagtttctggagcctcttggtctgtggacatctatttttgctgctgagcacctcttacctgcttctcacttcttaatctttctatcccccactccccatactccttttccaggagctgaatcccttagaaggaagataaccctcctctcaggctccactacattttaccccttccatttactagaaaacagcattgattgtcctgccccccagtctgccctgttctttatttcctcttccccccatgccaccgttactataggcagttaattccctatcatttgtttctcctttgtagattacatgttcagcattgttttcttttagccccagtgttgcatagattgaggagataccaacattccccagtcataggcggcggtctggtatggtgaaattaatagtgtgtgttttgggtgtgttttgggttcacattgaaccttgtgaccttgggcaaattttcagattctcagttcatctatataatgggaatagttgtgcttacattagaggattgttgctagaattagttaaaataaaataaaataaaatgtttagctcatggtaggcacataataaattaggattactttttggtgtaagaatgcattggtagatgtacctgtgtcatatgctaattttatgacctgggaaagagtaagagatttttgtttctttaactgtacattcttggtgtatttctaggccagatctataacgtttatattttttttcctcataggccaaactttttatctccagtggttcatgatgtttgaacgtgattcccactctttgtttccttctaatggtctaggaatttcagtgcgtaatcactatcctggaatgaccaccagccataatgttcctgtcaagaaccacacccaagtgttctaccttttggaaggggtgcctcatgccctgcctactcatttcttccactccttcaaaggcagtctgtcctgtcattcactctacaaaagtaatttggtgtcatgcatttcacagtggtaaaaggaacttctgttagctagttttgaagtattcatgctacttttcacctccctcatttgtttggttcctcagatcagtgtggggatctgctatttggcatcttcttacctgagcaagataattcctgtccgagagagaaagatcatttggaatacccagcttcttttccatagcaaattactgctggctctttaatacactacttcctgttgtgttattgccattttatattttctaacgtacttattaaacagatgtgactatttgacttggagaaagttttccttacttttttttttttttttttaagatggagtcttgctctcgccaggctggagtgcagtggcgcgatctcggctcactgcaacctccgcctcctgggttcaagcgatttacctgcctcagcctcccgagtagctgggactacaggcgcgcgccaccatgcccagctaatttttgtatttttagtaaagacggagtttcaccacgttggccaggatggtctcgatctcctgacctcgtgatccgcccgcctcggcctcccaaagtgctgagattacaggcttccttactgttaatatattgattagaccaatattaaagtgtagcattttacaattttttttttaactaattctagcaacaaccctttaatacaagcacaactatccccattattttacttcggctgggtgatgggaattgaagtagaaacgtggtgaaaagtttactaggatttaaaatttacaggaggtaaccatcccacaattagctgtatgtggactctagtttcgaacttcagggtctgctttatttaatttgaagtgctttgtaggtaataaaattttcttccattttcattggagggcaggaaatcactttctgttttgagattttgcattggtgcattttaccgtgggttaagcagtgatcacaaatttattaaacctcaatttcaatttgacccttattgagcaatagaataaatctgggaatgataatctaggtgtgacctaaaagtttaacttattctaggtagatctctgagaagagaggaaggagtgacaataccaaataaaaactttgtctaaggttcaatggcaaagttcaacctgagttgccaggatgtttatcgtttgtctcccaatatggccaaaaagcatgtatgaaggtgaagaataatttttatatgtacagttgttgttttttttcacagaaacaatgaaacaaatacgtccttagtgtttatattgagggtataaacttgtctaaaaaataaactgtcttctataatttcatttgggttgagaactcagttttcaggaatgttgtctaagcgttagaagtattagagttgttggttctgaattcctcagttacttctcaaagcaggtcctaaaaaatgcaaatagatatgtaaggactattgctttagaaataataactagttatgtttgaacataatagaatggttaaccctcctcacacaccctaataaatgtgttgtgtatctcactcctctcccccaactttttttttgtaggtcctccagcagcctgacctgagtgggttagtgatccagagaaaccagcaggccaacttggtcaggaaggttcgggaagctgttggagcagtgtggggaatttcccaccaggatgagtatgattggctgtgattttaggttagtttttgtaaatcttgtgggaagtatttgtattttacttcctggaatggagatagtaggggtggatgtattcccattctgtaatggagctactttggtttcttccattctctggatctgatgtggtactggttgcttctttttttaaagtggagctcattactgaattaaagggaattgtttaaatgaatgatgtctgtacatgattttttaaatcaccctaggcatcgttcaaaaaataaaattgcaagtcattatgtctaaccagttcttattaaagttacgaaaaatttcaaacatgcaaacattgaatagtataataatccccccacttacccatcaccagctttaatagtatcaacttgcacattctatttcatctatacttctgtttgtttggttttttttaatttttttaaattgagatggggtttcatcgtgttgcctagactggtcacaaactcctgggctcaagccatcctcccttcttggcctcccaaagtgttgggattacaggcgtgagccaccaggcccagcctgtttcatctatacttctaaccactgcccccctcaatggattatattggaataaatccctgtcatatttatttgtaaaatacttgtttgtatttctaaaaggcaagggctctttaaatataagatcaaaactattatcacaactgaaaaaattaacagatatttaaaaatatcaaatataaaatgttcagatttctgatttttttttaagctttgttttttttcttttacagtttgtttgaatcaggatcctgagaaagcacatttattgcaaagcattgatacagctgttaaatctattttaatctgcaggttctgtcttttgttttttttttcttccaatttatttgttgaagaaattgtcctatatatagtttcccgccccccatatttggggattacagcccagtagtggtgtctaacccattcttgctcaattaaagaccctggaggacccattataatggaacaatggctataatctcctgtatcctagttggagttgatagtgctgtcataggcactatcctaaaataactagtcatggattcctttttctgtggcaaagtctgatttgatacctgacttcagttccatgtcttggccttgctcattgctccacatgaaaagtaggcctcctggtggaagaagctagtgtttcctaatgacctgattgtgcctttggggtttttcatgcatggtttcaatttccttaggtgatttagttatttttatactactttataatgttgctttttattcttttgatgttagtgtctcagctgttctgacccataacttctaagctattaagacctaataatgagttcctggctgtcatacagttcttgaaatggcaatactaaaacagtttttgagagcttctacttacatgttgattttcagctattatacacaaccttagttttcctactgtgatttttcatttcatttcatctgaaatttatgtttccttagcataaagtcctttaaggacttttaggctgctttatgatgatctcactatctataaggttgatattcataagtacttgggcttttggtgttttgctgtattattcgttgtttcctcaacgactggttactagatgtttatatatgttaatgtcaggaataactcaacttttaagtcgtttgatgtttcataggtggtgttgttaaaacttgatgtacttgttgaccagcttggtcttctggatatagaaatcctttcaggtagtgaagaagtggctctatgagtaaaacaactgtaggttttgtttgggctgttaacctgagcattttcaacttttaagttctctttaaaagtttttagtcatttggctttaaaaattacagttggtggcatagaatgatcccataatgtgattttacagaaagttggaatgttttaatttattatgaatgtaccattacgtggagattgggattgtagatctgattcagtctggattgctgattgaactagatgaatgttaaaattcttcaactctgagattctgatggtataatcttaggtattgaaagacagcagtttttcctttcagtagtcattaagtaaatggtgactaaaagtagggagatgaattattctggaatgacctttcactataaccatttagatttaaaagattgatgagtctgaggatactgtcatgaatttatgtaccacctttagcacaatccaggttttaggtccttgtgattagatatcagagataattgccccagaagtgcgtgggtatattacatttggtggctgttaatgttttggaatgattttggaagattactttgggtacattatttgctatgattattttcttatattcctgtctattttatagtgaggcatgtttctcctggtctttgctttttttttttttttttttaaacttccaatattctttattacggcattctgacaattgagttcttacaggtggaaagacctttcagcacagcgattaagaacatggactctggagctagattcacagagttcaagttctgactcccatttcttaccaggtgtgtcatgttgtgcaaattacttaactgctttgtgccacacggtccttcatctgtaaaatgatgataatactgcctgccttatagagttctgaagaaatttagctgagttaatgcatataaagtgcttagaacaatggttctgaaactttagggaacatcagaatcacctagaggacttcctaaaagattggctggtccccactcccagagtttctgattctgtagatctaggaggggccccagattttgcatttctgataagttcccaggtgatacttctctatttcctgcaaattggcagctggatccagagacttgataaatttcaggttcgttccctttggcaaatatattgcgggggggtggggtgggggggtgttcattcacaacattgattatgttacgatgacttgaattttttggatccattaatttgttggggggctacaaaatggtgacgttctgatgctatcattttgttttcatctgttagctggaataattttgtttcccctcatcttttatttggttactcagcaatatagtttatataggaagagcaggataaatactcaattttttaaaacattgctttcaagatgatgaattggtcccctgtcatcttcaaaaggttacacatataagtgtatatataactatgcatccatagatgtaaacatttgatgggtttcaatacattgcagttctgatccttagcgaagttcaaattgcccttcttgtggctagtggaactctcttaaagttggctcctgattcttactgacatgctctctagtagtctttgatagcttccttgctatctggtatgtcaagatgtttccaggcgcattcttgtgcatttctgccccagacctggaattagctaatgggattaagataaaaggtgaagtcaaaagaaattctgtttttgccaagggtagcttggaactttctatcaagttccacttttctctttccacttaacctccctagcctgcctcttcattcttctctacctttttattagagttaaggtggaaaggtttgagaagccttgataatcataggaagatcatggagcccaggcagttccggatttggggcctggccacttactaggtctgtcagtttgggcaagttaacctatatcagttatgatgtggggaaataccttattcatatggttattggaattaaagagaaaatgtaaggtgttagtacatggtaggtgatcagtagatggtaatttatttaatgtactattttacttaactccttcaacagctcagaggtgggcagtcagggtggtgaaaataatggccatttaacaaaatgtgtctggaccctttaggtctgtgtgggatcatcagtggtgaggcaggatagggtttgttcttgagttattttgggtctgagactttggccagtgataactgaatgttccatagagtagtttttcactttggaactccttaggagtcacatttataccctctgaagggtcttagctagttctgtaatgtgtattacattggttaccttgatctctctccgtctatactggcccctcctattcaaggtgttcaaggttctgttgtaaccttagtaacctataataagtattcctaatagtcatcagtatcaccactgttaacacatttgggcagcaccatgcatggcaggtcagcaaacaggtaaatcttatttttttaaacattacacataatatctaaagtatagtatgtggcatgtaataagtgctgctgaataaatggaagtcattgttcagtttttagcttaatatatctttttttttcttttaacataacatttactgaatgttgctaagtataaggagtaagggacataaaatgaatgagacttggtctctgcccttgagaaactcacagtcgagttaaggactgtgaaatcatgtttaaagttccttagccttttcctttgtgtcatcatttcttcccctgcactgtctatgcatgatatagcctgtccattgtttctcacagctttcctaattctgtgtgcctccccagcctttgagactgctgatatgtgagaaagccaacaattgtcttctattaatacagggtaatatcaagaaaaacctttgggccaatattggatttcagagtggcatgtgcagttgacattacaataccagtttatggtctttagatgggcctgtacacctgggctccagcctctttcctgtgcctttaaactgccttacttccatctttcctcccctataccctacccttaatgtacttggtacataaaaatagaggctcccatacccaggtagtgatcaagtacaatgtaaagaaacagctgtacttcatataaactaggattcgagtgggcctagggtatatcactaaatttccattcttatctataaaacagtaatcggaaagcctatttcataggttgctgtgagcattaaagcgagatgatgtatttttaaatgcttgtaaagtacgaagataaggtcattataatttatataaaatacttagtagctatgttacttggggcaaattacctcatcactgagccagtttcctcatcctttaaatgaagatggtgatattcatttaacaaatatttattgaggacgtagtcattgcagctacatcctgggaatacaaagataagtgactggagaatgtaggacagtgtggtctaggggaaggagacttgcaaatcacacaaaagggtcagtatggtaatatgaggaatgaacaaaatgtgctatagcagtttacaagaaggcatcagagaatgtcacagagttttgttagggttaagcaagataaatgaaaagtacttcatgaattcaaaaatgctatacaaataagttagttaaacgtaccccaaatgaatcaatagtctcaaaccattattgtttcatttcttcacaagacttactctttagatgcatttatttctttgagctagattttatgacctccttaagggtaacctgtagtagagtatcctgaaagttaatgcttttgtctaaaaggatttttttcatccattttatcattttctagtttttaatcactgaattcaggaaaaactagaaaatgtgtgcatatttggggagaggatatacataattccaccacaatgtttagtcactgttaacattttggtgtattcacatcttaatgataagggtagtgtttaaggaataagaaaagaaatctagtaggaaattttaaggataggcatttcccagaataggaaactaaaaacgtccactaacaagaaatggtactcaaactaataatcagaaatgcaaatttaaataaggtcatttttagtcattagattgataaaaaataatttgataatatcaagtcatcgtaaaaggtataaggaagagtctggccttataatactgcctacaagtggcgtaaattgatacagctattttggaggcaattttggcaagttgcaagagagtacatactatgtgatgctatttatgttttaaaaaaaaccatggcaaactgacaactttatttgggaggagggatcatggggaactttacctttttctgtaatatgtgcatttctacttctgaaaaatatactgagaagtacagagaataatacaacaatccctgtccctacccccactccagaattgatcatttttaacatttatttttgccttacatttttttgtggagttggaagtaacacaagttgagtgtccctaatccaaaattcaaaatgccccaaaatgagtttcaacacgatgccacaagtggaaaattctacgcctaagtacttaacactttgtttcatgagcagaattattaaaaatattgtatagggtacaacgaacattatttgggtgatggttacactaaatgtctagacttcactactgcacaatatacccatgtaacagaactgtacttgtgccacctaaatttatacgagaaattgtgtaaaattaccttcaggctgtatgtataaggtgtgtatggaacatgaatggatttcatgtttaaacttgagccgcatcctcaagatgtctcatgatgtataggcagatattcaagaatctgaaatctgaaatcctgctggtcccaagcactggataggagatacttaacctgtataggtaaacaggagatacttttttaatacccagcattcccttccccccttacaatcagtacaatgaattgcttgaatttttctactgtgagaatggtataaattatgaatgtaagtaaaagttcaaaaccgatgtggtggccacacaaaaacctattattaaataatattaaatttgtacagtattttagagtttgtaagaagcattctgattttagtaagaatgctttgggaatagaactttttttcgtttgctcattttcttgttaactcttgtttgaaaacgttttcctgaatttgtttttaagtaatcttcatgactgtagaattatacatggcttattgttgaaaaatacagataaacagacaaatttccgcaaaccccaaactcacagataaaatactcttaacattttggtatgcagtatcttcttcgaaggcttttcttaactgctctgtagccatattatatattttttcagaaatgctctttttaaaatgtaattcattacctcccttccagctttcaattttgtatgaaaaatttcaaacaaaaatgctgaaaacatagcacaatgaacatctgtataccatcagctggatccaacaattaagtatttgccatattagatttatatgtacagatgtgtgtttaatttttctcaacattagaagtaaggatgacactttatccttaaatctttcagctgcatgtcttaagaatgaggacatctcagccgggcgcagtggctcacacctgtaatctgagcactttgggaggccaaggtgggtggatcatttgaggtcaggagttcgagaccagcctggccaacatggtgaaaccctgcctctactaaaaataaaaaaattagctgggtgtggtggcacctgtagtcccagctactcgggaggctgaggcaggagaatcacttgaacccaggaggcggaggttgcagtgagctgagatcacgccactgcattccagcctgggcgacagagtgagactctgtctcaaaaaaaaaaaaaaaagtaaggacatctacaaaaccacaataccattatcacgcctagggagtttattttttcttaatattatctaatatccggttcatattcacattttctcagttgtccccaaactgtctttttttccaagctgttttctccaaactagtgtagaaatggtatttttaactttgctcttcccacatattgacccctgtttcatgtctttgtcattatgtatacttctgtagcatttttaatggctacattgtattctattgtatgcagaatttatttaaccagtttgctttgttcacaccttttgctgtgttcatacttttccctcaggtgtccccaaactgtcttttttcaagctgttttctccaaactagtatagaaatggtattgttaaatttgctcttcccacgtattgacccgttccatgtctctgtcattatgtatacttctgtagctttttttttttttttttttttttttgagacggagtctcgctgtcgcccaggtcggagtgcagtggcgcgatctcggctcactgcaggctccgccccccggggttcacgccattctcctgcctcagccttttgagtagctgggactacaggtgcctgccacctcgcccggctaatttttttttgtatttttagtagagacggggtttcaccgtgttagccaggatggtctcgatctcctgacctcgtgatccgcccgcctcggcctcccaaagtactgggattacaggcgtgagccactgtgcccagcttctgtagcatttttaatggctacattgtattttattgtatgcagaatttatttaaccagtttgctgtgttcacacttttccagtcccagtttctcatgattttaagtaatgcctcctaacatacaggtaattcagcattcagtaaataagtgtcgaatgaaagaagcataggtacatcctaatagataaatatttatgagatccatatttaatatttttaattttttatttccataggtttttggggaacaggtgatatttggttacatgagtaagttccttagtggtgatttgtgagattttggtgcacccatcactggagcagtatacactgaacccaatttatagtcttttatccctcacccctttcccatcctttccccctgagtccccaaagtccattgcgtgacatccatatttatatccttaagaaatttctacaaccggaatgtaaaaatgtaaggcttttaatactcattgctaaattggcctttagaaaggctaaccttgcatttttcactgtgatatgtttagtatatgatccatcatgatttacaatattgtagcacatcaggataagccttgataaatcagaagagtataaatctggatatagccagtatcgttgtagatggctcactgcatatatacacgtatatacatatacgtacgtacacgtatatacatagacatatacatatctgctgccatatttttccaggggctagtttgactcttctactttggagggctttgcagtttgttaacccaatctggagtccaggccccggcttcttacatttctttaaatatcttggtgagaccagccttaaaaggaagtatagtctggagagatgcagacatcactagaagatatccttttacgtagagaattttagatttttgcttttaaaaagtaaagacaggctgcttttatgggtgaattcagatctctccctctagcaaattaccaacagctttaaaagggtagtcttcatgtccaacagaaaagctggatgataccctatatttcctattatccatatcaaactccttattttataggcccagttgtaggagtaataacatatccatggtaacatggctggatagtggtgaaattgagcatcaaacccaggttacctagtccagtattgttttcactatgttttatctctccttaaaactgaactttatttctaaatgtgccatctggtgtcatctgtagaaatacaaagtaagtggtcctcttcctatgagaaagttactccccaaataggggaattttaaagtagaaagtcaacgtgagaaaggcaaaaatccaaagaaagctcagtttctttgcccttttaaccgtagttactactttctgacatgagatcaacttggagctctttcatggaacagttcgatttggccatgtgttttcatgcatttatggatgctataaatcagtagatgagactgaatttcctgcttgtaaaactttttcaaattaaagggctgctttctaagtccatcttattttcccttccttttttcaactgttttaaactataacatgtttgctatttttaaaaagattgaaacaaaataatagtttacaccttttagcattatagttaagtattactgtgttaagtatatacttatgttaagtatttttatactatgttaagctttttatgctgaagtaatggtgtgaagtaggtgtgtacttttattttcatccaaatggttagccagtagctcctgtttttcttcctggcaaagtctatttgatctttaaaaatattcttagcttaaaagtgaattatttgcagaagtgtagttttattttttaaaaacctaggaatttgtggcaagtagaaaactagcatggttacttttagctgtttagtttttgaaaataattcagattgttcatgtttaatatttaacatttgtcttagactgaaggcaaagtactacagatagtgctttaagggatcttagttattgtacttccattttacatcatgttggaagcccagaatgtcataaggtcttaaagccagttggtggctgagaactagagtacctttgcatacttcactttcatttctagcaagcatctttcatgtaatagatatgttttaaagcagtagattgttcagaattgtctggtttatttaagaacatttgaaataactatgtgtcaggctgtgtggagcaccataaaatttactcagacagccatttttttctatatgttgggacacctttgtttttaaaggctttgttttacaactttcttatcagtgaactaatttgagcctcataacaaacctgtgaagttggaattcttttcaacatcctggaaagagtttgctgccaggttgataattgctataaataacttgctcttttaaaccatgcaaaagaatctttgtctccattccttccaaattcatttgaaccagctcaaaacagttgagacccagttaaaatttttgattaagtggcatggcctgcacattatttagtagactgtttaccttttgcagaactgtataatttgagaatgaaactggagcctcccaatctcattgtcatcaaagtagagtttaagttgttggttgtctgcagttatggctaacagtatggagattagtatatactgtatgttctccttcatatgcaggtaatgtgtagaaagattgagaaggccagctcttttgcatatgatcagatttatatatctgtatttctgtcttatcaatctgtagaatacctagcataaggtttctgcctttagattaatctggagccaaaagaaatagaacaaatagcaatacggcttactctttgctgggcacaatcctatgagatagacttgtttattttacagaggtgactggactcagagatgtatggcaacttgtctaagatcacacacctagtaaatggaatttaggcccagatctgtctgtttcccaggcttttccattatgctgttgtcctttacttcatttttacttttcttccagtggtagtcttcagcctctacttttttttttttttttttgagatggagtcttactttgtcactcaggctggagggcagtggcatgatctcgactcactgcaacctccacctcccgagttcaagcgattcttctgcctcggcctcccgagtagctgggactacaggtgtgtgccaccacgcccagctaatttttgtatttttagtagagacggggtttcaccatgttggccaggctggtcttgaactcctgatgtcatgatccacccacctcagcctcccaaagtgctaggattataggggtgagccaccgcgcccggccggggaggtttgatctttagagatgctgcttgtttctctgcaaacccaaggacatgagagaattggagctgaataatgcaaaaggggtggaattctgtttctttggtatctggtaccatctttattgtatttgacagtagtctatcatgtggctttgggaaaaaaataccatatacctgtgtttcataaatgaaagggaaatacaagggaaaacattgtcatggctagatagacagtgtcttaactttctttagggcattggttcctaatgttcttcaggtcatagatccttttaagaagccaatgaaagctgttgaccgtcttctgggaaaaagaccaacatatgtaaaatttcccacagaatttcagggtttttgtagtggtcatccttcagtataggatgaggaattctaaagattcctctacacttgtttttctctatatgtcattaagatgtctaaattgctatgttgtttgttcttgtatttcttagtacaggcgtccccgacttaatgatggttcaacttaggattttttgactttacgatggtgtgaaagcgaaacacatttagtagaaagcatacttgagtacccacataaccattttgttttccactttcagtcgatattaagttacatgagacattgaacatttattataaaacgggctttgtgttagatgattttgcccaactataggctctaatgtaaatattgcaagcatgtttaaggtaggctaggctatgatgtttggtcggttgggtacagtaagtgcatttttgacttagatatttccagtttacaatgggtttactgggatataatcccatcatatgttgaagagcaactgtatatatttttctagacttatttttctacacagtggtcaagggtaagcttggctaactgtgtcacttttgcttaaagatatactctgtattatgcaaatttaatttatcttctgtattgatcttataattggttgtgttttcagcctttgggcatgaggaagttgtaattctctttttttgtgtattgacttcgttgcctttatattacgattgcttctaatctattttatttctgatttttttccttattttctacatttctgtacacctggctatctgagtattcatctcaatgccctgcatatagtatgtttataattgttgaatggaaagatgaaggttaaatgaatctaaattgtttttttcagttcaccaagagtttaatgtgacttggattttttttagttttgttaagcatttactggatagttattcatttattaatctgctattaataaatgacagttcatatgctggtacaggaatgcaaagataaatatgatacagtcccactcttgcagaactcagcaagcatagtggggagactgtcaggtaagtaaagaggtgtgctgattgaggatcaatatgcaggatatagttggggctaaataaagcatgtggggagctgagggaaatattatgtaatatcatagcactggtaagagaggtaagcagggaccaggtcctagaggtcttggatgctggtttaaataaggagtttgtacttgatgtaggtaggttttgagttttagggagattgctctggcaacaatgtggaggatagaatggatggatccagcaggaaaaagtctcactttaaaataacttcaatttatgagacttttcaaaacatatacaaaaatagaaaaaagcataatgaacacccatgtaactgtcacccagcttgaacagtgatcaacacagggctattgttctatttataccccgctcctcccctctatttttattaaagcaagttcctaagtcacagaatggcaaagcatatattgaataataatctaatgccatggctctcaaggctggcctgtgctgccaaatcacctgtacagcttgaaaaaaataatccccacttcagacctactgaattagatagctttgaaatgcctgtgtggtcaggcatttttagttttcaaaataagtctcgggtgaagtaagttatttttaagataattttaaaataacttctgacaaatgaaaatactttcctgaactcattgaatgctgcctgtggcccttctgggtgaaattcacctattcgatacaggcaggcttttcttataaatttttatttattttttgtagagacggaggtctcactctgtggcccaggctggtctcgggaaaactcctggcctcaagtgatcctcccacctcaggcttatcctcccacctcaggcttccaaagtgctgggattacaggcatgcagccagaaactgacaattcttaaggtgtagactaggaatattccagagtaccaatttaaaatgtgtagacaaggagtctgttcctctcctgcttaatttgcttaacttacacttaggcattgctgtttttattttttgttgagaataccaagaagggctccttagcatgctgtcatttcctctgtattggtaaaattgataatctgcaactttggtgagccatgtttggttgcctagttcttctgatgccagtttctctaagtaattgggagtatccgggaaggataactcccagatctgcagcttccccagactgtttgaatagaggatgtggcaggagatgtgttctcagatactattctcacgttcaaagtcaacattggaggtttcagattcctctttcttagtatccctccctgcccatattttccttgcttaagcataactgcagtgcagagaaacacccagagccagcataaactcttaatctgaggtatagtgtgttttcagattttaaatgagagactccttcaaggtatttctgcaaataatttccagatttgtcttgggtgagtaaaggctatttttcagttgctttattatgacactttactgtcagtgcccagtaaaacctaggtcagcagttctcagggcacttgagagtcatgttttatgtggctaaggatagggagactggtgtctgtaggagaggggcgtagcaaggtgggctgtgcatatagacattatgtgcaatgtagagttgtggaacagatttgggtttgaatccacgttttaccacttaataggtatgtggccactctcagtaaactgggcacagtcttcatctccaaggattaaagataatgcacaataggtatagagtaagtgttagctatttttttatgatcataaatgtttttcacaatatttgttgagtggatattaatgtattaatagataatcagaaactagataggatggaaaggcctgacaattatgtggtgtcccctttaacaaatcataatcagtgacacctattcctctataatcaaatagtgaatagcaggctggatttcaagatgcatcttactgcttgttgacatgaagaatgctcagggcagctctcacctgaatttactttcagagactataaggcaaaaggaaatcgttgcaaggcaaaaaataaagtattttgctttgtggtactttggagtttagttttctctaagcattttttgtttaagaactgccgtaatgcttccatgatttctatggggattttaggctcattttgattcatccccactcccgtacttacgtgcaacatctcttacctgctaataatcaaccaaagtgcctcctgtgtgccaagctccaaacaccagaagatgtagggaagaagctcctagagtaggcagcagctaatctaaggcatttgtttagatggtgttcttaatctggtgcatgtcctttggctcaggggccagtgttttcttccttaaggaaaattttaggcctggcacagtggctaacgcctgtaatctcagcactttgggaggctgaggccaggaggattgttttaactcaggacttcgagaccaccctggacaacatggcgaaaaccctgtctgtacaagaaatataaaaattagccaggcgtggtagagtgtgcctgtggtcccagctactctggaggctgaggtgagaggattgcttgagcctgggaggttgaggctgcagtgagccaagatcatgccgctgcactccagcctaggtgacagaatgagaccctgtttctttaaaaaaacaaattacaaaaggaaatctgattataaatggatccatgatttataggaaatttggaaggattagaaaagcatgaagcataaataaaactatgtgttaccctgccagctagaggcaaccattaaaggccaactactaataatgtgtatttcttcccttcccaggtttttttttttttttaactttcccaccctgtggcagacattttctcataaatagggaagtgataggtacagagtacaatgtaatcacatatggtgggatatccagtcaagatttgaggggttcgggagaagattgtccaaattctggatatcattctgttcaaacctgcataagtgcttattatattacagtgaaatagaggctaaatggtcccctacccccaattttcaaagggattcttacagttactccgtcttttcaagacagtttgcagccacttgagaacataagctagtgtctttatttaccttttcctctacatttcagtgaccccataattctctgcttccatttacagcctatatatatattttttcccccgagatggagtttcactcttgttgcccagactggagtgcaatggtgcaatctcggctcactgcaacctccgcctcccgggtttaagcgattctcctgcctcagcctccgaagtagctgggattacagacatgcgccaccacacccggctaatttttttgtatttagtagagacggggtttcaccatgttggtcaggctggtctcaaactcctgaccttgggtgatccacccgcctcggcctcccagagtgctgggattacaggcgtgagctactgcccctggcccaacattttcagaagaggtttttacacataccatttatgctttctcactttccattgattccctgactctagtctggcttccattccctccatcccactgaaacaattgcttgtcaaattgtctctattaccaatttcagtggacatacctcattttgacatttgatgcagttgatcactcttgccatctttcgtctctcgtgatagcataattagctagttttgctctttcctcactagcctctccattgctgggttttccttctttccttacctttacacttttattgtattgtattttttttggtagagatggggtttcaccatgttgcccaggctggtctcgtttaaggaatctgccctcagcctcccaaagtgctaagattataggcttgagccattgtacccggccccttctttgccttacctttaaatgctagagcaaataactcagttgcgggcctcctcctttccttctttgtaagcagtcatctccagacccatggcttcaagtaatatatgtgtgctgacaatcacagattttattcttaatgcatacgtctttcctgaactccattctacaaatatttgcatacctatcatgtggaagataccgtgctaggtactgagagcttaacatcttagaaaatcaaaccagtaattacagttgatacttgttatgaaggaaattggaaataaactgggtgctataatagaaaaattacagtgggaccaacttgaggtgggttgtcatggaaagcctctctgggtcttagtttaaatgtcagttcctcaaatggaactagttgtgggaaaggaggggtggcaaaaacattccagcggcgaacttagaaattagagtgttccaagaactaaatggaaagaataattacacagttgaggaaacaagcatagagaggtggatttgtctgcggttatgcagtgagtaagtgatatagcagggattctagcccaggttttctgagtctgtattctgatctagtgcttctcaaactttgttatatggatcacctaaggatcttgttaaaatgcgggttctgactcctcatatctaggtggggcctgaaattctgcaacttttaataactcccaggtgatgtcagtgctgctgatccttggaccacacttgattagtaaggctagtctttcactacatccaactgctcttgagccagatttgggaactacaggtgtcctgtgcccttaaactgattcagtattgaaagtcattatttttaaatattatcaactggaggtgattactatagaatatgagtcacgctttgagtggcttccctcaggatattttagttgtgtacacttgttctgcaggtaaactgtacaaaaccaagattcaaacctcaggggtgtaaggaaaggttgggggaataaggaagtgaaaaaaaatattagataaaagtattgaagtaatggtaatagatatggatggtgattcatagtaattcacttgttttcttttaagttggctatctttctaacctaagtttaggaagcaatgtttattatatatagagattgcttggtgccctgagttctggttctgacccaacaaaggcagtaggccatttctaggaatttgtttcaaactaacttatttttatggaaggatttttttttaaatgtaatagggttttcacctgattaacttctaagaggtagaactcattccccagttactgttcctttcattagtgaaattacagcatctcagcttctcatcttgggccctagtttcctctcttggagtaattttttcaaacaaataggattcagcagtctagaagaatctgtcacaaatttttattcttatctgccaatattttgtagtaataaaactggttttaaaaaaaggtgaggctgggtgccgtggctcacgcctgtaatcccagcactttgggaagccgaggcgggcggatcacaacgtcaggagatcgagaccatcctggctaacacagtgaaactctgtctctactaaaaatacaaaaaattagctgggtgtggtggcgggcgcctgtagtcccagctactcgggaggctgaggcaggagaatggcgtgaacccgggaggcggagcttgcagtgagccgagattgcgccactgcactccagcctgggcgacagagcaagactccatctcaaaaaaaaaaaaaaaaaagtgaatcgcatgttattaaagcatggacttggtagtcagacctggatttagatcttggtgctaacatttactgaccaagaaaggtactttttttctctcttacttcagttttctatctgtaaatagaggcaaaacttgacttgagtggtgaggactgtatgaaaaaatatcatatgaattccctaggtagcatgtctcaaactgtattctttggaatacttcaattggactttgagtagatgccacttgagaaaatggttctgtgcgctaataagcctcctttacctaagatgtcttagagccattaataatgtcaattagctatgtgactgccctagtggaagagaaattctgtctataacatttcccaaattacaggattcttgtctccctttatagagcaagacattctaacacactttggggaactccagtctcagtattgtctggcttgtaatggacactcagtatactaacgttcccccctcccactgttgaaaccagttttagaaatatgagaacacaacaacttctaaatttttaaagttgatgtctcatggacagtgatgtcttggttttttaaactacaaatgtttcttgcagtagaattatagacaccaaggtaggactgcacttgttatgggaacatttgtgtgtgtgcattcatattggctctgttattttattgggtgcatcaaatgcttacacttgggacttagagtctagcgccactcatgcaaataacctgagatgatttagaattatgccaccagcatagtttctaggcatccagagtcttgtgttggcagcagaagtaccccaagctaagctgtttccgtggggggtctggctgtagttccaggctccctagcttccttggttcctcttagttttctgcacgtggagctctagccttctgtcagttctgtgagctatcagatactctccagtaaattacttggctgcattaattatccagtctttctgtagttacagacacttgactagtatagtacactaggtcaaaacagcattagagcaagttgcttatttgtttgaagattcatcagtgactcatctgcattaaaaaagtaaaatggttgtgatttgcttatttcagtgcataagttactctgtgctcttgttttggaggattgtttttttaaaatagactttatttttagagtagttttacattcccagcaaaatcgagcagaaggtacagaaatttcccatatactgcctgcctccacacaggcatagcctcccttgttatcaacatctcccactagagtggtacacttgttacaattgattaatctacattgatacatcattatcactcaaaggccatagttaacattagggtttactcatggtgtatacttttggggtttagacacataataacatgtgtccaccattgtagtatcatacagagtagtttcactggccaaaaaatcctctgcgctccacctcttcattcttccctccccactaaccctcctcaaccactgatctttttactgtctctatagttttttcttttctagaatgtcatgtggttggaatcatacagtatgtagcctttttgtactgatttctttcacttactaatatgcatttaggtttcctccatgtttgttcatggcttgatagctcgtttctttttagtactgaataatactccattgtctggatgtaccacagtttatccattcacctaccaaaggacattgtggtttcttccaagttttgacaatagtgaatgaaggtactataaacatccatgtgcaggtttttgtgtggacataagttttcaactcctttgggtaaataccagggagtattgattgctgggtcatgtggtaagagtagttttgtaagaaattgctgaactgacttccaaagtggctgtactattttgcattcccaccagcaatgaatgaatgttccacttgctccacatcctcacaagcatttggtgttgtcagtgttctgggttttggccgtagtgatatatcatcatggttttaatttgcatttccatgatgccgtatgatgtggagtatcttttcatatgtttatttgccatctgtctgtctgtggtgaggtgtatgttaaggtctttggcccattggcccatttttaaatcagcttgttttcttactgttgagttttaagagttctttgtgtatcttgggtaacagtcctttgtatgtcttttgcaaatattttctgtcagtctggcttgtccacttattcttttgacagtgtcttttacagagcagaatattttacatttaggtctgtgatccattttgacttaatttttgtgaaacatgtaatttcggtttagattttttttttcgcatgtatgtatcgagttgttccagcaccatttgttgaaaaaactatcttttgtccattatattgactttgcttctttgtcaaagatcatcggttgacaatatttatgtgggtctacttctgggctccctaattctgttccattgatttgttcattcttttaccggtacagtactcttacttactgttgtcttatgataagacttgattttgggtaatgtaggtcttctgactttgttcttctcctttgatattgtgttggctatcgtggatcttttgcctcttcatataaattttagaatcagtttgtcagtattcatataacttgttgaaattttaattggagttgcattgaatctgtggagttggaaatgacttaacattttggcagtattgaatcttcctatccatggacttggaatatctctccatttaattgttctttgatttctttcatcagaattttatagtcttccttgtatagaccttatacatattttgttagatttatatctaagtttttcagttttggggtgctaatataaatgttttttatttcaaattctgcttgttcgttgctggtatataggaaagcaattgactttttttttttttttttttttttgagacggagtcttgctttgtcgccccaggctggagtgcagtggcgccatctcagctcactgcaagctcagcctcccaggctcatgccattctcctgcctcagcctcccgagtagttgggactacaggcgcccgccaccacgcctggctaattttttgtgtttttagtagagacggggtttcaccgtgttagccaggatggtctcgatctcctgaccttgtgatccgcccgcctcagcctcccaaagtgctgggattgcagacctgagccaccgtgcctggccagcaattgacttttgtatattaaccttatatcctgcaaacttggtgcaattgcttgttagttccagggtgtttttccttatttcagattttctgcatgtatgatcatgtcatctctgacaaaaagacagttctgtatcttccttcccaatctttataatttttatttcctttactgctttagctaggactttcaatacagtgttggaaagcagtggtaagagaggacatctttttcttttttgagacggagtctcactctgtcgcccaggctggaatgcagtggcgcgatctcagctcactgcgatctctgcctcctggattcaagcaattctcctgcctcagcctcctgagtagctgggattaaggggttttgccatgttggccaggctggtcttgaactccttacctcaaatgatctgcccacctaggcctcccaaagtgttgggattacaggcatgagccactgcgcctggccttttttgtttgtgattatttaagggggaatgctcctagttcctgaccattaagatattagttgtagctttttttgtagatattttaatcaatttgaagaagttctctattcctagtttactgagattgtttgacttttcactgttgaattttgagagttctttatgtattttagatactatatatggtttgcaaatattttctcctagtaaattttattgtcctatatttaagtgattcattttgagttaattttttatataaagtgtgaggcttaggtcgaagttcatcttttttgcctgtgcatgtctgctttctctggcaccatttgttgataaaactatctttccttgactgaattgtttttttttttaacctttgtcaaaaatcagttgggcatatttgtatgagtctatttctgggttctctattctgctctattgatacttgtatatatatcagtactacttgatgtctgtagctatatagtaagtcttaaaagtgggtagggtaattcaattcctccctcttttatttttttccaaaattgtttcagccattgttgttcttatacaacatatacactttagaataatctcagcttatttacaaaaaaacatcttgctgggatttgaataggaattatattaaacctatataacaattttaggagatttgacatctttactagagtcttagatctctccatgtatttagagctttgatttttttttttttttttttttttttgagactggagtctcgctctgtcacccaggctggagtgcagtggcactatctcggctcactgcaagctctgcctcccgggttcatgccattctcctgcctcagcctcctgagtagctgggactacaggtgctcgccaccacgcctggctaatttatttttttttattttgagatggagtctcgctctgtcgccaggctggagtgcaacggtacaatctaggctcactgcaacctccgcctcctagtttcaagcaattcttctgcctcagcctcccaagtagctgggattacaggcttgtccttccacgcccggctactttttttgtatttttagtagagacggggttttaccgtgttagccaggatggtctccatctcctgacctcatgatccgcccgcctcagcctcccaaagtgctgggattacaggtgtgagccactgcgcctgcctggcctttgtttttttaagatggagtctcgctctgttgcccaggctggagtgcagtgagccactgcgcccatcctctgggaggcttttaaaatagatttcttgggttttctatgtggatgatcctttgacatctgcaaatagggaccatttttattttttcttttcttatctgtgtgcctgttatttctttttcttactgtattatattggctagaactttcagcagtatgttgaataaaagtcatgataacagacatctttgccttgttcctaatcttagagggaaagcatcagttatttgagttgtattgaggctggctgctacgtcttgcagcaggggcagtttaatagcctccctgcaaatgactgaagcgacaatagtgtgacagccacttgcgtaagacgtttatgagaaaaggggaggaaaaaagccttgagagtaagcgtacaaatagctcagcttatagtttccaccacatggacaggattgttgccagaatcctgttggcttcatttgagatattttgaggttgttggcatcaggcattttgttcattttgtattgatactgagataactttttaaaaagtaatctggaattacacaccctaaatatcaaccatagaaaacattttttcttcttaaggaatggtctctgcagaaatgttttagaacgtattctgaatttttcacaaactcttccttgaatgcctgctgattgaatggatacaggtcgtacaggcaaatacacgctatttccatagtactgagtatattggactaaatctaggcaaaaagctgcctaaaatttatactgtaattggtcagctttatattatggcagccttctcgggggaggaacattgatttctagtgactgccactgagttaaatacattgttaatagcagaatcttttgtgtgtaaagagcctgcaacccacttctacctctgtgcatgtgtcttagttgctaacaggagaaacttatttcttcttgtgctttggaggacttgtctgccatcaaagatctagggattatacagtggatctgatcaggctgttgtctgcttttgagccttccaaattacatggcttaataaaatgattgttttctgtgctcagaatatttctgttgtgatccttatacttcattttctagttgaaaaaagtgttgttttgcctttgctcttatgatacaactaatacatttttattggtaggaacagtaaaaggtgcataggtaaaacagtcatacttaatccttttggttaacaatgaattaatattctgatgcctagcacctctaagctgttttctttagacataagttttataccgtatgttctgtgttgtaatctttttatttcatcatgaacatctttgtgtattacatagtttgcaatatttttaacagttgtgtgacattccattttaaaccagtcgtattttggacatttgatcttttttttagccttgtgatggaacagtaggtctttttcagtcttttactattatacatggtcatgcagtatggattcttgtggttaaatatttgtgtacatctttacgactttctttggattaattcctagaaatggaagttatcaggaaactgcagggctatggtgaatttttccatcctgagatgtgttgcaaacattgtacactcttattttcaattaagagtttgagatgcttgtaaaagagaaaaaattttcattttgacctgatttggtttcagtcttgtgcaacatagggatgtgggccagtttgatctggagagattctttacctctctctacctgatagctgtgcctctgagttggcatagcatcataactccagtgtttttactttaagcattttgcattgctcttcattctgtattgtctgtgtccaagcttgtagagctcaagattgtagctttaagttctcacttcttttgggattttcttttttcagatcgtaaagctgaaaattgaaatcatgaaagtagacaggactaaactgaagaagacacctactgaggctgtaagtatccaaaagtttactttgcttattttttcttcattaaaaaataaaaaaatatttgtgaacagttcatccatgctcttcaaatctcatcacccatatatacaaaaggcagtaaaacaacaacttgtctagaaacagtaagattttcttttgaacttccctggatcaaaaaaatggatagccaagagaccagtggaaagtgaacaccgatcagttagttcttcgtagctgtgtgtgcctgaagtcagctctcaggctgctgtgcaattccttcctatgcagaaaggatgtgtggtataatggaaagagcagatatgggttcagatttttaatgtacttctgggatcttgcaattttgttttttagaaaatgaaagtggtaacatctttcttactagtttttttgttaaggccagtgttttagcttgtctttattactgattcttaatcacacaattcagcttaacttgtgtattgggtggtcatatcaattaaccctttgtcgacagtagaaatcccagctttaatctagtaatattccaccagctagcttgaactgctttctaaggttgaggaagtggtattgcattgtgatagtcctgttgaccccttgtgcttagttcagagagcacaagctttgaaattagacctaggtttgaatcttaccagacttttgtggctgagaggttattaacttgcctggtttccacagctgcaaaatggggctgaaaattttttccttcttgatgtgaggcaattgcttagcatagtatctggcacataagttagttcatatcgtaaatacaagccacttggttttcaaaaaatgtaaaagtacctggcaagtatcaccaaaagataacaataacattttgctgcatttcttccagttttttttgtttgtttgtttgttttgagacagggttttgctctgtcacacaggctggagtgcagtggcacgatcacagctcactgcagccttgacctcccagctcaagcgatgctcccacctcagcttcctgagtagctgggaccataggtgcatgccaccatgcctggctaattttttattttgtgtagagacaggatcttgccttgttgcccaggcttcttccagtcttttaaaaaattattacatgtgcacacacaattatcctgcccttttcatttagcattgtactaatgagtatgagcagcactttcttcatatacccttgtcagtattacagattgtcttttaaatttttgttaatttcataagtggggaagaaagtatttcactgttctatatcagttatcttcttgtgccattcattttgtatctgacattggaatatcagtgtttctcttactgaatgccatatatattgaacgtactcattttcatatctgttggaaatatcttcatttgcttttgattttgtttttgatgtgttttggcatctagaagttttgacaactgtgtacttgaatgtcttttactgaaggacaaaaagaaaacttgcttaagaaactataatttaaaaatttaaagtggaaccaatgtaagaatctactgctacgagaatagaagacctagaaaagtgatcctagtgtatataagaactagatatatggtaatagagggattataaattggaaagaagggacagtattaggaaaccatgctagaatgattatcttgtagagcatgtgggactattatattgcgataaattttagataaaccaaaagtcaaatgtttttaaaagaaataagctataggagaagtagaacatgtaggtgaatgtttactttgtcttaagtgggcatggtctttccaagcattaaaacaaaggaaaaaaaccataatggaaatgttaaatactgtatccaaaattaaaaagacatgacaatagccatcctaataggtgtgaagtaatatctcattgtggttttgatttgcattcccttgatttccttgatagggagcacctttttatatattttaaaactatttgtatgtaaatagacatctggataaatgtctattcaagacccttgcccgtttttaaattgtgttatttgggatttttttgctattgagttgcaggagttccttatatattttggaaattaatccctggaagacattaggcaaagtgaaataagtcagccgcagagggacaaatagtgcatgaatcctcttatatgaggcatctaaaatagtcaaaggtgtaaaggtaggcagtagaatgatagttaccaggaaatggtgggagagagaagggggagttgctgctcagtgggtataaaattataccaggcaagttcgttccagagatctgctgtagaacaacatagtgcctatagttaacagtcaggtattgagtatagtctgccctccgtgtgtgggttccacatttgcagatggaaccaactggatagtaaatatttgggggaaaaaacaataaaaaagaacaatacaaaagtaaaaatagaaattttgaagcaatgcagtgtaacagctatttacatcgaattcagtattgtaatactagagatggtttaaagtatataggaggatgtgtataggttatatacaaataccattgccattttatacaaaggatgagcagcatagattttggtattcatgggggtcctagaatcaatccccagtggatacagagggactactctacttaaaaatttgttacgagggtagatctcacgttaagtattcttaccacacacaatcatgcacacacacgtagggacacaaggaaacttggaggtgatggatatgtttattacctggattgtggtgatggcaacgtgagtgtatacatacatccaaactcacccagttgtatgcatgaattacgtgcagtttttttgtataccatttaccccttaataagctcaggtggggtgggggagggggaagacacatgacaagctggggaaaatatttgtaacccagtgtagttaatattttcagtagctaaatcaggagaaatgaatatcccaatgacaaaatgggcatagggcatttaagaaaagaacaaacccagtaaacgtccagcaagattcaacttagcgggtaattggagaaatgcaaattaaaaaacaatttttaacctagtggattgtaaggggttgctcttggagtcatatactgatttctggctcttatttcctagttactagcaagttacttagcataaactcctagaagtggaatttttatgtcactggttatggacatttttaagacttgagttgtctattttccttgagcagcatacatgattgcccccatttcccatactgtggtcaatgctaggtactattatgaaaggcttttattgatcactttgtgtatcagtagctgtgcaaaggattttttccccagatttggtatctattgaaataaatcactgtaaaccctggcaattgttattgagctatcgaactggcaaatgctttcttatatcttaacgttgtgcttgctgctttctcctgcaaaatgcaagggaccttgatagtctgataaaacagagaccatagtactggtacattaaattgatgccattatgctaactggatcttgtgagcagaaaacacaagcacaccttagatgcctcagacatatttgtgccagagagtcagaaacaaaccttgtggaagcttgagggccttttcacattaggaaagtttctagtggccccagggtttgggaaatattgggatatcccttctaaagtgagagggaagttgctgtaccttgtaccacacactgtgaagaaagaggaacaatgtgtgatgcgtttggattttggagccaacatattggttggtcacatttaggcatgctattttgacctatttactggataacctctaacacatttagtggggaaccactaaagtgttagtaaggtttggatctagaaaagactctgcaaaaggtccaggctatgatacaagttgccctatcacttggacattatgacctagtagacccaggtgactgacttaggtgtcagctaaagatgccatgttgtgcttttggcaagccccaatagaattacaagtaagacccctagattcttggctgtgctgtcctctgccaccagctattctacattcacaaaagcagcttctggcttgctactgggccttggtaaagactgaatgcctggttatgggacataccaaattattacaggatccaaatgttcatcatgaactgcatcttacctacacatcgtaaaattggatttgtacagctgcattccattagaaatagaagtaacacgtttgatgctggacccaagtaggtccagcaggcacaagtgaactgcataagcaggtggttcaaatttccatgttatctatttctgctgcttcactgcctctccctcaacttacatcttagaggagaagaggaaaaagtgcaggcctggtttatggaaggattttgtgccaaggattttacatatatttaattaccatgaacatttgaggtagatcttaataatgcttagagggagaaaaggtttggacttagcttaaagaaacccctgttaggttccatgttgtttcagatgccgaaaatacgtttctcccagtttgaatctcacgacagcattgctggatatataggtacatgttagtttattttgcagaagaggatgctgagattcaaagaggtagcttaccaactacctgattccaagggtcatactctttttaatagtatgctgtctctgaatatttaagctcctgtaatgggagataagtattttatgtatgtggcagacgtttgagtttcatatttgtgaggtagctattaggtctgtttttctgataagagagctgtggcttagaggttagacttgctcatgatcaaacagcttagtaaacatgaagttaaaaagtgaatccagacttgtttggttccagacctctggtccattcccaggatgctgtactgcctttatggagttaaagaacaagtgtaataatcacttctcccagctgccattcattaacggaaggcttctctctcccagcccctatccctttccctccttccactttcagaaacttgactataaatgctcaatccactccttgttacctgacaaatggacccattcatcagtagaagagagcagaaatgtatggaaataggaaccccaagaaagaatggagtcctagttttacgaagttcggaagctgtttaccatcttacaagtgaaggattttatgtaacagaaaaatatagctagtgctaatcttcacctttaattgtgaattcactaggacttttcagtctctgattcaatataacctaccaggcattctggttaactttcagaccatggtatagattccttaattgtttttttttttttttttagatgtttaacttattattgtttttgttgtcagcacctttccaaatagtttgtctgcatctacctttatccaaatccaaggtgggtttttgttttgttttttgtttttttttgtttttttttgttttttaagcccaggtggattgttgggggaataaaagcattttctcatgaggtttccattttaatcccaagagattgtctggcacatctcgttttcttaagtagtaaatcctagcaaaaggaaaattgctgtgtgagcttaagggttccttttctgattctccttatttgcaactccctcattccaaaacatcttttgtgaatacttttcttttctcagcctgcagactgcagagccttaatagacaaactcaaagtttgtaatgatgagcaacttctcttggaactgcagcagatcaaaacatggaacattggaaaggtatgtgaagtcaagctcccaaaagacaggactcaccatactaatacatcattttgtatgctctgatatggaataagaaaccacaatgggatagcctcattcagcaattaataagcatctagcatgtgccatgtgcctaacacagctttaaaccagtggcaaggaaaattttgctggctgaggatggagaattgatttcacaggtgatgcttaagaatctcaatcacagaattcctgtggtttgacaatataagtttgagataatttctggatttttagtttagaagaatttttattagataactctaaaaatgaatttttctgataaaatggattctggcaaggatagttctcttgtcttcgtagatcttagaatgtaaccggagttctccatctaaagacctagctctaggggttttatggtgtctattggtgttagcacatatatctagatgggtatgacaatgaactacagcacttttagctcagagtatgatctttctcatatgggcaagggtgggacgtgaacttgtctaggtgtcatgctcagcaatctcttgtaacaaagctcagttagaaagcacccatgcggcgcttctaccttattcttacatcctctttttcctcccctctccagtgcgagttatatcactgggtggacctgttggaccgcttcgatggaatactggcagatgctggacagacagtggagaatatgtcatggatgctcgtatgtgataggccagaaagagagcaactgaaaatgcttctcttggctgtgttgaacttcacagccttgctcattgagtacagcttttcccggcatctgtacagttccatagaggtaggggaggttaaagcctgtgtaccctgttcttgactagaattgtgtacatccagaaataaggaaattgctatttctattgcttctttccttttcattgtggagctctgggtttttcattgtcaaagataatagtagaatgtttcttggatatagatactatccttcatagggttgatgggaagattctgtactatcacctttgctttgccttttcaagattcaagaaatgaatgagaaatgttatatatgtattaaagtatttaaggaaatttgcatgaattgatttttgccctaggttgttagagcagccccacattacttttaaattcctagaaatagtttgattttctcatcacattaatgtacttactactcctctaagtgttagtgtgctgctttaaagtctctctgtactctgccacacccatcccaaaatatatattcatagcatcctttgtgtccttgaagagtaaggtaggtgcagcaatcagtgagctttttaattggttaaaaatcactgtaagaagaaattattttctttttatagaagcccaactttagactttttatcatcattagttaggtgccctgttaattttaggtgtgttttcctacgtcttcagtagagaaacagaatcagaacaaacaacttaaaagaaaatggcttaggaaaagaagtgggataactgaactaaaggcctaacatacagagctttaagtgggaggtaaataggcagtctgttgaagatgaaatagatatgctgcccatggaagtccatgaccttcggtataattggcaactggaaatgccttggttcatttctagctatattacatactgattttaattctgaccaactgcttcaatgtattggtgaattttaattgtatttaaaagccaaagtaaggccaggtgcagtggctcatgtctgtaatcctgacactttgggaggttgaggcgggaagatcacttgagcccaggggttcaagaccagtctgggcaacatagtgagaccccatcgctacaaaaaatacaaaaattagcggggcgtggtggtgcgtgcctgtagtcctagctactcgggagacttcggtgagaggattgcttgaacccaggaggtcaaggctgcagggagctatgatcatgcctttgcactccagcctgggcaacagagagaccccgtctccaaacagcaacaacaacaaaatccagagtagtcactcaggttccttatgagcatatactgtactgtaacacttatatgttatataattgccacgagctgttatcgatatctttagcttctatatgaaggaccctgttttaattaatttcaattttatgtttgtcataaaggatacagaagagaacataaaatatctttctttcacaatacttttagtccagttagagacttaatgttcttcttgagtcccacatgtgtatttgtctcttttccttcctgtgggaaaacctgcgcaattttgaaccactatttacgttttttacttttattgcactttatagctaactgccagattttaagctccttggggataaggttgcatgttgtagattatcaaatacatatatatatatatatatatatatatatattttttttttttttttttctttttttgagacagagtctccctctgttgcccaggctggagtgcagtggcgtgatctcggctcactgcaagctccgcctcccgggttcacaccattctcctgcctcagcctcccgagtacaaatacttatatattttttgtattgttgtgactaaacttcttgatagctttgtaaatgttgacaagtacattttgttttgttttcaaggccagttgtgcctgataccttgagctttgcccttttttgtccctttagcatttgacaactttattggcttcctctgatatgcaagtggtgctggcagtcctcaatctcctatatgtatttagcaaaagatcaaactacatcactcgtctgggatctgacaagaggaccccgctgctaactcggctacaacatttggcagaggtgagtcttgggtgaagagttggaggggtgcaaaaattggagcatatggttcctttcaacaggtgtttcttggagtgttaaaatatattagaatccctaagttaacttcactggcctaattgagttagaactattggtgccctgttttaaaacctaagtattctcagttattaagtaattttgaaggaattctttaatctctgctcaccaaacaaaatctctctgttcaaaagtggcaatttcacttctgaaaggaaagttcaaaattagattcaattctgtgtgagaaggaagtataatgcaataataagatctagatttgagtcctggccctgcttactagcgccgacactggtttcctcttctgggaatttaacatatctacttcagggttgatttagaatgaaatgaattgtggggtactcagtgctgtgatcagtaagtcgtagtgattgtaattgaagccagaagctctcatataaaagttcagctctaccaaactattgtccagtgttcccagaggcaacttcttaatacatacttagctttgagaggtaacccactgttggaaagctttcttagaagaaaagtgttatggctggctttttaaaagcatatttaatgcttacctcaaagtaattcaagttttcaggctaattcaggtgccatgattacttataaattagttttgtataattataaatataacatgtattctgaaaattctaggaaaatgtagacaaaatgtcaatcacctataattcatccctatgagacctcccttaaagttggagcatttttttcttgcatttggaaacacatgtatacatgcatgtgacctgttttcttaagatactgtaaatatttcctcttactattaaaaaccacaaggaggtttaacattggattcccaagtccacagttaaaaggaaaaaggaactattactcaatagatgcttccaaagcactcgataaaatttatctcattaacaaaagcttcatataaactttaagaaaactagagttacctaccagaagtcataatgggggagctgaggcatttccattggattcaaaagtcacacaaaaatgtcagacattaacttctgtcatttacatttgtagtacagatgctaaccaacagaaaagaaagaagcgaagaatacatattaaaagaaaaaatttgggctgggcatgatggcttatgcctgttattactggcacttggggaggctgaggcaggcaaatcgcttgagcccaggagtttgagaccagcctgggcaacatggcgaaatcccgtctctgcaaaaagtacaaaaatccgccaggtgtggtggcacacccctgtggtcccagttacttgggaggctgaggtaagaggatcacttgagcctgggaggtgaaggctgcaatgagccaggatcgtgctactgcattctagcctgggcaacagagtgagaccgagactctgtctctaaaaaagaaaagagaatatttgttactatttgtatgtaggtgatgagtctctttgtttcttggggagataatgtaaaattattataactagtaaaagcacagtgaggtagccaagagatcaatatacagaaacagatagctcttccatgtattaatagcaaccaattagaaaatgattggtgaggccaggcgtggtggctcacgcctgtaatcccaacactttggggggccgaggcaggcagatcacctgaggtcaggagtttgagaccagcccggccaacatggtgaaaccccatctctactaaaacaatacaaaaattagctggacgtggtggtgggcacttgtaatcctagctactcaggacggtaaggcaggagaatcgcttgaacccgggaggcggaagctgcagtgagcctagattgtgccactgcattccaggctgtgtgacaagagcaagactctatctcaaaaaaaaaaagaaaatgattggtgaaaagaccccattcacagtataagcaaatattctgtctgtaaaataagtcatattggctaaaactgtaaatttaagagcagttaatgtaggaggttgtgttgtaataacaatggtggggaaagaattcttaaaatccccatggcataaacctgaaagtaaaattttgaatattgtatttaaaaatatacttcccaacaaaaaacacatagctccaggctactccttaggcccttacactagaatataaatcaacacactgcttccttcatcaagaaaaatgtcagttgtactaaatagtatagttaccaatgtagttaaataacattctggtacaacctcattttgtcatggaccaataaaacttgcaaacaattggtgtaatagcaagcagctggtctgcatacaaaattaggcagcactttgtacaacagaagttaacagacccatggtagattaaaaatgtttaacagtgttttaaaactgaaaagggactgctaatgtagaatatccaaggaactcttccagatcaacaaggatgagcaaaggatatggataggcaatttatagaacaggaaattcatgtgagtagatgcccatactcagtaattagagaaataaaaataaaacaaggtacagctttgtaagcatcagatttgcagaaattagaaaactatataatggtaagtcctggcaggtatgtgaagcaatgggaaccctcatacattgttcataggagtgtagactggttctcatgggtatatatttcaaaggtgagatcgcatcatttccataaacgtgatctctgtcagagtattgcatcatcatttgtggtagtgaggagttggaagcaaccttggtatccatcattagtagatactcaaataagtaaaatgtggcacatgcacactatggagtatgtagcagttagaaacagtggaccaaataatacagcaacattgatggcttctaaacatagtggttagtgcataaaaaagtaaaagcaacagttttcattgctcagtaccatttctgaaacttaaaaagatgtacacaatgcaacatatagtttcaagaaagaaaaattaacagacatcaaaagttatacctttgatagaagggaatctgaatgggcaataatgggacagatacatgaacaagtacagtagtctccccttatccgaggtttcgattgccatggtttcagttacttgcagtataatacaataagatatattaagagagaagccacattcacataacttgtattatagtatatattaaactttatcatcagtatgtatgtatagggaaaaaatgtgtgtgtgtgtgggtgtattatatagggtttgccactacctgtattttcgggtatccactaggggtcttggaatgtatccctatggataagggaaaataaatcttaccagcagtatttaagatctgttagaccaacactaaacctttacttacagatttaaaagatggtctaaatagagacaagtaacattttttaaatgggaagacttaatgtagtagaagccctttaatgaaattaggaccaatgattggtagtttaattattttaaaaatcttgttaaagcaggaaatgtttaaaaagtgattgatacatatgattttttaaaaactaaaataattccctttcccatcttatgtgggccataagacttagtaagaagcagtctgttttctgacataaactacaactataatctgtgattactttatggtgttgcaccgattgaagaaaaggagcctgcatacaggattctaaattttttagagtttacccctgaatctcttcataatttgacactttttattttagcatcttgccttttagatgaatattttgcaaaatattcgacttagtttttgtgaaataattccctttctcatttaaatcagtcaaattgattaagtggaagtctgttaatagcatcaactgagacacagaaataaatgagaaaacactgataatgaatcagggtgagttgctgtatcagataatatcataaagctatagtggttttattataaagccaagtttttatcataaggctttttatgattaagccaagtcttgcagttggcacaggaatagacaatacatctgcaaaatgaaagagtataccttatgttgcttagaacagtgggacagtaggctgttttgaggggaaaatgtgtttagaacttttcttcacacttgacataaatcctaggaacgtatttagaggtaaatacaggtgacttttaagatctttgataagagtttgctaagaaagttaacagacctagaagtcattaaaaatacagctttgatcatgttaatttggttatttgtataggaccacaatagcatctgacagaattcacatcaccctacttttaggctgatacaaacacactaatatttcatactttaattaaatgttctgacaatttaagtagaagttaaaatgcaaactgtttttggtataagtggctcacatatataaagtatcgggtatgtttctttgttttgttttttaggtaattcagatccagttgttgttcttcctttggatgattttaccacagaaaggactgcttaaatgattgcttttttgtccctttgcatttttgacactttttacctttgagaggcttgctactttttgctctgaattgatctaaagagattgtagattggaggttaatttctagtcctggagaatttggaatcttgacaggtgcagtacattgcagcctttggtaatagattgatgtgtttggtgctttgcaataaaagatttttacaggtttttgaggtttagagataattaggtatttagtaatggtacctccaatactaatatccctcattaaaatttaaaaatttcatgtttctctaaaatgtaaaatttctctaaaaacttgacttgttcatgtgggcttcttttatttatgtatttattttttttgagacagagtctcactccattacccaggctggagtgcagttgcacgatatcagctcactgcatcctccgcttcccaggctcaattgatcctcccacctcagcctccctagtagctgagactacaggcatgcaccaccacacccggctaattttttatattttttgtagagatggggtttcgccatgttgcccatgctggtctccaactcctgagctcaggcgatccactcgccttggcctcccaaagtgctgggattacaggcgtgagccactgcctgtccttgtgggcttctttaacaatgctcatagaaatcttggttcatgtcttttcagtcttttcaggcaacttcctttgcaacaaacacattcacttgcatgtgtataagaacctggatttggatgtgaaacctacttttgccaacaaatattaacctgtttctgtgtctgtaaattgggggttacaatatctacctcatagtttttttaggatcagagtaaaggaagtcataaataaaacctgtagggttaatgccatcatgttggaagtacttaataaacagctgtcatttgtagatggatgtcaaccagagaaactacatgccattcttttgtatttgctttcttttaaaatgttacacatgcattattttataagtgcatgcatattgtcacatgattattttcagtacagccttttccctcttggttcacctccccataacctcaaatgtattcttctctatatattatcttcatattatattgactgttgagggtgtttttgtccttcagttacaaatgcaggataccttacatccttgttttcttatttcagaccttgttcaaaaatcactttaaagtcacctgtataactatagggttcttttgatggctgcatagtattccatgctttggatgtaccatattttactcaagttccctattgatgcatacttatatttgttatgaatgatgctacattaagcaatcttatatatgaatttagttactgatacatttaatatgatattataagagatgatatggagatcataagatagagtcccagaaatctcagtgtgactttattggcacttcactgatcagtaatgattttgagcatctttatgcttggccattaggatttgttcttgtgaaaggttttatcttttgtccatttttccatttggttactttttcctactctgtaaaaccatattggagatattagtcctttgtcatcttaaaagtattttttcccctaatcttcatgtatattgtctttgtttattgtgttttgtatgtgatgttttcaaaaatggttcagtcaatgcttttatataaaagattgaatatcgtgttttggtctttatgaaaagtgactttggatatggtgtctttcctcatagtagtttttaatgactaggtcaacccagtgatgtgggctaattgtgaatgtgaacagtgattagttaactacagatgtagggaaaattctccagaaagacttgttgaatcagttgaaagccagttggctggcttttgtgaaggtctggtatactctaggtctagtaaacttgaggatgcatcagaatcactttattaaaaaatatattagtcttcctcacctccatcccacctaactcctgagttgctgattcattaggcttggagtgggcctcagaatttgcattgctataaagttcccaggtaatattaatactaacctgctggtccagggagaaccactggcctagtctattttattaagttacaaacttttatcaaattcttataattccatcttagagagcatcaagcctttttcctgatgtctgaatatttagcaaatcctgtctagtgtgaggtagtgttgtatatgcctctgtggcataatgaatatagttatttatgggttatctacttaagggctaggatgttacagtaacactaccagataggtgaatactgtgaggctcagaagttacttatgtattttttttttgttttttgtttttttgagacggagtctcgctctgtcccccaggctggagtgcagtggcgcgatcttggctcactgccagctccacctcctgggttcatgccattctcctgtctcagcctcccaagtagctgggactacaggcgcccgtcaccatgcccggctaatttttttgtatttttagtggagatggggtttcaccattatttttggacaaaggccctgggctctttgcttctgctaaaatgtgaagaataatatctgttcttcctgtcttaggcatttggggattctttgagcatggtcatgttcgtttttttaaataaaaacaagcttacttagtacttgagaaagcaagataaatagataataaattaataataataagggcaaagaactagtgttattctgaatagtactgactaaaaagtaccctagaatcttaacatttaatatgttgattttgttggcagcgaaacaaacttgtcttcctgataaaaataggtgcttggtgttttatgtatgcaacaaaatttatcataattgtgtatctactcattttggtatattttcttagtctttatctgatgaatatttcttcacaagaaacatttctttatatttcatataatgttactagttcataaatataacaacagcacagactttcgtgagtcacgtttgagttggcagggttttttaaggatctcagcttaccaaaactttctaattaaaggtgcttgttttttatcaagttgcaaaagttggcaagaaggattttgtggtgacactaataaaagtattctgaaacaattagttggaataacagaagaaacaaaaggaaaataattgtgtagatacacagcctttcaagcttattctgccttgcagattcagacttttggtttgacttacctgtctgttctctgtagcatcaagcctttataccctcatccttactttatggttttcagcaaattgcatgtgtcttcgtcttcactagatgtcctgggaagagccaagaaaatattgaaaatgtaatgaagtacttattaggtattaaaccattttataaagctatagtaatttaaatagtgtggtaattaagagtggaattgaccaatcagtaggttccagaagcagatccaatgtgtaagaatcgaatttatggttaagatggcatttcagattagcagaaaaagaatggattattcaaataagatggtgttgtaaaaactggcttactctttgggaggcaattaaggtagattctacctcatcaaagtaaaattaagatgtaataaaaagctgaaatgttaaaaacatgaagttatacaagcattgaaagaaagtataactgcatggttgtatgctgcttgaagtggcaagatattttcaagaatgagactaatgccatgaaagaagaaattgattccattacagtatgattttataccttctgtctgtgaatattttaggtactgtcaattgtgccatctatggttatctcaatttacttcacagttttcttcttacttaggtaatttccagtatttttctgtggtaaataatgctacagtgaatatctttaatacgtgactatttggccatatttagcaccaggtgtttgttaccttttttggggtctcactctgttgcccaggctggagtgcagtggtgcaatttcagctcactgcaacctctgcctcccgggttcaggccatcctcccacctcagcctccctagtagctgggaccacaggcatgcaccacatgcctggctaattttgtatttttagtagagacggggtttcaccatgttgggcaagctggtgtcgaactcctgacctcaggtgatctgcccgcctcgggctcccactggctgagtgctgggattacaggcatgagccaccgcacctggccgtctgttaaacatcttaatgaatgtcgaaccttgtattttacagattcttgtctcattgccttaaacttccctagttgttttaaacttctgattattttttagagttctgatagacttgaattccgacagtcagtttattcactgtttttgtgaaggtgtgggcttatggggttccccattctgccattttcactgacagcattcctagtagaacagtctgtttttaaccagctgggagtgggggatatacatatctgtgtccaggcagactttctcacttaggttttcactagagaagtaagccctaatgccctaaggtatccattattaatgtagcaaagagacttctctcttgtgcatctaaggtggtgctagttatgtaccattatttggagaataaaatgatcattcaccatgttctgtgtttcatatatgatacctggattgagaaatgctgccagtagatcaagtgtagtttgagaaagcttatttctcacaggatagtcagatgatgttttatttattcatttatttatttacaggtttagaaatagcattctatagtatgtacctttgtgactggcatcttcagtggtttacactgtttgtttttgagacttctttggcaagtagtgatataatagcatttaacaaagaggaaacacttagatgtagagagagagccatgttagttcatggtggcagcccagatccgaggtgattgggacccacactagacaggaataaaatgaagacatagaatataagtagcattttgtgcttcaatcatgccagacttaaaaatatgataatgcttggctgggcaaggtggctcacagctgtaatcccagcactttgggaggccaaggcagaaggatcacttgaggccaggaatttgagaccagcctgggcaacatggcaaggctcctacaaacatttttaaaatgtagcctggcgtggtggcagcatatgcctgtagtcctagctgtgtggcaggctgaggcaggaggatcctttgaccccaggaatttgaggctgtggtgagttgtgattgtgccactgcactccactccagcctaggcaacagagggagaccttgtctatctctcacactctcttcatatatagctacatatatataatttttatttttataaattttatataaaatttatataatttacatatttataattttttaaaaatatacaaaatatctttttatatgaaatgttttatatttgtaatataaaaatctcttcagtttgacataacaaattaataaatttgtttcaaataatatctcatttctttcacttcgtcaattgtttgcctgaactatatgccttgccccatgaggcagggagatatatattttttacatatataaatacatattttatgtaatatatgtaaaataattatgaatgatttaaaaataaaaatacgttaatgctcttaatgttaaagtgatattttaaaggctgttaagatgcaggctagttagtaagtgagactatgtggctgaagttttgtatttagaagccagttgagccactccccccattatctcaggagcttgttgatgaggttttagatttgagtggcaaagtacagtagtaataaataaggtagaatctgctttgtaactcagctcatgtcaaaaagagaggaactggaaagcatgatttcctccctagtgctttcctccctagtgcggaaggtgagtaggcagagcctcaggcaaggcctgataggacaggagggacctgtcagcacacgtgactacaggggtatggaatataatggctggcagttgctgcttgagttcttcctaggagcatcctcactgaacagtgaaattgatctcattgaagaaatcacctttaggcagaccatcttgccttgattcttaagttcttatttctgttcgttttttcctcttgtttgactttcacattggatgtcttctcaacattatgttccaagcagccacacactcttaaatatatatatgtatgtgtatatacatagagagaaagagagataaggtctcactctgttgcctaggctggagtgcagtggcgcaaagtcaccataagcactgtcttaacactatctttttcctttttcaagagctggggtggaaaggagaatggctttggacttgcagaatgttgcagagacttgcatatgatggtaagtaactctttgggatatgggtgtcttttgacagagctgtggcctctctgtgaaccttactttacaatgaattgtggtatatgaagtgacgccttcacatcgagacctttgaggaacctaagatcagttcagacatagctgaaccacgtctataggaagcagtctagcagtgcttgggctcttgatgtgctggtggtagataaaaaaatctgagaaatagagtgtgtgttcatacccagttcttgagtaggtagctgtatttgttgaattaattttaatgtgattttttttaaatcccagaaagtatgttcgcttgcattctcacactggaactattgtatcagaactctggacagtgtggtgtgatttaggaatggctgcttggagagcagttctaccattaggtttattgagaacttataatgttttatgtgctttccttgtttatctctctgcctttcacccatgtttaagttatgagctcaggccatcctcctttctgctttgatatgttgctgtggagctacaaaacacaatttgattttcaataattattttgcatctggaagcaactatattttccacgtgggatttgtcttgtcagtttgtcgtgtttagcacaaatggctgcagtgaaatttagtgtatttatcttagcaagcctttttttcctaaagagaatggctcttttctggtctcagaaaaccacagattagatcaagttactttcccacgttagctggcatacttttctttagtgattattttatgaagagatattgggtgatacagtaggtgagtgttgtctgtttaataatcaaaactacataaatcttgaagtatattcagagtttggaattctaattatgacaacataaaggttaacgtgtactttaaaaggaagtaatacatatacatgttaaaaaattcagagtataaagaggtatgcagtggtaacttcttaattttccagaggcaaccactgcaagtggtgtctttcagtgagacattttagtgggcattctgctgtcatcttaattttgttcatcatgttgcttttctagagttaaagagaatgttttgtcagggtctggtttatgttgtcttggtatctacctgtgcagaaaacataccatgagaagtggtgtagaatggtatagaaggaaagtgtttgaagaattatgaagatatgcctatgaggcatactttgaattaaatatttcagaaggctgatgataggtacaaggtttttcgtaggaatgttcttttccattctttagctggtttctgggccctggtatttgttctccatcctttcttggattcttattcattactgcttggcagtcttgcccctcttttcccccttgggaatagccacagtcaaaattgatctcttaaagggaaactggaaatttataagtatgaaatgcagaaggtttgggagctctgggctctgtccttttgattctgtttgaaaagtctcatcctatctgagctctgctctaagacaaacagttaaaggcactgtaggtactgaatgtactgcttattcttctgccacaataagttgaacaagtggctaggactttgagggaagatgtgggggataatgtttataatcagttgaaactcaatgtctgattctttgatgtgctttatacacagaaatatccacccagtgcaactacactacactttgaattctatgcagatcctggggccgaggtcaaaattgagaaaagggtgagtctgattcagatttgttctgacaaagtctacaatttactgtaactgggattgcctcttctagaactcctcagttaaatgaataaatggttttgagctacactgctgccctcgcaaactataaatatacctagcagctcctcaggagtgttaattgcatccccaactctgatagggttgggtcttatgttgggagctgccaaaagatgcaagtcccatccattatgaggcactgctatgacctatgtgcttttcccacagtctctgagaattccaacatgtagtatagtagtttggatggtgatggctcaggtttctctaattaggaagcctgcaaaagtctttatgtattgtggatagtgtcctgcttaaattatctggtcattttgtattgtttgaggaggtactaaagagtttggtttagaagtagcttagtgaaaatacaatttctcttctacctatactattcaataaataaataatctttctagcttaattgccttgaaagcaactctaatacatattcagagagaaaatattttcatgaatttggtctttgctattaatactgctatggatattaagtcagtggagggttaaaaaaggacaaagaagaatatgaaatgtgcctggctatgtgcattatagtttgatactactggttttaaaggagctttcctaagaatattctacatataagatggatgttttggaagattctcaatttaccttgattttaagagcattcacttaggcttcagcctattaggtgacatcttggttttcagacagccctttggagctctatggaaggggaagctagagtgttcagtgactccttacagctctcttgtcttttttaattttagacaactagtaacacactacattatattcacatagagcaacttgacaaggtaagaggaatctttgactcttggctcgtttcttaatgtttggttcactttttgttcctaactatatctttttttttaatgtagatttcagaaagcccttctgaaatcatggaatctcttaccaaaatgtacagcattcctaaggataagcaggtatgatgtggctttaaaacatccacaggatgtggttgttatctaaatagattaatgatatgtactggggtgggagattgcatagcagaaagaatgtcagctttggagtcagaccatgggcaaattgttagcttctctgagccttagtttccttgtcttttatgaggttaacacttaataacttcctaggccttatgagagtttgaggaaaacataaactacctcaccgtgagcaggtaataagtggtggtagctttctgaacacttcggatatcaaaggagaaaacgtttagttgtgttgttttttgagttagccctcataaagaatattcacctttttcattgatgtttttaaaatgtatgtcttatctctctacagatgctgttatttacacacatacgactggcccatggcttttctaatcacaggaagcgattgcaggcagttcaggccagactgcatgcaatatctatattaggtaagagaagaatactttaattaccaggccgtattagacagtttgggcctgatttcctttgaacttcattcatctttgttgctatgagtcctattatagttacctaggtagcaacttaaatacttccacccctcccagtgttcactgtatttattcattatccttgagctccttaatgttggacgagaaagagggtatgatgatgttgattgacatgtcacctgggtttattcttggtattcgtctctttttttttttttttaatagatatgcttgtagctatcgttcactgtccccctactctttctcttgccattgtgtcttcctcctctctcatcctttcagggatatcattttgaattaagtcacaaaatattcagtagtcaatactgtgcatttaacttcttttactgtggcacagtaaaatggaaaacacgtggttttgtaatcagtcctgtactctgtccctgattctgtagattattagccacacttatcctctcagcctcagcttattcgtttaatattgaggtactcaccgtagaggctggtctaaagattaaatgaaaacctagaaagcaatctagcacagaacaagcacatagaagatataaaatggtaaccattgctgttattattgatgttcattatgttatgacttgccttctcttaaactatgagtttcttggcgtgaaattcttgctcttttatgtgtactcatatctagcatgatttctggcatgttagtgggtgctcaggaaatctttgttgaaaactaaatgaatatgcctaaatcccattagtttatgcttcagggtactgtgtccggtattaacctcatcgtggaattcattgaatgtgaattacacacattctgaagttttactacagtgtcacacaaatttctgacttactctgcaatggtccataaattctgttctttacaagtgtttacagtaaaagcagaagcataggaagaggctaaaatggaaatcttatattgaaggcatagtggagttacatcaagtagtaatgttatgaaaaattaactcagagcttttcctatttccatccccaaaattctttctcaagactaataatacctttagtagtggaatctgtcaattcagtgtctgtttagagattatcagttgtatttgatccagtccttcagaatttaatttggtgatgattctgccctccattgctggttgggaatggaattcttccccagaacctatagataccaaaaagtttgttattgggcagtggcttgaccactgccttcttgcctaaagtgtttgtttctccttttgcagtgtattccaatgccttgcaggaatcagcaaacagtatcttgtataatggcttgatagaggagttggtagatgtccttcagataacggataagcagcttatggtaagtattttacaggttgagtaacccttagctgtaacacttgggaccagaagtattttggatttgagacttttttggggggggaggggatatttgcatatacataatgagacatcttgggcatgggacccaagtttaaacacgaaattcattgatgtttcgtatacacattatatacgtagtcttaaggcaattgtatacaatatttcaaataattttgtgcattttaactgtgacctgtcacatgagatcaggtgtggaattttccacttctggcatgcaggtattcccaaagttttggatttgggaatatttcagatttttgaatcagggatcctgcattaatgttctctgtatatcaggcttatacttgtttgccttttggtttttcccagagggttagaaagaactcccagtacttccctctttgggtattaaactgcaaaactaacaaatactagattttcattgttgctctcaacagacctccatcccctcaagcagttaccagtagaatgacttatattttaaagtttggatattagcaactggaacttggttcagtcatcttattatatttgacacattatgtgtttaccttctaatttaataggagattaaagcagcttctttacgaacattaacatcaattgtccacttggagagaactcccaaactcagcagtattattgactgtactggaactgcctcctaccatggatttttgccagtgcttgtaaggaactgtatccaggccatgattggtaagttttgatggtgattatcttaggcaagaagaaacatttgccctctgcctttgtctttttaatatcctgcctgcttaacagcaattttgagcttgtttttgttctccctctccccacctcccttgtagatccttccatggatccataccctcaccagtttgccactgctctcttctcttttttataccatctggccagctacgatgctggtggtgaagccttggtctcctgtggaatgatggaagccttattgaaggtgctgtactttttttttttttttttttaaactacatggggaaatcaactaagggtgtagagatgcaagtttggggtgtttcacagtgagggcaaataatataagaaagcttatccagaaaaagttatacttaagtagaaggccagtttggctttctagttatctaattaacaatgtttaagagcagctacttccattattgagacttttatcatagtgtagaatggtcaggaggtcatgggttctggttaaaacattgccacatgttatcatgcctttacacaaccatagggaaaatatatgtcagggtactttgtaagttgtgttgtagtagtaatagcctttactatgtgcagggcaatgagcaccagcttttttctccctaaatatcttacttaatcctgcaaagtaattgatgtccccattacctcagaggttgagtcgcagaagtcatagaactgtcatttggcaggcaccaaaaataaaacacatgttttcccccatactgtgctgccttactgaggccccagactacatgtatacaaaagcatgcaatttttacaactttgtgtctttatagttcattgtttttgcctctttttctccgtgataggtcataaagtttcttggcgatgaacaggaccagataacatttgtcaccagagccgtcagagtggttgaccttatcaccaacctggatatggcagcttttcaatcccatagtggactttctatcttcatttatagacttgaggtattattatacaaggaatgctttgcacagaatttaatactcagagctgaacctaaggattgtcctgataaccctaaagagcgatcttacagtctcttctgtttctagaaatcaactgtgtatctgcttgcagtgtttttccattataatagtttttaatccctgaaaaaatatatatatatatatatacttgattttcttataacctttctcttgattgtagcatgaagtagatttgtgccgaaaagaatgtccgtttgtgatcaagccaaagatccagagacccaatactacacaagaaggagaggaaatggaaactgatatggatggtaattaacagttattaagtcagtatttttgtgcttgagattttttgtcatcccaccccagttttcattcttcctcataaattccaaagtacacaattaacttgagtatatactttcagcaacaaaaattttttttctatgtaagtgatttgcaaatttgtttttcacaaagataataagaaaagaaaggtactagttctttggagtagagatggcaggtaaagcagatgctatagctgtggtgttaatctgttttatttcatcacgtaattttcttatgtatttcttattgtcttatttctactaaaattcaagctccatgggatcaggatattgtctttttcactgccgcagtgcctgataacatcctaggtgttagaaatatgcttggtagagagagagagactaaaatgggaccttttaaaactttacctattttgagaagagaaaggagaggtaaaaaggttgttgggtaggcaacaacatccgttaggctggcacatcacttgagcccaggggttcgaggccagcctgggcaacatggcaaaaatcttgtctttacgaaaaatacaaaacttagccgggtggggtggcatgcacctgtggtcccggctacttgggaggctgagttgagaggatcatctgagcctgggagtttgaggctgcagtgatttcaaaatgtaaatagtattttatcactgatggagccttaatacattttataaactgtagtcaatgattgtgtatcttatactcagttattcaagtgtataaagtaaaaatgaatgctcacttacctaccatagctactagtttcggtgcggatctttccaggcttttttatgcatattcaaatacatgttgatgttaagtatgtatgtagtattttagaatgggaagatgagatcataaacatactgttcatcttgcattgctcattcagtgtttcatagacattcttccagatcggaatattgagtattaatcttttcatgctttttatatttattaattactcttttgaaaagctgtacctatttgtatactaccaactagtagtatatgaaattgcacattttacttaccactctccccctcttccccaatttggtaggtgagaaatattgaaggacttctgtaggattgttaatttacacacacacacacacacacacacacacacacacacgtgtatgtatgtacgtattaatacatgcaactagtgatatattttcattttggggttcagtattcctgatcttcatttttatattcatttcacattaatggaagaaattttctcaaacaaaatttttctttttgtggtaccttttattctagtaagtttctttatcataacttgtactttagttgcagatgtggctatggaaagcagtccaggctcatccatctctatggagcacaggctggatgttgaattaagggcatcaggttccagcagcagcactaacatctcttctggccccagccctggtcccagtcccggcaccggccccggccccggccccggccccggccccggccctggccccggccccggccccggtcctggtcccggccctggccccggccctggccctggcccccgtcctggtgcgtacacacatagatgtgcagtctttcagagtggtagagttattaaactattgaagaaggcggctttaggcagaacttaaatggtacatttggaggttagcatcccatgactattcatgctccttcaccattctggtgttccattttcttatattaacatgtctttcatagcattttatacttttccaacaatttgcacattgattatcaaaacagccatgttggagggcagataatatccaaaatgggaactgagtgaggtaaaaaaaaagttgaacctttttactttgtaatttttcttttttactttagacttttagtattggtaaaattaaaagtattagtaatttttccaatttcaaagcttaattaagtattcttcctaacattcagagacctcacttcgaatgtcttctaattttattatagtgtatttggatctcttaaaattttgttttatgtgcttgatcattgtggtttaatggcgaactcagcataattcttttgtctttcttcattgccaggagtccagtgtattccacaacgagcagcacttctgaaatccatgttgaatttcctcaagaaggccatccaagaccctgctttctcagatggcatacgacatggtatttgattccagataactttttttggaggatattttactctctcaaagattggttcttttcatactattctggcacctgttgttttacaaggcagtctttggtaaaggccatgccattttcaatagcttttagttgttttgtgtcacttttcctagatgtaagtgttgcttagctattttcataatgatttaccctttttttccccttttccagctttcgactctgtgcttaattccgtcttattacccctttctgactcttaagtgtttgtgttctttctttttttaacccatgttagaaagcctattgcatggacaaataataaaataggaggagacaactgggggccattagattagaattaacacaggctttgaggaccacagtgtgataatacataacatatcactcaattatccccactcctcacacctttccagactattcgtattctccataatgttcacttttcttttagtgatggatggttctctgcctacctccctgaaacacatcatcagcaatgcagaatactatggcccatcactcttcctcctaggtaagtggagttgatagttggttataacaatttgggataacctggcagagctctctctctctgtatttacttacttacttatttacttatttatttttgagacagagtctcactctattgcccaggctggaatgtagtggcgcaatcttggctcactacaacctctgcctcccgggttaaagcgagtctcctgcctcagcctcccgagtagctgggattagaggtgcctgccaccatgcctggctaatttttgtatttttagtagacaaatatgaatagtaaaatcctgcaaggatataaaacacagagaggccgggcatggaagctcctgcctgtaatcccagcactttgggaggccgaggcgggtagatcacctgaggtaatgagtttgagaccagcctggccaacatggcaaaaccccatctctactgtctacctggacagtagacaaatgtcaatagtaaaatcctgcaaggatataaaacagagaggccgggtagatatctgtcttattggtgatgaaataaaggtcagaattcagttttaagtaaatacctattttctgggtgctgaatataccttcgataagtagtacatttgtagtaagtaacattatcatacattttgtttatctgtgctagaattcttaaaacgctaaaggaatttagtaggagacgtggaaatagggaaagtctccttgtagtagcaagcattgtgttttacagtttggggtgttggggagactagttttggctactacaacttagatacttccttgcccccttgctgaagaaatttaggatttttgtatattaaccttgtatcttttaatcttgcacagttcacttattagtacatacttgttttgttttcttagaatattctacataatcttgtcatctgcaaatgcatttttactttgtttatggtctttgtgcctttttttttgtcttatgacattagcaaagatttctgatacagtgctggatagaaataagaatgggcctctttgctttgttcctgaatttagagggaaaagcatttaatatttcaccattaagaatgaagttagcagaggttttgtgttgaaggttttgtcaattttgtcaggttgaggaagtcttcttgtggtgtagcaactctaccatgctatggaaaagctctctgctaaggttatgttcagatggcaaaattcagacaatagttctttggggtttttttgtttttttttaagatttgttttacggtggggacgtctcaaggccaggggcagggagaatgcccgtcttctgggagaaagtccagaacagagagaaagagaaaaggatacacaggcatttttctataaatgggaagcttagaagaaggagcaattgccattgacagggatattgtttaaaagagggaggcagcaagaggatatagtgcttaggtgctgggatagtggtgaggagcaggtgagccctatgaggatgatgccagaagtgagggacacgggcaggaaatgagacttagagcactaaatcaaaggtcagtgaaggtccaacttccttccctatggttttcttaattcatccctcacatttaaattagcatagcaacctcccagttttcccataaaatacacttgtacttgagagagaacaaatttgcaaagcgaaacctaaataattagactagccattgttattttagctccccaaatgatagtacagagcctttcactccaggtggaaggagatggcccaggaaagacatcagggagttctgagaacctcttggagtattttaataatataattggcagtttgggtttatttttgttgaactattctggataccttttctttattaatgatcatgcaacaggaagtccctttaaggcacaagcactatcttgaaatgccagtaggtagtttcatgccagtctgttatcaactatcatagtaactaaactgctttgtccctcattgagggcttcttaggcctgaactgtttggttaatgtggtctgtcaggagttacaacatgtctcggtaacctctatgagttgagtctgtgttacagaattggaaatacctaaacttgtgcccgttacaccaaagattctgatgaggcccagaataggtaaaaagtgctcctttttgtggcaagacttgataaaacagctagactttctagttgaatttgaggtgccctgggcactaaatgtccatagtacataggtcagcttgtatgggtagaagggaacaggatcgctgaataaaatgtataaccctgctgagcaggagttgtaacacagaagaatcagtagcccaagaggttggaagttggagtttctagggggcaaacttatatcagggtggacattctcaacaggggggcatcattgtatgtactatcagttggtggcagaggctgggaaagacatgaaatccttaagggggaagtttaatatggaagcacccagtgaggtcacgatgtcctgcttataatttcacactcaaacccactaaatattctgactccttctccctcacgtgtccgacctctggctcttctatgccacttttagccacctgtatttcatttgtagtatcccatttaacttccccaactcccctctcttctttctcacctcctgccttacccctcatgttatctgttcgggtctgtttgtagcctatgctaatgtcatcatgcttatgattgaccacttaaccagagagtgtagcaagttgtcaatatgagtattgaaatcctccaagggagcaagatatagttgtatgagtagttgcctgggctagggtatctgttagtattgctggaggtttagtatgtaggtggcattctctgttactaatacatagatacaatctatcaggttgagtgaggggaagcaggaaatataggtagtgactggaatagtgaaattagagtgtaaatagtgaaagtggagtgtgggctgtcaaagagttgatggggcagtggagttatgatgagttatgtgggggcagttacaagggcagttaccatcttgagggtgttagcgtcaaggctgggactgtcagttgtactgaaatcatcatctaggatgctttggtatgctggatggatagaagccctaggctcgcacttgagaaattattataaaagtaactcagtatccctttgcctacaagagttttagaataatttcagatagggaagctatgcactgattacccctaaacaagtgggatcacagcatgggcaaaaaggagcccaagaagtttggcattgagctggggtagtagtatcccagacccagaccatgagccaaatgaggtatagacaggccaactagagccagaatattccacaaagatattttcaggcctgtggtgcgtagacttttggcatgccgaagtgccagtttattatgggaatcacaggcattgccatcccatatcctgcaatagtctcccattcaatacctctgtaataaggtggttccagaactggcttcctgtctaagaatgttggtactaggaactaacttaagatttttctttcctctttggaagaaccatacagttgtgtatgtcaacccaggcagagagactaagaccttcatttcctatgaagagggatctccagttagcagtcctttaaaaccatcatattaggaaaggactttggcagagaccttctgcatagtcttagagggtgagggccctcaattttctgtgggtcccatcctgttacctactttcaacctaggctcctgtccaccgtggatcgcaccaatatcaaatgaggaggtgtcgttaagtgagggggattctgtttgggtattatagactcatagatggaaagtatctcattttgaggctagaaaggggacaaaggaagcactaattgtgttttttcagatgtcatacaactaaggcaatcggcaaaagagagatcaatttaagagaccattgtccatttagtaagtttaagagagcattgaacaagccattatgcctctattaggcctgctttctgtgaacagtacaacagatgggccaggcactggctcacacctgtaatcccagcattttgggatgctgagacaggcagattgcttgagccttgagcccaggagtttgagaccagcctgggcaacatggtgaaatcctgtctctacaacaaataaaaatgtttgcagggcatgctggtgcgctactcaggaagctgaggtgggaggatcacttaagtactggaggttgaggctgtagtgagctataattgcacccctgcactctagcctggggaacagagtgagaccttgtctcaaaaaaaaaaaaaaaagacaaatggaagctccaaggtgatgccttgtttgaaaaggcccatgcccagactgaatgagcggtaacgtacgtaccctggtcagagtcggtgttaccagaagcccaaagggaactaactgagggctataatagtggtggtgttggcagtagttgggcaggaaggataagccaagaatgggtctgtataacaatcagttgtgagggcatagcgatttgtgccagcagattggggcagtggcccaataaaattgatttgccagtgagaaaaggagtgtttacctctggtatggtgagcccccactggtgatgatgccgatggcacgacagggcacaaagaacatattgggaggctagggtttgagtagggctagtggcatggggatgcaatggcatttgggcccagggactgtgatgaccttctgccttcctttactctcttctctgtaaccttgactttccaaactctgttggattcattttcagttctattgaagtacatctgtgggtaatttttaaggtgtcagacttctctttcagaagttggtggctgttttcttcattgtattctaatgctacattattgtagataaccatggtgtcacactggttcttgttcttatctgtatatagttcctgcttctgcctttttttttttttttttttttcttctatttctctgattccttttaactttctcctggaaaccctaattaccttttttccatttcttagttgcttggttccacacacagctggttgctctgtgcgtgtatataccctttaattctaattcttggttatcagtgtttttgtataggggtcccagtgcatagtgtcgttgcgacttcttgataaaataacaggtttgatgtcttagtaattgcttgtagaacactaattttagtttttaaatactcaattttagtaactctatagaattcatacatttctacaaatgtaagtcaatcgaggggagtgtcataccaataggaaccccaaaaaggacttaaatttttcagaagtttatagcccatgaggaatcccaaaggccattgaaaactgttggtccccggtaactgctatatatctgccattcccctagcatttgggataaaggagagatgctgtattcaccatcttgaatagaaaatcctctggtttcttttagatcttaggcatcaccataaacaagtttgttctgtatacatggtttatgggtgttgtatgtatattcctcttcatcaggttttttaattaaagttattgtagttattgtagtcttatgagttgggaagctttgtcttaattattcctagaaggtttaataaaactattggcttggtgcctctctattacctggattttttttttttttccccttttaaaaattctggaacgggcacggtggctcacgcctataatcccagtactttgggagactgaggcgggcagatcacctgaggttaggagttcgagaccagcctggccaatctggtaaaaaccccatctctactaaaaatggaaaaatcagccaggcgtgttgggtgcctgtaatcccaactacttgggaggctgaggcagaagaattgcttgaacccaggaggtggaggctgcagtgagccgagattgcaccactgtactccagcctgggcgacagagtgagactccgtctaaaaaaaaaaaaaaaaaagaaaattcttactggtctagtctgctttgctgtcacttcctgagatttgatttttatgacattttcttattaaactatacatttcacttgttggcatatagtttgtagaatatatttttctgtatctagttaaatctcctttctcattcataacgtatattactgctcttttttctaatttatattatttcacttgttggcatacactttgtagaataaattttttttttctgtatctagttaaatctcctttctcattcctaatgtatattactgctcttgtttctaatttatattattgctctattttctataggtttataagcttttccagtgtcttcacaaagctagatattggcttcgtttatcctttttgctttcgttttcactgaattcttttttctgttaattcttcatagcttgtttggttactttttaataaatactttaatgctgtactatttcctcttgagtagagtttttcccatgttccagaagctttggtagttattactgcacattttaaaatattataatgtcaaaaactgatcagattaatattcaaggactcttgcattgctggtgatagtttaaaattgttgaataacctttgtatgaggcagtttatctattttcatcagtaaagcttgcatttgctttaacccagcaagcccacatcatagattttttttcctgttaaaagcagacaaaaacggatatatgtttaggtttatcattttcacaattgaggactggtttttatacatgtggtacatgcatttagtggaatagtaggcagccattcaaaatgaatgggtcgttgtgtcgggagaggacattatacggtatgacagttgtgggggaaaagcaaaatatataaaacagtgtaacctcatttatgtaaaaatatgcccataaaaatcctgtaagtgtagtcactagattctttatagtattgaatctctgatggagcagtattaggatctttaatttcatagtaagcacaagggtttaaattgctagacattgagtatgtatttttttttaagcttttggtgttttgttttcagtttctgtgaggaatctctcagttttccatattttctcatctttttttagctactgaagtggtgactgtgtttgtatttcaagaaccatcactgctctcctcactccaggacaatggattgacagatgtcatgctgcatgcactgcttatcaaagatgtaagtcttttctgctactctgtaaagaatgtcttagggcgtgaaaatcctatctcttctgtgtgtagtgttgaatctaattgggacctggttgtcaaaattccttctatctcagcttgatacccatggccggattttcctagcatctacactcttttagatgcattcaagctcactttgttttctctttaggttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggtaagttgttaagatttattttatagtagaaaattgatttagtttgcaaggaaactcttccttgatcatctctctcatcgttttactggttaggtgtgctaagtttaatgggaattatcatcatacattctattatacttcagaaggaatacttcagcttctctgctcataatatttccatgcttctcaacagttcaccattgtactttcatggtactggtagaaaataggtattaagaagcagtggtagatttccaggttcaccatctggtctgcagcaatgagaaatatggagtcctgaggtgttcatctggtaatctagtgttctgatgtccaactctctaagataacgacacatggatattttttttttactcagtatacttgagaccagataattgagagattattagcaaaaaggtagggctccagaaagattacagttttcaaaaatgtgctttgtacttttcaaccaccactgtagcatttagacactatcattcttaactggagcagccagagggttaatggtttgtacatctttcttctctctcactctgtaatactagtttagatcttgacagcaaagattgccagagtagagtgcagcacacatagttactttaaaatagtttactaaactgattccttccttttccctagtgatttggggggataggggctgggtgtaaattcattaaagaagttgtggcattagaaaatcacaaccaaaaaaaaaaaataggaaaaaaatatcacaacagcctggcctggcacagtggcacacacctaccattttgggaggccaaggtgggcagatcacttgagctcaggagtttgagaccagcctgggcaacatggccaaaccccatctctaccaaaaaaaaaatttctccagtcacggaggcgcacacctgtagtcccagctacttggagggctgaggtgggaggatcgcttgagtccaggagatcgtgacactgcactccagtctgggtgacataaagtctttaaaggaaagaaaatcataaccaggctcagtttcttctttccactttatatgttggtacagaaaagagcccaagctctattttcttcagtctttctaattctaacagttcattttttgccttaaggggatactgcatccaacctggggagtgctgtcgatgagctcatgagacatcagcccacccttaaaacagatgcaacgactgccatcatcaaggtagaaagtgataaggatgtgaccatgagcatgagagagcagagaaggggaaggttttagaagattggcctactagaggtcattaggattcttgggctatagctgtaagagcattatgtctgcctcattgtttccatgtccttaggttggtcctttataaaaagatgttgtcattttagttcatcttagaaagaagtctctgttaaaatttttttagcctgggtgcagtggctcacgcctgtaatcctggcactttgggaggctgaggctggtggatcgcttgaggccaggagtttgagaccagcctggacaacatggtgaagccccgtttctatgaaaaatacaaaagttagccgggtttggtggcgtgtgcctgtagtcccagctactctggaggctgaggcaggagaatcacttgaactcgggaggcggaggttgtagtgagccaagatcatgccactgcaagactctgtctccaaaaaaaaaaaaagtattttagattgagaattgttttccttaaaaatttttttccatttaatgtaacctgtatataatgatttcttttatatattatatggacaagcagacatggcttagattaagtttgtaaagcatattaccctttctagtctccgtttgttgatccctgtggctgccccccacccccgccttattagctctgccagtttccttttagaattgttgttgaaattggtatataagttcctggtgcttggtgaattgggacagggagtcaggttcgtcagtcacttatacagccgtgtgacgctcaacaaattatttaagtttgcagcacttctattcccttgtttataaaatgtaattaatgaccatattctgggaattatgtatataacatgtatacaaagtgtttgggcaaatacacaacacatagaaaacgctctaaatatgttagctgtctcctcctccccattccatgattactaataagtaatcttatttcctgtgcctttcagttacttgaagaaatctgtaatcttggaagggaccccaaatacatctgtcagaagccatcaatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcagtaagtgtttacagaacagatcatctagccatataatcgtgggcatgttatcacctctctaagtcttaatgaacactttcatctataaaaagcaagagagttgtattagatcattttaaagttctaaccggttctaagaatgtattagtttttccttttttgacccttgtgtgtcatttgtgctttggtatttaattgtattggttgccttaggaagtgatctttttttaaaaaaattaattaatttttaatttttattgatttttttgagagagagttttgctctcgttgcccatgctggagtgcaatgatgtggtctcggctcattgcaacctccacctcctgggctcaagcagttctcctgcctcagcctcccaagtagctgggattacagacacctaccaccacacttggctaatttttgtatttttagtagagatggggtttcaccatgttgaccaggctaatctcaaactcccgacgtcaggtgatctacccacctcggcttcccaaagtgttaggattacaggcgtgagctaccgcatccggccaggaagtgctcattcttaaaagctgttgatgaaattgaatcagaatttggtccatcaagttaatggactttgcacagagaccttattttccctttgttgatttgatattccacatcgactgcttgatttttttcaggcacgtgtgaaaaacaatgtacttttgaagcctgtctcctaagaagtccttaaggggtgtgtgaagatttgttgttgcttgttgtttttttatttttgttcattttgttactatctgttcgttccagattaattagtagaaggctttggaatttactatatgactgtaaatagtcaagaattgactgcttagatggaagcagggagtttgcttaaaggcttagtgattggtagggggtagtccaccaggctctttgagcagtattcacataccagggatgaactgtaactgtatacctgtaacttttagtcacctgcatgctgaaaatgggattgatctttctggacagtcctgcactccctcatataataagtggtcttttagtgtgtaggtaagtcattctgagaaaagcttgagcattttaggcacagctatgaatgcatttgagctggtcctgaatggcaccttgggacttaaaatttaaggtggagttgacaacaggagcaaaggcctagaatccgaaactggtatgtcctcttggaactctaaatagtgatgagcctgtgggtgtcaagtgttttaaggagaggcattaactactaagtatattgctttgttgaacagataccttaccctgtctgagaaggcaaacctatcttcattctagcagtatcttttgttctcttttaaatgttctttttctagaagaggaggacaccctggaaaaaagcacgacttttttttgtagacgagtcttagtgcttcctttgtcacacccttgaatgtcagtgaccctactggagtgtggggttccttttcctggctacaaataaggaaaaattttaaggtgtaggtggtggtggttttaattcaagctcatatatattcatctgcatgtgacgtccctacctggatattttccagatgccttacatctgatgtgcccagatttcaagctgacacagttaatcagcacactaccctcatttgcttaccctcctttcctttcttgggctatcatgtatcactgtgttctatccacagccatccccattcccacatcacctccttttacatccaccagatttctgtaaggctagttcaaatgtcttattcttgaaggaggtaggttggttggttggttggttggttttttacctccaaatgagaactcaatcttgtgttctcccaacagttttgttaaaattattcatacatgttaatggttttcctcactcacctataagctcctcaagagcaagacattgcctcattcaccagtgtatccctatcactttgtatatagtaggtagtcagtaggtttgtttattgaaatgaataaagagccttaaatgaaggattcctgaagtcttaaatgcttagagagctaggcctaatgagacatgaatgaaaatgaagagaaattagaaatataaacccagtagcattaatattctaccacagtgatagttatatgtaacttctaagatgcagaggactctagtagttactgtaccccagtatcagtagttttctacattctggatgctcatcactgcctcatttggataatccaggagtctcacagatgttgacacatacattttttcacttttgccatcttcagaggcctagattgggtcactaagtaaattattagggaaggaagaaaaagcaagagactgtctaaacttagcttcattttgaaaaccacaatatattaacagcaaaagttctttttatcttctatcccaggcaattgttataggggaattgtgtactttctcacaatatggtgaaagggcttagaaagatttggaatatgtgtcacccttctccccagaagtcttgcccatcccttcctccatatccatagttcttccgaatttctgtttcccatgctctcatttgttttccaatgccttatacacacataaaatgattaacttttatctttattttattttatttatttatttttttttttttgagacagagtctcactacatcacccaggctggagtgcagaggcacgagctcagctcactgcaacctccgcctcccgagttcaagcagttctcggtccttagcctcctgagtagctgggattacagacacgtgccaccatgccttgctaatttttgtatttttagtagagatggggttttgccatgttggcctcaaactcctggcctcatgtgatccacccacttcggcctcccaaagtgttgggattacaggtgtgcaccgccgcacctggccaatttatcagcagtttaaattcaggtatgatttccatacagattttacatttccagtttccctgcccaaaattgagactgttactcatcttacttctgtcatcatattattatgtctattccagaatatgtttaaataaaatgaccatataaagtcttatgtgtatattatatctgacgtatataccttcttgtatctagcttctttgtttgatgtgttttggaggttcatccatgttattgcatctgtcagcaacttgttacttttcattgctgagtagtattctgttatgtgataattgtatagtgattatccattttcctgttgatggacttgggtttctgagttttttccaggcttagacactaccctttctttttttttttttttttttttacaaaatcagcagctagtatttgcaaatggtgtttgtatttactcttgaaatacatggttttgtgctggagatttggagtaaggaaacttaggcactatagtctacgccaggtacgtggggtgcctttctacactcagactcactcaccacaagtagttctaaatacctgtcttttgccccctttcttctgccttctgaattgtttgatctcagaaaatctgatattgctggggatgaatatacttagcagttaagtaaccagggtttgtagttggtgcatcacggttcactttgtggttgattgcattagtgtgcctagcttaccacccaccactcatgagcagcttgaaagaaatggactatataaagtctttgtcatctttagaacttgaatagcaattgtctggaatttaaaggcaatgagtgcagagacgcagttgttccctgaaatgtggcccactgggagggctcctttgtcagagtcagctgtctcctcaaaagctggaggaagcacctgaccatccccccatcccaaaaaaccccatatacatcatactatgacactaaattgatatcctcctttacttttgatgggggcatgagctggggctccaccaccataaatactgaaaattgaccagagtttgggaatgtgtgtatgtttggggaaagggagagagacaggaagtttagaaggacttttcttgaaatcagttggtaagttgagtcctgttggaaagagttgatcattttgattattcctgtatggcttcttgggcctgagagccaaaagatgaggggaaggagaaaagtggttactgaacaaatttattcctgaaattatattaagaaccactattggtttgctttctctctgttcttctccccagtttccatgtagcaaatgaagggggcatataggtctcatttgattttactacttaggctctttgccattatatctggcttcttcaaagggttgggtgtctctgggcgggatccacacctgcactccttatcgatagaggtggatctatataggtaattgatataagtaacatggaatgctgcagtggttctgaggaggaacttaaagaaaggtttgtggtcttctcatggaatcatttcagtcttgccttataggtatactccctttctacaaagttcttccccacatttttcattgaggaggttcacaacatcctacccaaacctggttctgggtatttttgtcactgaagtcattcataatgcctctccactctcttttcctgttctatattctgctgccaaatgttcttgtgcctggcaaatctttgtttacattttgtcttgctcaaagatgagaactactagcttcttgccaactttcttgtcttcttcctctacctctccctctgtctctgccccatcccgctctcctgcaccctgtgcccaaatctgtttcaagggcctgtgtccaaaatactccattttctaaagtatttgttccttcctggggtttatcttagaggtatattttgattcatcacaatatactatatgtgtagttttttgcattgagctgcattttctgcagctgtggcatgttgtagccttctcatctgctgtgcaatattgaagcaactgaaaagacaaaagacctgatcagttttttgatagttcaggaactgtcatgctgcaaataccaattgttagggaagggagacctcaggtgtatgaatctttgaactaaattaaattgtatttcctactctccataactttaaacgtgatgcaaaaacatcgtatgatgtttaagtgtttctttgtctagcctctttcttcaagcaaatgttgagtcttttaattgaacttatttttagtgttctcatgtggataaatttccctaacagtagtttgccaaagataggatagcttctcttgtgatgtatactaatgttgagtttttaaaggcttggttgtcccctttatgctttcaaccttggtcaggcttggaaaggtagattcaggattgatttcagctgtttttttcctgcggtatatgagtctaaaggctcatctctaccccataagcctgggaagcaaaggctgcagtgagccatgattgtgccactgcactccagcctgggtgacagcaagaccctgtctcaaaaaaataagcaaataaataaataaatagaaaaaggcctagaattttatacagtgcctcctcctctgttctcttaatattggtattgtgaatttctgtgtaactcactcttttctcccctaacagggttgttggtacagaggaacgtattcctattcccctcatggattacatccttaatgtggtaagattcaacacagggcaaactgagtaaagatgtatatgtgcttttctggaaaatgtgtttcgttatcagagtccagtaattaccgtattcattttaattggaatccaattaagaggggaaagatgtgccacccttttgtttttgttctagactggtttgccagaaattagccaacacaagccccattattttgtattccagatttttttgttcactgttaccattctccattagaatccagacaggaatctgtaacaggttttgttttgccagtctagtacaggctgatcatcccaaatccaaaatgctccaaaatttgaacctttttgagtaccaacataacactgaagggaaatgctcactggagcattttcagcctgtactgtataatgcaaatattcaaaaataaaaatctgaaacactcatggtgcccaagcatttcgaatatgaaatatacaacctgtaatatgttttccaaatgtgtccaacatatattttcccccttttttcccattacttcctgggtatctcaccaaaaaagtgaagagtttgaattttcccagaattgtttaccaataagggagagacctcttagcatttgtttcagcctactaatcacttccaagacttccagagatagtttgtcttgtgcctgtgtgtttattgcccacattttacttttttactcttaaaaaaattctttgtttgaaacaaactcttccagagttcagtgtttcatttgcattatgcgtttcatttgcattataagcacatttgggggaaattttccatgatgtttgcctgcaggagagaggtaggcaaggagcactaaatagcaaattaagagattaaacatgattgtaccactaattcataatgtggccctgagcaagtcacttaacttctctgttatctcgaaatatctgattcttggtgtgcttgaaaatggagattgggcagaaattgtagatattctttacttcctggatgttttagaatccgtatcatacatctggtttatctgaggttttgatactctatagaaaacactaatatcatgactagaaggctaccccatccttattccaggctggccatttagttccacctgtcaggctctaacttctttaaaaaatttttattacctagatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattggtaagaagcatctggccaaatgttttcatttctttctggaaatcaattttgcgatacttctgtatatatgtttttactatggtctcccttcaactaaaaaataatgaataaatttgtgttatgttgtataagtgaattttgtgactaatatatagtgtgccatgttatttctcattgaaaagtcaaagtattttttctttgttcatcggttgggtatgtagttctacatcattagagtttattggagggaaaagtgtatctccaagaaagcttttctagttgggttttattagtacctctcccttctttgttataggtgcattttaaacacattttatgtttatggttatgtttaaccatgtattttcctcccctttcaagcttggtagtcatgtattttaagcataattgacatgtagttcattgccgatacttaattccccccttttcaagcccgatagtcatgtattttaagcataattgacatggtagttcattgctcatattttgccaaaaatgaagcttctttattttttcatagtggtaaactacacataacatgaaatgtatcatcttaaccattttgaagtgtagagttcagtagtgttatgtgtattcatattgatgtgcagccaatctccagaactcttttcatcttgcaaaaatgaaattctgccattgaacttctcatcctcccctctccccagaccttggcaactaccattctattttttgtctctaaatttgactactctaggtaccttatataagtgggatcataaaatattttgtatgtgcgaccggcttttttcacttagcataatgccctcaaggttcaaccattatgtagcatgtgtcataatttccttcccttgtaaggcctaataatattccattgtgtgtatataccacattttgtttatccattcatctgttgattgacacttgggttgctttctccttttggctgttgtgaataataatgatgctgtgaacatggatgtacatgtaactctttgagactctacttttaattctaattttcccacatcctagccaatacttattttctgttttttgataatagccattctggtgggtaggaagtgtatctcattttgtttttcactggcatttccctaatgcatagtgataatgaacatcttttcatgtgcttgttatccatgtatatatcttctttgtagaaatgtctattcaaattcattgttcttttttaatcgtgttatttgttttgttgagttgtaagagttgtgtattcttgtacacgtattaatacctgatactaatttcttctcaggtatatgatttgcatatatttttcctgttctgtgagttgccttttcttggttgtctttggattcacaaacatttttaatcttgataaagttcagcttctctttttttgtttttgttgcctgtgtaaacacctgtgtttttggtgtcgtgtccacaaaaccattgccaaatccgatgttttgcagctttcccactgtggcttcttctaggagttttataacttagctcttatattcaggtctttaatccattttgattagattttttatatggtaaaagtctgtcctttcctattgcatggtcttggtacctttgtcaaaaatcatttgaccatatatatgtgaagatttaattctgggctctctattctattccattggtctttacgtctgtctttatgccagtatcacagttttgatcactgtaactttgtaatagaaatcaaaaagagtgagacctccaaaaatttttccccaacttgttttggctatttggggtcccttaagatttcatataaattttagaagggatttttctatttctgcaaaaccaaaacaaaaaacagcattggaattttgatagtgattgcattaaatctgtgaaactcctttgttagctgggctgcagagtgataagtaattcctgctgaatgagaaatccatttgcttacagacttggaaagatccataattgtgacgtgacttcatttagtttattttgttttactctttgaaatattgaattaaatgctcttcatcacagagaggggaaaatatcctataagatgctgtggaaggatagatagatttatttaaagccataggaaggcacatgatttctcctatctttgcatggcaagtgatggtgttttattgtcagatttttctccagacttgagaggaaatcacaagggtcgtataatccttgggttgtctgataaaaacaaattgcctacctgattcctatctcagaataatcgcttttgttttaagaagaaaagaacagtgtaatagtgactcacttccatgctttggaactttgcctaacattgtttcctatcgagcaaaatttggaattaatcctatagtgtagaatccttgccgtaacagtattcagtttgaccatcataagcttttaagtgttattggctcaccaagtttgaaagtagtgtgttgctctagaaagagatgttaaggtatgttgtacctgacttcatatttgggttccaccatttaccaggtgagagaccatggccatatccaaaatctgagaggcttccatttaattgtcacttccattgtgactattaaaagacatgatgaatttgaagttcattgtatattaacactttaattattcttcctgtttcagacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacaggtaaaaataaccttaggggtgaacatattaatttaaaggcagtgaaatatctagggcatacacctagcagggttactatgcttgaaaggaggtctgcctgaggtagcagctaaaagaacagtccaatttaggatgagatttttttgactgtcaaaaagttgagtgactatataacttattatgtgatgaagtggactttcttgagagcgaaacatgttattacagacaaacatcaattgggtattcatctggccttagtactttctaatctttccaccagtccttataggtctgataatgggatggcataggtaggacattttaccaaagaacatttaaatcaatagtaattaacaaattactaaaaattttctacatatcaaacgtttgacctgtaatccataatccatagttccagaaagaaggcattttgtgtatgtcctcacagttttactacatttattcctcagataattgattctaaagatttatggtatcaacattaaacaaaacagggttcaacagccctgttttatgctattgagcaggagtgtgttctctgttaattgtgaatcaatcaaatctgaagtttaaaaaagcacaagtataaaggatttagaaaattaaattacttaacaaagcttagggattgatttttatgacttctttattaaatgaaataaaatgaaaatgaaacattcaaggaattaaataaatctaggtacttactgaagtaaagaaattgaatggaaataataatacccctaccaaataatttagaaagtagttaatgaacctgtaaaaccatttctttgattcagaaaaaaagagtagcctctgatgcctttctttcactttataaaaaacaatgagaacggatgttgtggaaatagtttgtaaatattgtaagaggataccttgtggaactgtcgtcttgagtgtggacattttgatgaggtggataactctgagaatagcaatgaagaaaaatcccttacccttataaaactgttgaaggtcaatttttttttttaagtataattgttcagagaacatcccaaaggtgaaattcttgttatgattgcagagtgaaattcgttccatctccgtaaaccagtggggctctcaattgggtctgagtgttttgagcaagctgagccagttatactgttccctggtgtgggaaagcactgtcctcctctctctgtgtaccccaaacaggtaagagaatggctctctctcttattactttgttatctaagttcggtgagcctggaggattgctttggttggggataggagggtatggaagagagttcagaggcctccttgtccttccctcttcccagcctaggaacttgatgacaaatgctttgtcgtcatggtagatgtttaaaatgtgttcctgttattagccagatacaaaaaattgagttgtggctggacacggtggctcacgcctgtaatctcagcactttgggaggccaaggtaggcaaatcaagaggtcaggtgttcgagaccagcctggccaacatggtgaaaccccatctctactaaaaatacaaaaaattagctgggcgtaatggcgggcgcctgtaatcccagctatttgggaggctgaggcaggagaattgcttgaaccccggaggtggaggttgcagtgagcccaagatcatgccactgcactccagcccaggcgaaagagtgagactgggtctccaaaaaaaaaaaaagaaaaaaaaaagaattggaaagcttgtggggtgctacctcaggaattatagatgctttattacattcagtttaacctgcctgctataggagggatagtgtcagccaagcaaattagagaccatttacaatataagaggtgaattatcagtatatatatatatatatttcttttgctcagcatttctctttttgcagcctaccatctgggtgtgaatttggccaggcagatatgcagaaactggttccaaaggatgagaaggcaggtacgacccagggcggaaaaagatcaggtaactctaagaaactaaaatgttagtcattacttctaagttttgttcctacgtctttataggtttattatgaaaatttttagttagttctatcatccatagtctagttttcatcctctcactaatttttagtcatttcttccataaaaacatatatacataatggtaaaatttagaaaatgtagttgaaagaattacccgtatttctgccaccaaaaaaaaaaaaaaaacattttggaagtgtctgcccgtcttttttctctgaatacatttgccagtgtcttagataaaaacatttcgtagatctctttcttcacttaatgttaggtaccatataaaggtacacgaattaactattccctgttaagtttctaatatgctatttttaaaaaatgaacatttttgtatctacttttctacaaatgtaaaattgattcctagaaattactgtatcagagggtattaacaaatactttttaatgtggctactagaaaatttaaattatatatgtgtttcatgttatatttctatcgacagtgctgttttataaagaagattgcttttatattatctcatgataaaaattccaaattttggccgggctcggtggctcacgcctgtaatcctagcactttgggaggctgaggcgggtggatcacctgaggtcaggagttcagaccagcctgacgaacatggagaaaccctgtctctactgaaaacacaaaaaattagccgggcgtggtggcacatacctataatcccagctactcgggaggctgaggcaggagaatcgcttgaacctgggaggtggaggttgcagtgagccgaaatcgcgccattgcactccagcctgggcaacaagagcgaaacaccgcctcaggaaaaaaaaaaaaaaaaattccaaatttcagtaagtagaaatcatacacaattttctgactctaatgctacaaacctaaaatgaatacaagcaacttttccagaatgttttttctctggtgttcagtatcaatgaggaaataaaaaaggataaactattaagaaagcaatgaagataattctgtgtataaaaatgcatcaggccaggcacagtggctcacgtctctaatcccaacactttgggaggctgaggcaggtgaatcgtttgagcccaggagttcgagacccgcttgggcaacatgacgaaactctatctctacaaaaaaaatacaaaaattagccggccatggtggtacatgcctgtagtcccagctactagggaggctgaggtgggaggatcgcttgagcccaggaagttgaggctatggtgagccatgagtatacccctgcactcaagcctagatgacagagcgagaccctgtctccaaaaaaaaaaaaaggtatcaggcttaaaacttgtacagaaattactagaaagggaaatttctaaggaactaataaagctgacataggcttagaaccaacaaacaaggacttacatatgacagctggttattgtgagggatgggataacattaataaactataaagaaacctgacaaaatgagaatttcaaatttagtcaaaacatactaaatttaactcagggaaagaataaattgactaagaactgagaatgaaattagattcactgtcaaagaattgcctctctaacagatatattttttctagcaatttaacacatttaacaaaaacgactcagcttctccacagtttttctggaatgttaagagaacaacttggtgacttgttttataagtttgcataaagctcattcttagatctaagagcaagcatataccaaagaaaaagacacatgtcacattcatatacataattcttaaatgctaggaaataaaattgtccagtggtaatctgtgatgtctagtttgaacttaacaagctataacattctagtagggcatccacattgacagcattgggtactgtgcacactgtagtccatgtgaatggtaccccctgggttgggctgtgcctacaacagtcttccaaggtagccctgggttaatactattcatatgctgtcatttgaagatgtcagcattaggtacttagaactccagaggagcatatcagtaaaatatttgggtcgtgtttttgtttttcaaatttaggaagccatgggaattgaaagagtaacaaaaaccataggtaatcttgtcagtacttctcaaggaaccaggtaaatgttggctctacattgtcctattgctcccctcttatacatctgtagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcaggtgagtcattctcctttctcctaccttttctggctttcagtcccttagtcttgaaacagattgagttggaaaggctatgttgtttcacctaaggaagtttaaaacttctgtgactcatttttaagtgtcctttgttgagtggctgctatgtgacaggctttgtactagctgctacggatacagacatgacagaatcccttcctgagagccatatctactaccctcccttctttaatttcttcctcctacttactcttcaactattgcatattgttgctgctccttccatttcactgagatgtctcagcaaggcatctacaacgtccttgtcctaagtcccttctcacttgtctgcagcatggtagttgacccaccatctccatctagaaatattcttcctttggtgcttgtgttattaagctatcttgattctcggataactatctggctcttccacctagtcttctctttttgtgttccttgaacataactggcaagagacatagtctgataggtgttttatattaaagtcactttggcagctttattgagactgtattggcagcatacaaaactgcattaatgatttgcactggtctgtttgcccttttttttcccctttaatgtaataccaatgtttgggaacctatttgtgtgttcgtaaattgtcgtcactttctggcaccttaatatagaggaaaatggagacctaacttagaggaatctggggcccttcgtaaaagcaaacagaaaatggcctttggtgtttccatttgttacctcaaattcccattgcattttacattttacttttaattagtttaattctccatttattttaatttgaaagtctaccaacattaccttcaaaggaaaattgaccaagcaagaagatgttcatatttctctctccttgctttgtcatatttctttgatcttggagcattcagaggtttctgtgtgaacccagtccatatactgtttctctttggttactggccttttgccatcctcttgtctttggactacctttaagcactttgctatctgttcacctgaaagcagtggtgagaaagtgtaaacccaatgattggattcattaggttttcaaagtctgggtatacccatatctgtagactattccctaattaggataaagaaatcttaatttggatgtaataggaagaagaaaggactgttttccttgttcctatactgtatacatttgagcttattactaaattttagcaggatatgtaacctaggctcaagtagagcctatttttacacactgagtttatatgtgcatgtatatcctgaaaagacatagatttaacccttgagcaacatgggggttgaggcaactcctccacacagtcagaaatccatgtataacgtttgactccccaaaaacttaactactaatagctatctattgaccagaagccttaccagtaacataaacagtcgatggacacacgttttgtatatgtattatatcctgtattcttaaagtaagctagataaaggaaaatgttaaaatcttcagagaaaaatatatttactattcattaagaggatcatcatagaggtcttcatctgggtggtcttcacattgagtagctgaggaggaggaaggaagtggggggatgttggtcttgctgtctctgagatagcagaggcagaacaggtcaaggaggtagaaggaaaggcaggtatgcatggtgtaactttgtggaaatacacagtactttctttctgacttggttgctttttcatttctctaaaaatgtgtctgtacaataccaatttttcttccaccgtttgctttagtttcggtgcccatatcatagtaaggtccacatcataaaaagtcaaaagtattctttagtaatcagaaccctctgccagattgtcttatgtcactttggttcctggcactgcttctacatcttcttcctcatcatctggtatcggttcagaagcactcatctctatcaagacgtcttctgttacttgctctggtgtggtgtttattagctcttgaatttcactgagattcatatcctgaaattcttcacccatgaccttttttttgctatatccacaaactcgtgatttccttgattggcgctgtcataaatcctgttaagttctgcacaatatcaggacagttttctccaacaggaatttatttcaggcttgatggctttttctgtgacaatgatggcatcttcagtggtgtaatccttccagactttcgtgatgttccctctgtcagggttctcttccacagcattaacaatcctttccttagagtactgtgtgtaatagccttaaagccccttatgactctctgatctagaggctgaattagagatgtggttttggggggcaagtagaccacttcagtgccttttgtgttgaattcatggggctctgggtcaccagaggcattgtctaatgtcaaaagaactttaaaaggcactcccttactagcaaggtacttctgacttcagagacaaaacatcaatggaaccaatccagaaaaggggtcttgttgcccaggccttcttgtacaaccaaaagaccagcagctggtagtttatctttctccttcaaggctcggaagttaggagctatataggtaagggcagtcctgattataaacccagtagcatttgcacaaaatagaggagtgagtctgtcccttcctgccttaaatccttctgctcacttctattccttactaataaacgtcctttgtggcctttttttttttttccttcaaagtagggcacttttgtctgtatgaaaaaccctttcaggcagataccctttctcaatgatgttcttagtggtgtctgggaacttatctgttgcctgttggttggttgtcagaagctgcttctcctattatcttgacattctttaagccaaatctctttctaaaattatcaaattatcctttactggctttacattctccagctttagatccttcactttccttttgctttaagttttcatatagtgagttcattattttcttgaattgcattagaatctatagatttgtctttattatggcaatcctgtacccacataaacgtgcattttcaatatgaaataaaaagatttcacaaaagtgcaaggttttcaagcctgctggtgtagctgcagcaacagcttcactaatttccttttgtttgttttacaatggtctttacactgaattcatttttcctgaagtggtgggcaatctgcaatccatatcaaataattcaactttttcttgaagtgtcatgacttttccctgcttcttgggagcacttccaacgtcactagtgacacttcatatggggtcatagagtgacccaggtttattccaggttttcagtattgcggtaaacatgaaaaacaatgcgagaaccatgagagatcactacacaatttactggagagatgaactgttcatgtagaagtgcttagcctcacacagtgttttaagcagattgtggcaacacttgagctcaccacagtatcagcaggtcgtggctacaaaattattacagagtataatatgtactaaattttatccagttactcaatactgcttatttactgcaaatggcaccgtgtataagtgtatgtgcataagtgtgataaatattaaatttttataatttgtgtatattttatggtagtaaatgataaaatagactagtatctacatatattttatgcgtttatgacatacctaactttttgttaatttttcaatattttgaggctacatgtttcatctgagagttttttcaaattgtcaccaatctccaaaattttcagtatatctattgaaaaaaaattcacacataagtaggcatctatagttgaaaacctgtgttgatcaagcgtcagctgtactttgattcagacctagcccttcttgtctctggatcatgaaataacgtttcatgaaaaaacgtgaaataacgtttatttttaaaatgctatggcaacattttcatttatgattttaaaagtatatttcattgtagaaatataaaaacacatgaaatatttaaagagaagctggaaagcactcagttttttgtgttttcttttacatatgtttatatttgtatgctgccttttccttgttgaattatatattgaaaagcatcctatgaaatggaaaatttgagatgtccataatctgcccaattccttaagaagctacttgtaaaaattttcctgcttttcctagtttattttttcctctgggactacatattttttgttgtgatcagactatgtatattgtcagtgatcttttcttatctaagtggctaatcatttttggcattttaaaagttttctgtaggcattttaagtgactttatcatccactagatatcatttaacttaaatatggtttcaatttatgttcctctagcagtatgagtgcttatttgtcttttacatttggtatctgttgagtgccacatatctgtctcctaccgtcaaaagtggcatttgttccttgtgggacttcctttttggattattgaatgtagaacaaatccaagtgttaactaggggttgtaggaggaagtggtgagtcataaaaatatgttaatggtaatatgtctgttgtaattaaaccattctgagaatactgtacagtcttattctgatttctgggtttcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggtgaagttcagcttgagattcagggactagaaagttacaataaaaaatatgtaagttgttcctatactacttaaaatggagtgtgagccactgaatttgagaatttggaggtcccttgtttactctagaaaatgaagtgtaagttacttgttttggttgtacctagtacagaacatgggtaatattttaagtatttacagtcaaactgcatttcagtggtcttatataggtagtatcccttatccaaaatgcttggggccagaaagtgttttgaattttggaattttttgggttttggaatatttgcggaatacttatcagttgagcatctctaatctgaaatgctcccatgaacatgtactttgagcgtcacgtcagcaatcagaagtttcagattttggaacattttgaattttctgatagggatactcatcctgtattctttagtaggtgggaggtgtcacttcagtgtgtaaattttactcttgccttttacatgaatttcctattgcttctgtctctgctttacagaaggttaaagttttgcctttttttccactttcaggctgacattcttcatctgttcagttggtttcacatccccaatgctgtttgatgagaggaagtatccctaccacctcatgctgcaaaaatttctctgctccggaggccacaatgctctttttgagtaaggatcaagttgcttcacagaggagcatttcttggagtttgatctttgctgtgtgccttcccagcccactgcttttaagtaccctatcttgtaacagtgggatatatagaaatagctattggttgtatccttcagtgttctgggaagtaaccatgtttgtctccatttaccttggagggtaggatttagcctcccctagagttgtgtttgtaagggtctctgctttttctcatgtggcttccagttccaagtatgggtttttaaaataggtttgtctttttctgttgtttctctgaatataatttttctgctattcttggtcagatgatttcaagatgagtttcactggtttaggtttttttgtgttttttttgttttgttttgttttttgttttttttgagatggagtctggctctgtcgcccaggctggagtgcagtggcgcaaactcaactcactgcaaggtccgcctcccgggttcatgccattctcctgtctcagcctcccgagtagctgggactacaggcgcccgccaccacgtccagctaatttttgtatatttagtagagacgaggtttcactgtgttagccaggatggtctcgatctcctgacttcgtgatccacccgcctcagcctcccaaagtgctgggattacaggcgtgagccaccgcgcccagctggtttaggtttttaagactctaaaaagtaacggaggagaggcggaacaaaagaaaaaaatagtatagctgaaaactgttggacagattagacgtaatagctctaagaagagggacgtgtagggccaatatagagattggggaccttttagatgtaaaccccccttgccagggtaaaatactaatattctgtctacttttccttatttgaatttagaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagtgagtattcagtattctaaaatcaaaaggaatttctcatgctaagtcgttcccactctattttgtcctgcttaatgaaataacatgcttatttaagaaccactggatccaactcccagatagggctgccttacgtaagggaatatagaccatttgagaattttccgtgataaacatttgagctgtaaatttcagattggtacttgcattaggccgttcttgcattgctataaagaaatacctgagactgggtaatttataaagaaaagatatttaagtggcccacagttctgcaagctttggaagcatggtgctagcatctgctgggcttctagggaggcctcaggaagttcacagtcatggcggaaggttaagtgggagcttgcatgtcacatggcaggagccaggaggtggagggggtggtacacactaactcactatcatgaagacaacactaaacaatgagggatccacccccatgacccaaacacctccagcattggggattacaattcagcatgagatttgggcagagcaaatattccaaactgtatcactgcttaaggttgagtaaaatgcctcttctctgtgcctccttagacctcctcatgttggccaattattttgttgctggtactagttgtggaaggactgttccataggtctttaacttaatccttctgagctttgaattgaagcaaaatgattttcacacacttttcaaattacttacaggcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacaggtagggtactggcctcacactccagggtccagactttgcacccaatggagtgtgatgcttacggattttctaagctcacataccactgagtccctggtcacattaaccaggagacagtttagatttcctccttctcttagtatttattttttttctcctgaggaaaactggagtatagtcctgatgctctgcacaggtaatactcctttcaagcatgttgatgagtattctcagtagcctcctgctgcctcagtggaggcaaactgtcctcagttactttctggttaacctgtaaagagaatggatattgtgaaccagatttattctccaacaagagctttctgaaaccttagtcacctacaaaacttttgttttcacttgcaaataaaatgtataaggggcattttaaaaattgggaggccagaaagaggagaggggaaaggcatgtaaagtcctgccacttccatctcaaagagcattttaagattttcttcctggagtttgtatgtatgtgtgtcagcttttatgtctggagtcctgttcaaatctgtctactatatacacttgtcccgttttttatcattaaagtaataaatactctcattaccaaatttggaaaatacaagacttttaaaaggcattcgtaattttatcacacaagatagtcattgtctcctttttcagtcagtcttgtgcctaatttttacgtcgttaacatcaaataatacatatacttgtattgctgttatcaagaacttttttttactaattggtcattcttttattgttggatgctaattttcttacagtttgatgttttaacactgtgttgtatagtttccttacgtaccaatccttacatacatctcatgattattgcctggtagtagattaactaggtcagtttttcaggcacttgctctgttaccagtttgttttccagaaagttgggaccaatttatacttctttgtatgagtctcaatcttttaattataataaccctgttaatcataataaccatgcatccccccctaactttcttagaggatgaaatcgagaatcttcttggctccttacccaatgtgtagcttagaatgctatagaagcaccaaacagaaaggattgttcattttacctaattgccctagctcataaatgctctcagcccagatgaagttagaaaaagttatttccatcttgaaaaggttccttccttttaaaaatgtatttggatttccgttatgtgattctgagcccttgcattctttatgtagctcatggacatgggcttcacaagggaacatgcaatggaggcactgttgaacaccagcaccatggagcaggccacagagtaccttttaacccaccctcctccaatcatgggaggagttgttcgggtaagttggctcagaagcagtgattttccaggatattggtttgactgctgaagtcctttttccccttattattctgtcattggtcttcctttctataaactgcttctcattttcagacatgtccatgccagtattttcttttcataataacagaagttttctgtcccccagcaatacaaattactatactttgtttgcacaagaacccccagtcacaaaacaatagaagaggcacacttttctaagatgtagaatagatgatcacactgtaagcctccttcctatacttagttttacgtgtgattttcctcatctgttcttgtttgtagtaaccacataagcctgatagggtttgacttatacaagagcagcattttgaggcccttcctctctctttagcttgagcacaagatgtctgattgcctgtgagttgcagtggtcttgttgggtttctttgttttgagtgtgtatccttactggatattctcttaacactctaggatctcagcatgtctgaagaggaccagatgatgagagcaattgctatgtctctgggacaggatattccaatggatcaaagggcagagtcacctgaggtaactatggaacactgcatcctaaagggcttggcacatgaatcttagtattctgtgaacattctgctagtattgcaaactaattgatagaattcaaatctaaaggaagacatgagaagagtactaattcatcccagctttgccatccattattgagctaccttgtattgacctgaagctttaagggaggcatatgaagcgttaatctttattgtcaaataagagacccaatgtgtactcagtagtgccattaggccgaacttggctgtatatttctaggtgacagttactttaattttccctgctggcacagaatatagaacagtgtctagaaatgattttgcgggaggtagtatagaatgctacaagtgacttgacagtgaaagttgtttgaagcatccctcccttctaccttccctgtcttgccttaaactttgtggctgccacatcctggatgaaagtatcaaccgcttgaggagaaggttgagggtaatcatatggtagagcaaaaacattctcagagtctctcttatctttcctccttcacctctcctgtgtattattcacacttccttccctgcttccaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgagctctcaaggggtcagaagaggggagtatgtgaagtggtttgcctgcctgtgtcaaaacctgatttctgaaaaatcagcatattttcattctacctgatatgggtatattctctatttggattctttcgatctggtaatcctgaaacagtgtgttaactacatcgcacacacaaaaatgtctttagaagggaaaaacaaagctctccttttctacttttctcttaaaatgtctaaaatgtgcctcacccttgagtcaggttcgtcccctggactaatactgaataaatgttttttcctatgtaacagccgcttgaacaactgagtccccatcctgatgaatacttgtgacctgatatttgtcctctttttcttttctctcattatgaaattatgctaattatagaagtgggataagaaaggaattaccttaaatccccacacccagatagccagttaacatttcgattgtatttaagttactggaatcttgttttatgtaatgtttcattctagaagcagggaaagaaattaaaaaagggaaaacttttttctgggctttgtaaaatagaactttaatgcacaagaacacaagtaaaggaaaactggataaaacattttttcacagaaagttttagtgtctattttttaacaataattctgagagagagagataaaatgaaagattgctgatggaagtataagttgatagaacctttttggggttgactgtatgcaccaggaagttttaaaatactcatttcctttaacttagattttaggctgcttatagtctagcctaataaagtaattgtttagtggtgatcctttagtagcatacatcttttgatatagattctaaatccctatggtaaatatgttagatttacctacctttctttagtgaatgtgttggaggcagagggagtattttaaaaggttgagaatattttcagaaacctcatcttgctctgcggttccgtgacttaaccctttttttgcttttctaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggtaagatttagatctttggggccttgtaattcattcatgaaagaattatcaaacacttaacatatatgaggcattgaagacgataaagcgaagaataaggcatgagtcctgcatttcatgagcccagtttctgataggctgaaatgcatataattacgtataaaatacagcattctgtgttagaatgataacagttttatctgggtttaggaaagtcatatgcatcactttggattcatgtgagaagggcttctgagaacaagcattaattgaattgagtcagaattgtgaggtggtagtttaaaaaaaaagtatttaaattactaacagagcttggtcatagaatattttttgctcttctgaggaaacctaactggcagccacatagtagagtagggtatgcaaattggatgtggtcaatattgaggtaatagacattagatgaaatcagattcctctctcttttccttgcctatttagtcagcagattatttgaggcaagagagtggtttgggcaagacctgatccaaccaacgtaggaactaggaggcaattgaccttggacaaatgacttcatttgtggctcattatctttaaaacctgaacttaatgaactgaaccctttacatacagcaaactcaggggataaatccaatataagagtcaaactgtgtaacagctgtcttgggggtttcctttatcatggaagtgataactcttactgtagcactttgtaaatagatacttgtgggaaaggtttcagagtactaaagagagaatcattcatggacccccatctaaaacaaatcacaagtaacagtcttgtattttcttttagtgttttttcctgttcatttaagcaattgggataagactgtatagaaagttttatattctttttgttaagtattatgactattttcccatttgctatatacattagtccatcttttgaatgttctctaatttatttaaataattacctatccttggacatttacttccagtgatttcctgttaaaagtaacactttggtgtagccccagtaagacgaaccattaactgtgtttaattattccattttccttgaaagattataaaatttctctgtaaatctaaagctttacaacttcaacatagactgcacaaccttggtgataaaccatttccatattaagcatatacattagtgccaggcactgggtactttatattaatatatataaaacctcaatcatcacaattattctgcaggtaaaaattatttcctctgacccatgaggaaaccaaagcctagaaaatttaacacatcttagattacacaactggtaaatggtaagaggtaaaatttgaactcaaccaattctattattatttacccttatgttcccctcccctatcccatgctaatctttgttactgagtagaaattggtatctggttgttgttgttttttccctttgatctatcaggagttgaagctaccttgtgcttgggtggttgaatcaagtggcatccttaatgtcctaatcaaactcttggaagtggttcagccctgcctccaggcagccaaggagcagaaggaagtccagaccccaaagtgagtaaccctatatctaccctagtttcgtttctatttccctgggacatgggcctgaatcaggcactcttctggggcatgtatggggcaaatttgtggtacttctgtagttttaaaattataaaggaagcatctgatgaaattaagatatattttcccaatttgtgcaggtttcttgctttcccaaaacagatcatttttcttttttaggtggatcacaccagtgttgctcctgattgatttctatgaaaagacagccatctcctcaaaaaggagagcccagatgactaaggtgtgtaatgtagtatgtatgactgcaggacggtttagcttcctgaggcaagagtagaccagaagagaatatgagagagtagtgaagaatatagaagtctctgaccaatgtataaatctcttaagggattttcatagctaggtttctcttctgaataatttactctggaagtaaattttgaaggagtgtgctatctccagaggaggagcggcttttctgttatgtaagggactgagtatacagcaatcctaccaaaaagcaaacactccttagatgaagattattgtgccacatcatctcactaccttcttggaaacagaatttttgtttcagtacatctcaggtgaacattccccttttagggaaaatcagtagaaacaaaaggaaagtagaaaatggcaagataaggggctgtagatagtttttttgtctaggaaaagtatcttagtccgttttgctgttgctataacgtaataccacggactaatttataaaccataggctgggcactgtaggctcacgtctgtaatcccagcactttgggaggctgagacaggtagattacttgagttcaggagttcaagaccagcttgggcaacacatggtgaaaccccatctctccaaaaaatacaaaaattaaccaggcatagtggtgtgtgcctatggtcccagctactcaggtggctgaggtggggagatcacttgagcctgggaggcagaggttgcagtgaaccgagccggcatcgcgtcactgcactccagcctaggtgacagagtcagaccctgtctccaaaaaaaatatttaatataaactgtacaagtttatttggctcatagttctagaggctgatctaagggaccacatctggtgacagccttagtgctgcatccttctattgcagaaggtggaagagcaagaggtgtccaaactcgcttttataaccaacccagtcacaataactaacccagtccgtggataatgacattaatccattcatgaggggcggagtccccatgacctaatattatcttttattaggccccacctcccagcactgttaaattagggattaagttttcaacacctgaactttagaagacatgtttttaagcgtgtagcagagagactaaggaatgtgagagtaaatgcatatgaaaaatgttcttttggtttttaaaatttattgtccagtatatttctttttcctgggtgagttttagcagtgaacactgatgaagttactatttcttctaatcaaccttgaaagaaatacaaagaaactttgtacttttatgtttagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcaggtacatgctcactcaccaagcttgtctaacccgtggaccacaggccacatatggctcaggatgtctttgaatgcagcccaacaccacacattgaggtttttttgtcgttgttctttttagcttatcaaatatcgttagtgtagtttatgtgtggcccaagacaattcttcttccagtgtggtccagggaagccaaaagattggacacccctactgtaaactttatcaaaaagaggggtatgtgttttggttttcttctttctgaaccagcattcctaacgtgttaggaggaggagagttaccattacctaattaagtatagatttcagaaaatcgagtcttcctaaggtcattgattagaccttgggtctgtagcaatttgatactatccctcttagaaatgattttaagtgtttagtcaagggctagggagtggttagggatggtatttgctctgttggaaggtctacagttcattataaggccttgtgtatgccacttgccttctggggactttcaggttttttctctgtaaatgataaaggtgggataaattgccagagttccttcctgttgtagcattttacctgggagatgtccctcccctcccccacctttataattcatttttggtagaggtttttttaatgtctgtttgaattcctaggttaatgaggaaacagggaaccgacgccctgtgatgctgactctcctcagggtacctcggctgaataaaaattcaaaaaacagcaatggacaggaactagagaagacgctggaagaaagcaaagaaatggatatcaaacgtaaagaaaataaaggcaatggtatgtaccaagagtgttttacctaaagctaatgtgcctttgtggcttaaggtctggccaatttcattgtgagttattttcatcagcttgattaacagattaaagatacgtaggcctcccttatgctttttcatctgatcttaaaattggtatttggcatgcttctcttaataggacccaagtgcttggccaattacttaggagggaggcgtgggaggaaataaacatcaagttaaactgtctaaaactgttattttcccattttatagatacccctttggccctagagagtacaaacactgaaaaggagacaagcctggaggaaacaaaaatcggggagatcctgatccagggcttgacagaagatatggtgactgttttaatccgggcctgcgtgagcatgctgggagtccctgtggacccagatactttgcatgccacccttcgtctctgtctgaggctcacccgggaccacaaatatgccatgatgtttgcagaactgaagagtacccgcatgatcttgaatttgacccagagctcaggcttcaatgggtttactcccctggtcacccttctcttaagacacatcattgaggacccctgtacccttcgtcataccatggaaaaggtgagtgtgttttgtatcagattctggtttagctttacatcatacctatgttctccttggtctgagaacaaatagacttctggttcttcttagggtatatagctagatatgtatactgtatactccacccaacagaattttccaactctatgcttgggagcttgcttaggtatggtaggatgatcctattgctagaaagtcctctccagcaatctggttttcttttttttctttttttctttttttttttttaatctaggtttcattaaccaagccaaaaaccgttagtaaagaactgggataccttcccccaagttcataccttcagaatcattcctttgtaggagtacctctcgggtgttcagccaagagactattctcaaaacactgtattttggaatataaaagtatagttaaagctttttgaatgtttgtaatctgccaggcactgtgatagacacttaacaaatatccattgtgcagatcagaaaacaggttattatattttaggaaacttacaaaccagtggaagaaatagcaacgtacttataaaaaataaaaacatttgtaaagttaagacaatagtctgggtgtggtggctcatgcctctaatcccagcactttgggaggcaggtaaatcacctgaggttagaagttcaagactaggtgggtgtggtggcatgcacctgtaatcccagctacttgggaggcagaggttgcagtgagccgagatggtgccattgctccccagcctgggtgacagagcgagactctgtctcaaaagaaaaaaaaaaagaagacaacagtggagggttgaggggcaaatgtcctagtagtgaggcttttcctcctcagtacttaatacaaaatcctttcttctgctgattctttgtcatcaataatgactgttaatagactttgcttccgttttcctctcttgggacattgtttcccacatttataagcagtgttgcaatatgcgtttttgtgcctaactttgttcatgtttaagatcgttacttagagatttttagtaattggatcaaaaggcattacaagtattttttaacttgcttgccagaaaagtggtatcagtttttgtatatctgagtatacattttagattcttcagacagttctttacacagcctgcttgatttcacctcacatgtgccaaatcaagagaaagagagctgttaaaggtagcttgtatggtgatccacagtccaggagataacccagcagggaaggaacaactatatacaactaaattctgattttagaaacttgaaatgcttgaaacgctttctataaagaaatgtttaaaagttacaagttcaaagtgctaggagaaagtgtaggtcctcattggatgagggaaaacttttaaagttttaactttaggtaaattatagttggggtgtgggaaacaaaggaacatcagtgacagtcttaacgtatcaagatggcaaaatgtaaagtcttggtactattcattgctagtacaggtgtggaaaaccaggcatactcttaactttcggtaggagtggaaattggtgtagccacatgggagggcaatttggtactcttggtctaagatatcctttgacctagaaattctatggctaagaatttatctgataactaacatcaagtataccaagatgcatatataagagtgttcactgtggaattgcttgtaatatcaagaaactagaggtctaatgtccagcagttgggggctggataaattatggcttatccttaatattgaaattaaacttttctgtgtttattaaatggaaattattttataattacagccagacaggcaagatacagagggtataatgtgctaaagggcatgattgatttggtttaaaaaaaaaaaattaagataccaaaagatgtttttcattgtgagcatgtagtttgtgaaataacagataatggaaaataatacaattgagttattttcttcgtgctttcatggatttttccattattaacaagcaattttatgagaagagcagaagcatagctatatgtaagccctgtgttatcaaggcaaacaatatataaatagttcagtatctccagtggctatcattatctcagactgatggttgactttgaggcataaagaaaatatttaattgtgttcctgtacactaagtggattacagtgttacatgtttttgaaccattctggtttaaaattgtgacagcatttggagaggctcaggagctgacattttaatgtggaagttatgtggggtttatagtcttgacacatctcccagtttctataaagatcacatgcagtctggtctaataattgatagttttgagacatgctgcaacttttttataagccaggttttttgaatcaagaagggatgggacgggacttaaaaataaaatgtcattctccccaaaatcaaaagcttttagtcttggtaactcttgactgcagttgtatttttagaaagtagtgtttaatcgacagtgtttctttctctctttactaggttgttcgctcagcagctacaagtggagctggtagcactacctctggtgttgtgtctggcagcctcggctctcgggagatcaactacatccttcgtgtccttgggccagccgcatgccgcaatccagacatattcacagaagtggccaactgctgtatccgcatcgcccttcctgcccctcgaggctcaggaactggtaagtttcgcttgctcctggcctttgatattaagtttgtggcctggtataaatccagaaatttatttatgaggaggtctgtaacttgaagagcctccttaggcaagtattaggacatttgctggctaattgattgtttgggtcaatttattaggtacttcagtagcttctctgggccttgccctgttgtaatccctgccagagacactgaggactcattcattctagtccttcacttcaaagagctcattttggtggggcagtaggctttacatatagttaatggtttacaaatcaagtgataattaagggttaaatggatgtatgtctcgtgtaacacagtgcgaaatagacgtcatctgtgtattcctgccaagaaatgtttgacctgtatttaattatgaggaaacaattagataaatacaaattgtgagatgttctatataagacaactggcctagactcttcaaaaatattaatgttatgaaagaaaaaatacaggatcatttcttatagagaaaagtagactagagagataatcaccaccagccttggttgggctgtggatccagataaaagatttggagaaatttgagtgctatgtattaggtaatgtaattgtatctgttaaatttggggggtattataatggtattgcagttctgtataaaaatacccttgatctcccctctgctgacttttttggtaataaaaaagaaaatatatgtccttgatcttaggagctacaagtagatgtatttaggagtagtcacttggtaattctggatgaaaagtatatagatgtttattatactattcgaacttttctgtaggtttgttggatttgtttttttattttattttttttttttaattttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttccatccacacagacccggcaaccatccgatttctcaatttcttccccacccttcccgcctttctattccacaaaaccgccattgtcatcatggcccatccccaatgagccactgggcacacctcccagacggggtcgtggccgggcagaggggctccccacttcccagtaggggcggccgggcagaagtgcccctcacctcccggatggggcggctggccgggcggggggctgacccccccaccaccctcccggacggggcggctggccaggcagaggggctcctcacttcccagtaggggcggccgggcagaggcgcccctcacctcctggatagggcggctggccgggcgggggctgaccccccccacctccctcccggacggggcggctggccgggcagaggggtcctcacttcccagtaggggcggccgggcagaggcgcccctcacctcccagacggggcggctggccgggcggagggctgacccccccacctccctcccggacggggcggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgaccccccacctccctcccggactgggcggctggccgggcggggggctgacccccccccacctccctcccagacggggcggctggccgggcagaggggtcctcacttcccagtaggggcggccgggcagaggcgcccctcacctcccggacggggcggctggccaggcggggggctgatccccccacctccctcccggatggggcggctggccgggcggggggctgactcccccacctccctcccggacggggcggctggccgggcagggggctgaccccccctcccccctcccggacggggcggctggccgggcggggggctgaccccccacctccctcccggactgggcggctggccgggccgggggctgacccccccacctccctcctggacggggcgactggccgggcagaggggctcctcacttcccagtaggggcggccgggcagaggagcccctcacctcccggacggggcggctggccgggcggggggctgacccccccccacctccctcccagacggggtggctgccgggcggagacgctcctcacttcccagacggggtggctgccggacggaggggctcctcacttctcagacggggcggcggccgggcagagacgctcctcacctcccagacagggttgcggcccagcagaggcgctcctcacatcccagacagggcggcggggcagaggtgctccccacatctcagacgatgggcggccgggcagagatgctcctcacttcctagatgggatggcggcggggaagaggcgctcctcccttcctagatgggatggcggccgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcgcctcgggaggccgaggctggcggatcactcgcggttaggagctggagaccagcccggccaacacagcaaaaccccgtctccaccaaaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccatggaaggagaccgtggggagagggagggagagggagagggagagggagaggagggagaggagggagagggagtttttttttttttttttttaataaaacgttgggaaggggatgaaattattttggaagttccagctatgtgcctgcccctgtgctgggcatttctcagttatatcctcatttaatcctcaacataaatttggagagtgagaaaattgaggtttgttgaattaacaactggatttcaaaaccagttttctctaactcaagcctttactatttggtactgctatattaaatcctgtggaatttaaggaaagtataaaccaggttttatagtagagtacttgaacattaattgaaaatggtctcctatctcaagccttctatatcatacatgcccccttctgagtctttattagtaacctagtttaggtactgcttcatgattgactggtttttctctctcattttggcttagcttcagatgatgaatttgagaatcttagaattaaaggccctaatgctgtacagctggtgaagaccacccctttgaagccctcacctctgcctgtcatccctgatactatcaaggaagtgatctatgatatgctgaatgctctggctgcataccatgctccagaggaaggtatgtggctagcctacctcaggaggctgggcactagaggatatgttactttgcctgggtcatttcagccaactcatggcttagtgagcactcactatgtgcccatactctggggctcaagatgaataagatacccattgcatgtctgtgaagaagctaatagtcatatagtatgacataccaggatggtggtaagtccttagggtgaggcaccttacctagtgagggtgcacaggtaagaaaatttctttgtgtacatgatttctaaaatgaaccttgaatggatgagattgccagagttctgttatatgagaatacacaccatacgggggaagaatgaacaaagatttagaaggagataatagcattctgtgagaggttgaaaataagacaccaggaagtctctaatgttttcatactcaagcaaaacctttttattgtctgaagagctggaggcaatattaggaggtgtgtctgagtttcctaactgttgagaccaccacacccatccacctttattcctagttaaggtgcatcttataagcattaggaaagtcatgattgatttgcttggaacataggtttccattatagtaaggtccttctggattttattcaggacatacttatttgataggtccacagaattgccaaaaattgatgaatgctgcctttaataagcaaaagaaatctgagtcttgaccttggtgcttttcatctgtacagaaccctgatccatatagaattccttggttctcctatcaccccagaatctttaccctatctcttatcacctccccgaaatagtttagctatatagctgtggcaaccatttattgacccaccactgcatgagcaatagtgccaggtatgttcacttaaggtttgtagttacagcttaggaaagtgagactaagttaattgcctgtggtcacaagactagtttttgtaattttagggtgaggcactctaacattatctgtaatagcaccatgtaaacagtcatagccacttgatgtgaaattgaccaagactgactagataggccttaacattgtccaattgtagaagaggtttattttgtttttgatggttgttactgttttcctagcagataaatctgatcctaaacctggggttatgacccaagaggttggccagctcctgcaagacatgggtgatgatgtataccagcagtaccggtcacttacgcgtcagagcagtgactttgatacgcagtcaggtttttccattaatgtaagtcaattccaacagcgttttatctttcttctcatttttcaatgcctgtgtggtctcagtatttagggctatccccggggaatttcaaagatattaattgtgatgtatctgtaaattatctgttgcctgtaaagacaaaattggggtgtccctggagacttttttttctctcctaggattagaactgttctttaattttttttcttttccctttccttccccgcctcccccacagtctcccagtcactgtatttataatagcctcccacagattatagtataaaggtgtaaggtggttaaaaggttggccaaagagaatctgtggcattcccagccagtgccctgggaaggagttctgccatttgcagacgggtgcttttgaaattcataatagctcaggagttttcttcttcttcagagtcaggtctttgctgcagatggtgcctccactgagacttccgcatctgggacctcccaaggagagggtaatgatttgcttttctcactaccatgttcttattccttaggaaaacaacttgaaaaaactgtaggtgtcctgtgcagggggtaggagaatacagacttaattattacgtttactggtctaagtgaactttctcaggtgagctcagtgttctgtaataaagggtctctatatgctaaagttaatggaactgtaagttaaccaacctagtaatggttgctgtggtaacatattttagttttactttttaaatcacaccataattatttggggggtttctaaaaactggcttatagagattttatgccagtgatattgttctagctacatgctttacgtggtggatgcctgtcttccagcaatgttaacagagcccattgactactcaccatgaactagaaaaatgtccctgggagtaagtctaatgagacctttaaagagctgcttctccttagataggaaaggtctttgtgatccaatttaggagacattttgtttaaaatcatactagttcctggagataaatttaaaaggctaacattagtgaaataattggttaactcattttactgggtttactggccatatgtagtgtatagcgtggatgatggtgctgattcaagggaagcattacccactatgtggcagactatattggacaccaaaatggatcagatttgttccctgtacttaaagtactttgtccagtgactgagacctgcaagagttataatgcaggataactgccagaatgaaggcatacttggataagatataatggacatgtaaagtatctcacagtatgtctagatgagacaggaaagcatttatggaggaggtcagcatttgagctgaactagataaaagtgtgccaggcagacggaagaaagaagtaagggagcaagacaagtttgaagaactgttagtagagtgtttctggagtatgtaaaaggagggaaatggagggagatgcacaaatagttggacaaagcatccctgttgtactgtaaccacataaatctgagacctgagttatcctggttctctgctcttgcactgcagtgtcacgagagcattcagtttgtacaggtggcttaaagtggaggagaaatagcattcttttccacctaagacttgattttgccagtgttccagtgtggaattgaaccagtgtttgacttttctcaacagcttcaactccagaggagtctcgagatgggaagaaagataaagaaggggaccgggcctctgaggaaggcaaacagaaaggcaagggcagcaaacctttaatgcctacctccactatccttcgtcttctggcagagttggtgaggtcctatgttggtattgctaccctgattgccaactacagctacactgtgggccagtctgaactgatcaaagaggtaatatttccaacttctatttaagatgttacactgtacttccatcatttgggtaccgcctgtgtcagacactgctgggaagctgtgcatgctaagtgctaacccaagtaatgagtgagaagaggcatcttcagacatgcaaggccgggtgcggtggctcacgcctgtaatcccagcactttgggaggctgaagcaggcggatcacctgaggttaggagttcgagatcagcctggccaacatggcaaaaccccatctctactcaaaatacaaaaagaaattagccaggcgtggtggcgggcacctgtaattccagctattcgggaggctgaggcaagggaatcacttgaacccaggaggcagagattgcgggaatcacttgaacccaggaggcagagattgcgggaatcacttgaacccaggaggcaaagattgcagtgagccaagatcgcaccatcgtacacctgcctgggtgataagagcaaaactctgtctcaaaaaaaacctgaaagagctaggccttttttcattaggttcactgagagagagagttaatgagatttgttctattgaaagtccctttttatgcattgtggagattgaagagggaagactggagtcagagagaacagttaggaatctgatagagtaatctagtaacgtacgatcttggtgaagttggaggaaaatgggtgagttgaagaaatatttttaaggtacaaatggacaagaattgggtttggaagatgaaaaaggaaattaagactcaaggatgtttcttgatttgtgggggtttttttaattgcttttatgggttggcatctaacaagaaaatagaatggggtggggaaggtttgaagagaaaatgaggagttttgagaagtatctgtgggacatctaagtaaaagtgtctaaaggacagttgaataaaccatataaataagaatataggtgttcatcttccagatgtactcacacatgtgcaaagacaccagatgtggtagcagtattggtaataaaaataaaggaaaagccttaaatgttcattagtagagctgtggaaaagaatgaagtgtcctgatgcagaattatcctcaggttagattttttaagtgagtggggcattttgagaaactgtatcacatgttcccgcatatgtaaaatgggtgcccaaatattttttcccgtaagggtgccttgttttgtggatcacattgtaattttatggttagtaagtggcaaaagggtctgagagtgagtaggggcactagtgttgccatctttgaaagcaaccgccatttttaaagctattcttactttaatccaagtttaatatacatagaaaaatacacaaatcttaaatagtctgtttttcctaggtaaccactagccaagttaaataaagcattacaagctccctagaagctgccctccttgttctttagtgcatctcctcccacccatttcaccttcactcaagataaccattatcttgagttctcgtgccgtaatttggttttgtagttcatgtaaatggaatctcatagaatgtactctcttttttgcctggcttcttttgcttaacatacttgattcattttgtgtgcaggtgaagtttattttcatctgtataaaattccactgtggaatgtaccatgtaccaaaacaaatacatcttttacccattctactgctaataaacatttgggtaattttgcctttggagctatcacagatagtgctgctatgagcattcttatgaatatatataagttcgtgaactacccaatttctgttgggtagtatatgcctaagagtaagaattgctgagctctagagtatgatagttgttctgctaatgctaaaagttttccagagtggccaggtcagtttatattattaccagcagcatatgggagatcaacagttggtgttttttcattttactgattttaatgggtttgtagtggtattgcattatagttaaaatttacatttccctgttgaccatttttttcatgtctttattggccatttgttcattctcttttgggaaatgtctattcagctcttttactctattttcctattgagtttttaaaatatattctggacataagtcctataaatacataaataggcttcctttttttaagagtctcactttgtctcccaggctagaatgcagtggtacaatcatagctcactgcagctttgaactcccaggctcaagtgatcctcccaccttagcctctcaagtagctgggacctataggcacatgctaccacgcccagctaattttattttttgaggtcttgctatattgcccaggctggtctcaaacttctggcctcaagtgatcctcccgcctcagcctcccaaaatgctaggattacaggcatgagccatcacacctagccaggctttattccaaagctttaactcatttatgccagttgtattcataatttataatagtattacctgtgggttaacatatttaattacaaatttattaagtatctgcctaatatgtgtccagtgtcctaccagtactgggtactggtaagtgctttataaatactattgttaatcctcacctccacactgcaaggttgttgatagtgatctctttaatagaggagagaaggctcaaagaggtaagtaacttgcctgggaccatactacagagtagcagagctaaaattggaagctagggctatgattccaaagctaagtcctttctacgtggttattgagaaaatagttttaactttgtatgtattcactactgggaaattaattgttatttctaattgttttgttttgacaaggtcactttattcagtttctcagactctcaaattattcaatgcattttctttattgaggtaaaatttatataaagtcaaccattttaaagtgtactgttgagtggcatttagtacattcgcagtgttgtgcaactgtcacctatgtagttccaaaaatgttcagtgtattttcatccaaaatttgcttgaatgacaatagaatttgtttctaagataaggaattgtctaggcaggaattgtagttagagaaaaaagaagagtctgacttaatttccttcctctattgagcctttttcgttactttaaataaccttgcattaaatatttttgcatattagtttctgtgactctgctgtctcttgctcagctcttaccagcttctattgtagcacagggtcctgggcacattgtaggtgtcagtaaataatttcaatttaattgaacactgaagggtttatagcacttaattaagaatcaaggtttgaatcctcagcccttgattaaattcttctgtgcaagccacttctttagggggcttcagattaccgcttatcaaatgagaaaatacttatctatttatagatttgctgtaagtagttctattaaatatcacatgtgaaaatattttaagataggtgcaatagcacatgcctgtagtctcagctacttggaaggctgaggtgtgagaacacacacacaggagtttgagactgtggtgtgcgatgatcatgcctgtgaatagccactgtactctggcctgggcaatatagcaagacctcatcttcttaaaaacattttaataaaaataaagtttttaaaaaatgtttttaaaaatacatgacatctacataacagtgtataagctgtgcagtgggaaatgggtggcatttggaagttttctaaaatctgggtttgctccttacttgcttgtatctttgagccttggcttcttcatctataaagtggacctaataatcactcattgggtgacttaaggaaatactatgtgtgtgtgtatctttggtcctgtgcaaatgatatggcataattgtgcttgtaagtaaatgtcgtgattcatgacttttcaggactgcagtgtgctagcttttgttctggaccacctgctcccacatacccagaatgcagaagacaaggacacccctgccttggcccgcctgttcctcgcaagcctggctgctgcagggagtggcacagatgcccaggtggccctagtgaatgaagtaaaagcagcccttggacgggcactggctatggctgagagtacagagaaacatgccaggtaagattcatacctgtcccagggctaatagccaagaacatccccttattcttcttcttagtccatgggtggttttgcacttgaacaaaacttcttgtcatactggcatcatatactctctggtccgctcaaatagttctggcggttggaaatagccagagcactgattaccattagagtaagtgggtaaacctagagaaaacaaagggaaatgttaagtgtacttttaaggtcttcaaggaagttgagcaggttatttgatcttatattttaaattttatttaaagtaggggctgggcacggtggctcacgtctgtaatcccagcgctttgggaggccaaggccggtggattgcctgagcccaggagtaggagttgaagaccagccttggcaacatggcgaaaccctgtctctacagaaaattagctgggcgtagtggcacgctcccgtagtcccagctactcgggaggctgaggtgggagtgtcacttcagcccaggaaggttgcagtgagccaagattgcgccactgtactccaccctgctacagagtgagaccctgtctaaaaaagagaaaacgaatgctatcaccttagggagtgtgttctcacctgtttgtttagatgttatttccagaaggaaatacaaaagttacaggagggttatctgaggctattttgtgaagacttggcctgagaaatggctatattcatatgatagagatgtcaaaacttctctcccaggcttcaggcagtgatgtgtatcatcagtactatcatggagtcctgcccctccacctccagcttctacagcagtgccacagcgaagacccagcacaatggcatgaacaacatcattcggcttttcctgaagaagggactggttaatgacctggccagagtacctcacagcttagacctgtccaggtaaaatcatgccccagccccaggcttttccttctcttcagcctcactacacgaatgatgtggaggtagctggtgtagtgggaaaactttgggtacaagtgggagacccaagtctttcttattgtggcttttagcacttgtctttcttaaagccttggttcttacttgctataaactcaagagttgaactataatagtgatttttttttcaagcttccccccactttaaaaattaccacttattagaagattatatgtatattataagaaatacagatgagtaaaaataagaagtagacactgtattcctaccacccagataccatgattaccttattggtttattattcagtgtttttctttgcatgcataaataatgtattctttactaacatgatatgatacatgctattgtgttgggggaaatttggggcattttcgtttttattttcagttactggtcacttccttgctatgaaaataagtttcatcctacctaatgcccaaatccataattaagcatttttctccaaaccagaatccaattaaggacttgtattacatctggctatgttttctgaatctctcttattctaaaacaattttttttcattatttcgatctttattttgtttttgttgttcatgattccagcttgttgaagcgaccgtgtttttgccttctaaacttggtgcagttgcttccttgcagtgtagtttaacttaatcctttacttcctgatattttctgtaaacttctagttagatctagaggctttagaggcttattgaagcagtttaaacattttgggctgaaatgtgtagcctaggtgatgtatagctcatattgtatcgtgggagacacatctcccatgataattgtcactttttgttcttactagaaagtcatctctgttgttattttggcactttacaaatgtctacactatcaatcatatacctaaataatagccttaacatcagttgataattcttgcctggatcaattaatttctttgaggcttatgaataaaagctttctaatttctcatttcgaatacattattaactggcatttttctgtgttagcctcacagggaatgtctggttgtgctaaaatataatttctattataaaggcagtataaaaacttaatttctttctatttacatttgagattcaaatgtaggtttttttctggctttctatttttaagtcgtattatggactcgacttttcatgtttgttttgttttgaaactagtgattgaatttatttggatcactgcagtcactttttcatgctcaaattattacacctttgacctatgtggccccttcaagatgactaaattgtccttttgctacaaacctatcaattttttgaaacatttataaatgtcaaactcacagtactgtaatgaacaccatgtgtctacctagattaaccactgctgaacattttgctttatttcttcccttcctgtcctttcaggagctgaatcatttgaaattagttgaaaacactgtaaaactttacctctaagtacttgatcatctgtctcctaagaacaaatattcctttatatgggtacagttccattgtcatatccaaaaaatttaccaataatataataatactaaatttatacaattttatatacacatactcccagttatttcaattatgtctttatactctgagggagagtgttttgatccgggattcagtgagtatcacatgttgcatttggttgtcacattttttttttttatgacattttcctgttttgatgaatccaggcttgatgtcttatagaacatctcacagtctacattgatgtaattgctcccttaatggttagggtcaggttaaacatttttggcaaaaatactacatgggtgatatttgcccttctcacatcacgtcaggagacaggtgaataccacttggtcccaatacttgtgatgctaaatttgatcacagccgaggctggtggatcacttgagcctaggagttcgaggccaacctgggcaacatagtgggaccctgtctctgcaaaaaaatacaataattagctggacatgtacgcctgtagtcccagctttttgggaggctgaggtgggagggtggtttctgttagatttccactttgtaatgaataattccattactatcattattctttctgatactcagctgggcctgtggtaatgatcccattaattttttttccccatttttgttgttatttttcctctttatagaaacaggatctcactatgttgctcaggctaggctcaagcaatcctcccatctcagcctcccacagtgctgggattacaggtgtgagccatcacgcccagctgtcccattaatttttgaaagctttttggcacaatgagatatcccaggcttaccttatcccttccttgccctattcctgggatcacttgttctgacgagtcttggttacttttagtgtgatgtgatatcagagactgccatcttggtactactagtgagcatatatatatatatatatatatatatatatacacacacacacacacatacatacatacatacatacatacatagactcacacataaatacacacataaagcagataaaagcagagctgctctggtgttagtgggcacctggttggtctcacacaccttattacacttagaaatcataccacacctccaactgcagcccctattgtacttttattgaactctaggaagccctacagagtataatttgaaattcacaggacttcaaactgttatcagccgggcgaggagggcaggttgcctgagctcacgagttcgagatcagcatgagcaacatggcgaaaccccatctctacaaaaaatagaaaaattagctgggcatggtggctcacgcctgtagtcccagcgacttggaaacctgaggtgggaggatcacttgagcctgggaggtggaggttacagtgagctgagattgtgccaatgtactccagcctgggtgacacagcgagaccctgtctccaaaaaaaaaaaaggaaaacttttatcatgttccttcctttgagcttttagggtttggggactaaatgctggtggtttaaaaaaaaaaatcctgagtacatccgagaagtggcttgcttgcatgtggtcatccagaatacattctgatttccagtcaagaatttgttactcatgtgctttccatggccccatgaaatatggcattgatttaactcttgcttttagggtgggttccttgaagacatttaagtcaaaattttttttttctaaacaaaagtagagtgttagttgtacgaccttatgccccttttctcttagtagattccattgtaagaagcttagtgtcatttagaagatagacacctagtatttctgtgctcagtccatctctttatcttcccttatctcagtcccaacatggccaacacagtcaatgctgctctgaagcctttggaaacactttcccggattgtgaaccagcccagtagcctttttggcagcaagagtgcttctagcaagaacaagtctgagcaggatgcccaaggagcctctcaagattccagtagcaaccagcaggacccaggtagggaatcagagccaatggactggagaggtgggagtagttgctttatgggcctgggatcacaactgttctggcttggtggtgtttccctgggaacttgctggccttccagagatctgtcatagtggcgtgggaatctgccccacaaagaattccttcaaaatgcagccttgtttggctatcctcacacgtagccttgtcttttcctttgtcacccattcgtttattctctgagaacttacaaacttgcccaaggaagggaccttattgtctttgcgcttgcctcatggtgcccagcacataggcactctttgattattttgctggttggttgattgtttcaggcgagcctggggaagcagaagtgcaggaggaggatcatgatgtcactcagacagaggtggcagatggggatatcatggatggggaggctgaaaccgactcagtggtgattgctgggcagcctgaggtgctcagttcacaagagatgcaggtagggaggcagatcacccagcatttccctgttgcggcgctgaaccaaacccttgccaggtggtgtgggtgggtgagtactttagatccttgcctcaatgctggctgctttgcagaggagcatgggtgatatgcttagtagatgctcagtaaatgtgtttgtactgtattaaaagaggggtgggggcagggccaggatgccatgtactatgaaatgatatagatcccaaccagaaaacttaggcacaggtgaaatgttgaagtagaaagctgacctgagaccgttgggccccgggtctttgatttactttggctctggtcattattggaagctccttaacaccaccttatgcctatagcaccagctcttgctggggcattaaaacagcagtcttctaaagaccctaaaggaaagcattgtaatttctggagctggtagcattgggtaagaaattgggcctgtggtcctaagctgctggctttaaagagatctattatgtcttcctggacagtataaagacaacccagtatcagataactgggatggacccatttgaaggatagtctggttgtggattggtagcacgtggtagtttctgtgctaattagcaccgaatgtgtggtttcacgtaacatcctctgtcacatgttatcctagaaatgtatgctgctttgctggccttttttagggtttcggtgctagcacaatgatagacttgtgtgcatccatatatatgttctatttctctccaggttgagaatgagctggaggacctgatagatgagttgcttgagagggatggcggatctgggaacagtacaattataggtgagagccccagaactgagtatagcctcttcctttgcctcagtctctcttgggaggaccctttttctcatcatctgcttgctcagctctgcctaagggctcatagccagcctagatcgctgcttgtcttgatgttgacggtcttacagatgagaaattcacaagacgtctacaggcctgtggcagtctaaagtgttgcctgtgtgggggaggtggtgggagtggccattgatacagatgatacatcaagcacatcaaaagagtgtttattcatggaggcctagaggaggctgtagggtgagaaagcgctgcctttcagttcttcaatgaagtccaggggctttctgcccctgagtctcagtagtgtaaaaagaatgatcattccctgagggtggccctttataaatctcagagggaaaatggcaaaggtaccctactgtcacctggctctgagggtgtatgtgttacttgtttttactttgttgatcaaggaaatcaaaggataaatggaagtagacacgtattcttaagttttacaaagcttttttatacccagtatcctctgtggtttcacaattagtgggattggcagggcagatgtgatcatcctgttttacagatgaggaaactgagactcagacaggtaaagtgactggccaagctcacctagctagctgacagcagacaatccaggtcttctccctcatccaaaaaaaagtggatatctgctaggtgtacatagctactttagacgcacccagtctggaaagggaagtcctctgttgttcagtgaaggctctgctctgtaaccttcagtgagcagaagtggagaggatgaatcacaagaggacgtgctgatggatgaagctccttccaacctcagccaagcttccaccttgcaggccaaccgagaaggtgagagtgccgaggccagaaaggcctcccttcttgccctgcacgtctgacagacactacactagggttttcctggaggcagctgcccacatgtgcagaataaggaagcatctgtctgcatgcgctgacatacaccatccactttatcctcagccagtttttcaaataacatgttactactgcttgcccaaagtttgtcacttcttacttggttcgctttcttctcacccacctgctatcatcgctccaggttccctcttgccaacaggatatagtcaatagcaaagtagggctgaaaaggcaagggggcaccagcagacttggccaagtcctagaccatggctcctcaagcaccaccctctagccagcctccacattcagccaccctgctcagtgtgttgatgcattgattggcactctcaggaaatcgggtctggctcactaagtctgtacatcaccccagatctggttcttcctctcatagagtcagatatcccatcaccttcccactcagcctgctggcctgcacagtagcctgttttctagctactcagtttagtcctccaatgtgctccctttgttttagattccatgaatatcctggaccctgaggatgaggaggagcacactcaggaagaggacagcagtggcagtaacgaggatgaggatgatagtcaggatgaagaggaggaggaggaggaagatgaggaagatgatcaggtgaggggggactgcgtttgggttggttcagatgacctcttccatgggaacatagagctgcagaaaaccaacagtctgggttgctagcctcagcgtctccctccctcatgtgcacatgtggccatggcaccaggcttcagaaaacccttacctccagcaattctccatctcctattttcccttaaggaggatgatgaaggtgaagagggagatgaagacgatgacgacgatggctctgagatggaattggatgaggattatcctgatatgaacgcttctcccttggtccgatttgagcgctttgaccgggaggatgatctcatcattgagtttgacaacatgttctccagtgctagtaagatacaggggctcagctgggtttttctctcttgattcttatacccttctctagggtaagccaagcagtggaccaaaccgatccgatacagacagcacttcttttcctatgctgacttcctggggcaagggatatctgaatccatctgtctcattagtgtatacttaggagaaggaatagtgagaggctgcttttgttcccttcacctcagtaaataggcagccattttagagcctggacaacttgatgatttgcttgattaaaaaaaagaaagagaccaaggctgactgcatcaggcacccatgtgcacaccacagtggcagggcaatcaataatccttatgtccataacacaagatcttgagggtttgaatggtcacctttgagcttggctttggggagcagatttgaacatactcactctattcatccaggatgcgtcttttcgggagaacgagtgaatctcttcctcccccatcaccgtgaaacttcccttttagcgtcaagttagaatcgagttcttagaatcaagctgtcttgatagggcaggtcttgacaacttaaatcacaagcatgatgtagcagaaaacactgaactgttctggtctgttttcttggccaattaatctcttacctctttgagcctcagtttgtcacctgtaaatgaaaagttcgagaaaaaaatgggttggattagataactttgaagataacatctatgattattttgcatttttgtgattttcatcagtttcccttagagttgagcctctgtccattcagcaaattgaacaatatttgaggagtgcctactgtatcctaggtactagggatacagcagtaaagaagaaaacagtcctcgttcctcataggagtggtttattaggaatcataactaagcaggcattacattgcactatagtaagagagcacagaggtaaagagttacctaacccaatctgtggaagtcaggcttcacagagaaagtgacatcttaggccaagaagagaagagcaggtaaagaagcgggagaggagtcttcaaggtgaagggagcagcatgtatctgaggggcctagaagcatcactgtgactgtagtgtggaaaatggattgggagaaggtactatttaggaggccgttgcagtatctaagtgagagatgatggcataagctatggtagtgtcagtgattgtagatgagttgtgggaatgagggagaaaggacaaagctcaggtttccgtgtgaggaagtaaggcccaggagacatgattctgcttgaacaaacatggaagaaatttctttttgacactgacccttttacatattgtccttgcagcagacatccccccatccccaggaaatatccctaccacccatccactgatggtgcgccatgcagaccacagttctctgacactgggcagtggctcttcaacaactcgtctcacccagggcatcgggcgcagtcagaggaccctaaggcagctgacggccaatactggccacaccattcatgttcactaccctgggaatcgccagcccaaccctcctcttatactgcagaggtgagttacagagatctgttggattcatcggagctcttgtaagaattttcactgtgctttagcattgtcttaaccttgggggaaatagtccatcacttaatgttcttgtcatacacacaaataaggtatttgttccatttctttgtggattacatgtgtagccttttggggagtgcagccttttggggaataccaaattatgtcaatagttctgcgcatgtatttagcaattattaagtgtctcatgccaagcacttaacactttagatatagacgggacaagatccctgccctcaggcttagagtttagtgagacaaacaatcttaagaagtaaaagaaaggcatataagtgttgtaatggttggtgtacagacgacagagagggtgtagtggaggcaatgtgacctgacgcagtgcctggcacgtgggagcttattgacacccacttggtgccaggaactatggaataatatacaacttaagtacaaaaccagggtggtattcagaaaaataacttagacttgtgtgcacatcatcaggtttataatcatgttctgcatttaatagaggatgcatgaagaggatctcatggtaacaggttgcagggcacctctggacttaacagtgatcatggtacccaccattaccctacaggttgcttggtccctcagctgctgctgacatccttcagctgagcagcagccttcccctacaaagccggggtcgggcccgcctcctggtaggcaacgatgacgtccacatcatcgcccgttctgatgatgagctgctggatgactttttccatgatcagagcacagctaccagccaagcaggcaagtttgtgtggtgaaagggagggtagaatttgtcagattctactttttccctgctgaggaaaagcaagacagtgtctgccctatagaaaacccccattttataggagccagaaccactcagtgacttagccatgggcaacaaaaactttattgtctctaggtacttgttatgttctaaacattgtgatagaccttgggtccttttagggaaatactgcaatttttggatcggtggatcagttaatgcttgacaaggccaagaatctcattcccctttgctgtccctacaggaaccctgtccagcatccccacagccctgacccgctggacagaagaatgcaaagttctcgatgctgagagcatgcatgactgtgtttcaggtgcgtggcagcttggttatcagggcaatagtgagccttccagagctagggcaaacgtgtggagagttgtttccctggttctctgtggctacaagctctgcctcttggcttcctccctgaccccaccagagcagcctttgatttttgcctctttgaaacagtggttaaagtgtccattgtcaatcacctggaattcctgagggatgaggagctggaagaaaggcgagagaagcgcaggaaacaactggctgaggaagaaacaaagataactgataaaggcaaagaagataaggagaacagggatcagagtgcacaggtgattcccaagggctgggaggattcatctttgactgtgtctgccgtaatgtggttttggcatacacatggcaccaggaatcactgaagaatcctagaacgttcacgttgaacctgggaaattttttatttcaaattcaccatacattgacctggtttttaggggaaagaattcaaacctagaggggagatttctcaagtgtcaagggaaaaactggagccagaagcagaatggcttctcactcaacagtcacactgcatagtctctaccgccaaggacagcatcaagacaaggagaaaaaccttatctaagtccatgctcttagtcgcccacttccatttctgtcggtgaactgccagtgtggggaatcttaccgagatgaccccattccgtcatttgagtaagatcagcctaggtgtcagatcagagaaaatgtttgtactctgaaccccatcaccacatgtcattttttctagggctcacatgtataaaatcactaatacaattttggtttagaaggaagttacctacttttttctgaaacttctgggacctcagacagagatcttttaaatgtctgagtaaatgttgatagaattatacattacagtgtatcacttgatataaaagggggaaaaactgatagaaatacaaagaaataagacttgagagtgaaagactttagtataccctactcagcagttaaggaatcaggtagattaaaaataagggtagtgaagtgttcagttaaaataacaaggttgatctaacaaatatctttatatagaactttttacctaatacacacattgtttcaaacttgatataggatgaaaaataagtgaacctagcctgtgactgaaaagactagagtggacaaaataaaaaataagccccatgaagggaaaaaatacatagatgaaaccaagaaattcttgctagaatgatcatgatcgtgcccatccctaaggggtttttattatcctttccttccatatttatttccccctcagccccaaacaattcttgaacctgagtatgtatagagaaattggtcatatatttgcacagtgaaatgatcaccttcctttggtcacatggccaaagcattctccattagatcactgaactcctagatggtctgggtggaggatggtgactattacagttgacctctatcttaggtgcttgcaaagtcccacattggtctatcccttctttttgcagtgtactgcatctaagtcaaatgactccactgaacagaatctctcaggtaactctccttccctttctcccttcttactaatcaattggttgcttctttatcctgatagttccgagtagctggcccacataggctgaagatggacactggtgctctgtgggatgaggtagtagattgtatagttttagggtcataccccatcttggagataactatacagtctactgtctttcccacggtggtacacttcttctccgactggctctgttcaggttcttgttctggttattatctactttgttctggcatgggtaatgaggtcatgtgtcttgttcatttcctgactgcaactctgtcctctgaaacagcatgttcatgtacatctttgaagtggctggtcctttgatgaccaccatggtgtggcacttcatgagaataactgatgacagtggttctcaaatgccagtcctctgtggaaacgaacaaaatcaaggagctttaatgcctttttcataaagctgaatttattccatttaaaaggctgtttttgtatttagagatcatattcctaattctgtggtaccaaaatatttttattaaatgatgttgattggatgttttttcttacatggctaaactaaaagttggcaacccctacattagtctctactttttgttctttttttaattaaattttattggtccatggaatctaaaagtctaggaacattgtcttggatagtgtgctgttcatgaaggtagctctctgggcttagtggtatgactgccgtatgtttcctattccctctgatcttcttaacaatggtcagtagccattttgtgattctatcagttggttcatgtgatatcatatgtctcccccacccatatttcctcagaacattcttctgcctccctacacctgtctcctttcgcacttgagttggaaaatgattgtaccaaagcctgcacaatattttttaaagcagtgaagtagggtagatgccttggtacccttaatctagcaaaagatctttaaaagagtctgtcaccatgtaaaatggccttttgcctgctgcccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcagtggttcatgcctgtaatcccagcatttttgggaggccgaggcgggtggatcacctgaggtcaggagttcgagaccaacctggccaacacggcgaaaccccgcctctactcaaaatacaaaaattagccaggcttggtgacactcgcctgtggtcccagctactcaggaggctgaggcaggagaattgcttgaacccaggaagtggaggcttcagtgagctgagaacacgccactgcactccagcctgggcaacagagcaagactctgtctcaggaaaaaaaaaaaaaaaaaaaagattttgaagggctggacgcagtggctcacgcctgtaatcccagcactttgggaggccgaggtgggtggattgctagagcttaggagtttgagaccagcctgggcaacatggcaagaccctgtctctactaaatatacaaaaaattagtcaggtatggtggcacatgcctatagtctcagctacttgggaggctgaggtgggaagatcacctgagcccgggaggtgaaggctgcagtgagccatgattgtgccactacactccagcctgggcaacagtgagaccctgtctccaaaaaaaacaaatagagttttgaacgaaattctgaccatttcttgctccaaatagatgaagtgggaggatcaataggattttggtagttagattttctgtgtacctataggtcagagacatttagcctcaccctatatggcctgaaatcttcccccttccacctgcagggcacagaaaggattttattcttagaatccacagagtcagagctccagttcttgcattcttgggacagagatagcactgtgccttaaccttcatccttagtataccagaccagagatgttccttggagtatttttgttgtggggatgatcactggctgggtgggatacttatcaggccacatttgctgattggggtggctcccctcatcattggctggttgccccttaaccactattattgttctttccgagaaagatgggacgcctatgcctgacagctacccaacaaccccatcttcaactgatgcagctacatctgagtccaaggagacccttggcactctgcaatcctcacaacagcaaccaacactcccaaccccaccagctttgggagaggttcctcaggagctgcagtctccagctggagaagggggcagctctacacagctattgatgcctgtagagccagaggaattgggtcccacaaggccaagtggggaagcagaaacaactcagatggagttatccccagctcccactataagtgagtagaatttcaacatttggggaggatgaaacaagagggaagaaaggatgtctttgtagcttctctttgctcttttgcttgagagaaatagtaggagttcaacttctcaaataataagatctcgtcttgcgcattcactttcttaagtgaagttgaggtcctgaactggtgatagttgaatgtctaatgatattggtgatgataccaacagttcattgaggcaattactctgtttctgggctatcaccccaggcttattatttaaaaacaactctccagctgggtatgatgactcataatcccagcactttgggaggctgaggcagggggatcatttgagctcaggagtttgagaccagcctgggcaacatagaccccatctctattggggggaaaaaaaaactctccaaaatcgatggtgttatttacatgagtaaactgaaactcagaaatgaaataattagcccaagtcactctgtaagtggttgaactagaattaaaacccagatctgtctgactttaaagattactctctccttccacagttcccaggatggcaagcatgtcatcccacacttagagctctcccattctcctggcagacactgtttatctcatgacactatttctcactggtttgaaatggggcctgaaaagtcttctcagcagtatttcaacaggataaattgatacctgcttgccatccctgctctataccatcttgcttgtgaagttctctggagagaccctaaggtgtcagttttttctttcaaggaaccttgtttattttattttattttattttatttatttattttttgagaaaaagtctcgctctgtcacccaggctgcagtgcagtggtgtggtcttggctcactgcaacctccgccacccaggttggagtgattgtcctgcctcagcctcccaagtaactgggactacaggtgcacgccaccatgcccagctgatttttgtatttttagtaaagatgaggttttgccatgttggccaggcttatctggaactcctgacctcaggtgatccacccgcctcggcctcccaaagtgcttggattacaggcatgagccactgcgccctaccgaaaccttgtttatttagagaactacagggatatgcacgtgcaagtggtgcctgcagtgaatcaaagtgaaaaaatcccttacccgggctgggcgcggtggctcacacctgtaatccaagcactttgggaggccgaggcaggtggatcatgaggtcaggaattcaagatcagcctggccaagatggtgaaaccccatctctactaaaaatacaaaaaactggccgggcgtggtagcaggtgcctgtaatcccagctcctcaggaggctgaggcagagaattgcttgaacccaggaggcggagattgcagtgagccgagattgtgccactgtactccagcctgggcaacagagtgagactccatccccctgccaaaaaaaaatcccttacctggtttgcctagggaagatgtttcacaggcatgcctggaacacagtaaatgttcaagaattgatagaaagggcttcagctgaaccttagaaatctcaaagtgagattgagagggggacagcaagggagaagtgagaagtctgagctgagatgcccctaaggaagcagccctatcaaagaccttatctgtcattttgccccggttccagatagaaacctaacctctccctgcaacttcttcctagcctcactttccccagagagagctgaggattctgatgcactgacggctgtcagcagtcagctagaaggctctcctatggatacaagcagcctggcttcctgtaccttagaggaggctgtgggtgacacttcagcagctggcagttctgagcagcccagagcaggcagctccactcctggggatgccccaccagctgtggcggaagtgcaaggcaggagtgatgggtcaggggaatctgcccagccacctgaggacaggtaagcatgtgtgggcaaaagaagggtaggatatattggagggtctttcaaagcacatttcatactcgtcaactaatggacatgcttgttatgctggggagataaagctggtttctgtgagaaaggggtattgtagcagtgttttataaacgagaagacataatacagacagcaacctgagcatgatttccctcagctccccacctgcatcctctgagagctcttccaccagagattctgccgtggccatttctggagcagattcccgaggaatcctagaagagccgttgccttcaacaagcagtgaagaagaagatccccttgcgggtgagttccgtgtatgcccaggtcatcctgggattgttttggcttctagtagcccttggcatggaaatgcccaccagccaaacagttccatttagatggagggcatgtatgtgggaggactgacaataagcgggggtgctggtatggcataatgaaacgggtccagccttaggagtcaaactgatcttggctcactcaaattcccccactctgccacttctaccttttacaacctagggtcattatttaatttctgtgatcatgaatgataccgagggggtgatgatatctgcgtggtaggttatttatgaagggtaagtaacagtgcatgcagtctagcaaataacaaaagctgttctgagcccagggaaggtggggtgggccttctctgtgtcccatgtcttgcaagcagtgaagacatatacactggtttccctcaaggagtgacatgggtttattttctccaagtacatattaggcaccaatagaggtgtgagaggctgggcgcggtggctcgtgcctgtaatcctgaaaatttgggaagcagaggtcagaggatcacctgaagccaagagtttaagaccagcctgggcaacatagggagaccccatctctacaaaaatatatatgtaaattagccaggcattttggtgcatgcctgtaatcccagctactcaagatgctgaggcaggaagactcgagcccaggagctcaacactgcagtgaggcaagggttgcaccactacactccagcctgggcaacagaccaagaccccgtctcaagcaattaataaggcgtgaatccctttacatgttatatctcccttcaggtatcagtctccctgaaggtgtggacccctcttttctggctgccctgcctgatgacatccgtcgggaagttctacagaaccagctaggcattcgtccaccaacccggactgccccctccacaaatagctcagcgcctgcagtggtggggaatcctggtgtgactgaagtgagccctgagtttctggctgccctgcctccagccattcaggaggaagtatgtgagcgggaaggtggtggggccaggctgcctggcaggagaaatgccctcattgactttttctgctccataggtactggcacagcagagagctgagcagcagcgacgagaactagcacagaatgccagctcagacacccctatggaccctgtgaccttcatccagactctgccctcagacctgcgccgtagtgtcctagaggatatggaggacagtgtgttagctgtgatgccacctgacattgcagctgaggctcaagccctgagacgagagcaagaagcccggcagcgacagctcatgcatgagcgtctgtttgggcacagtagcacctccgcactctctgctattctccgaagcccgggtacagagggaggcaagtgggagggctctggaaagctttagccagatgaggctatgttttcttacctttgtattacctatatccagtttacaccctctccacaatctcagttttctttttctttccttccagctttcaccagtcgcttaagtggcaaccgtggggtccagtatactcgccttgctgtgcagagaggtggcaccttccagatggggggtagcagcagccataacaggtacctttgtctatttttaccttaccatatcaccactcaagtctattagcccagctcccttagttttataggtggagaagctgaaatcctgacaggcaggatggatggtctctctaagccatttccttgaataagtgagagagccagatctttggactccccattcagaaaactacaccttttggttagtcttgctaccaaagaccacaatcgcaaaagcaggccggcagcaggtgctaactatggttttaacaagaaggaacaccacttgtctcccatgcaagtagtaaaacaactaaccacctgccttgagtttgtaacacctaggctaaggaagtatagaggagtgagttagccaggctaaaacagagtgggcctgacatgccaaaatgtgaaaggagtgattggttcctacaaggccacaaactcctggtagtctagagaaggcagaaactagcattgtctcctagacttaggtatggtcagattttaccagtcgatggatgatacctgggctggaatctctgctgtcttctcagtcgccgtgtgatgtagggcaagtcacttaacctgtttgagcctcttgtttatcatctcaaaaatgggtggttctcggccagttgtcgtggctcacacctataatcccagcactttgggaggctgaggcaggtggatcacttgagtccaggagttcaagaccagcctaggcaacatggcaaacccaatctctactaaaaatacaaaaagtagtcgggtgtggtggcgcgcactagtaatcccagctactcgggaggctgaggcacgagaatcacttgaatcctagggggtggaggttgcagtgagccggtatcacgccactgcactccagcctgggtgacagagcgagactccatctcaacaaaaagctggtgggggtggggggcttcattctctaagctgtacagcagccctgaaaggatgatgtacagtcattgtaaagtgcctggtacatagtagacacctaagagggcagctgttactatgaagagcccttggactggacacccacctttctcaagcctccttggagatacctagctcattcccctcccccattcttatgcctaatcccagagctctagccactgaagtgttacccaaaaaccatgttctgtttccaggccttctggcagtaatgtagatactctcctccgcctccgaggacggctccttctggaccacgaagccctttcttgtctcttggtcctactttttgtggatgagccaaagctcaatactagccgtctacaccgagtactgagaaatctctgctaccatgcccagacccgccactgggtcatccgcagtctgctctccatcttgcagcgcagcagtgagagtgagctatgcattgaaacacccaaactcactacaagtgaggaaaagggcaaaaagtcgagcaagagctgtgggtcaagtagccatgagaaccgtcccctggacctgctacacaagatggagtcaaagagctccaaccagctttcctggctctcagtatccatggatgcagccctaggctgcaggactaatatatttcagatccagcgttcaggggggcgtaaacataccgagaagcatgcaagcggtggctccaccgtccacatccatccccaagctgctcctgttgtctgcagacacgttttggatacactcattcaattggccaaggtgagggtttcaaacccaactcctggggatggaagaagggtggcagcaagagcctgggtgaaagttgaacactaagcaggctagcgtgtctttttgctcttattttaagtgttgagccctgtattgtttctaggggattgtcctatatatttctggggttttttcttcattcttttccatttttatgtatgtcttatttagtcatcaaaacaactgggctgtatgattcctgttttacagatgaagaacctgagattcagaacattttattcattttgtcttatgattagaaagtgatggagctggacctagaatttagtgttctttcaataataagcattgctgccatctatcaaaggcctgccttgtgccaggcactgtgcaaaatacatcatgtcgtttaatctccaacaactttgcaaggaagtgtagttatctccattttataagtgcgagactaaagctcaggaaaagtttgctcgtgagtctgtattgctacaaagccctcattcatttctctaggctgctttactgtctgttggataaaactcttatatgacatatcccccaatatttaccaaaattgtctgaaggagtctgggaaccagttgtcttttccctatcaggaaggctcatcctctgtgaagacgtcctagaccaagccttgtcctccttttcccggcaggtatttcccagccacttcacacagcagcggaccaaagaaacaaactgtgagagtgatcgggaaaggggcaataaggcctgtagcccatgctcctcacagtcctccagcagtggcatttgcacagacttctgggacttattggtaaaactggacaacatgaatgtcagccggaaaggcaagaactccgtgaagtcagtgccagtgagcgctggcggtgagggggaaacctctccatacagcctcgaggcctctccactggggcagctcatgaacatgttgtcacacccagtcatccgccggagctctctcttaactgagaaactcctcagactcctttctctcatctcaattgctctcccagaaaacaaggtgtcagaagcacaggctaattctggcagcggtgcttcctccaccaccactgccacctcaaccacatctaccaccaccaccactgccgcctccaccacgcccacaccccctactgcacccacccctgtcacttctgctccagccctggttgctgccacggctatttccaccattgtcgtagctgcttcgaccacagtgactacccccacgactgctaccactactgtttcaagtaagtgtggatgtagactgggagctgtggggtatatactgtggcacccacttcacccccttttccatccagatagttctccctcagtgatagcaatcagcttggtttgtgtttgtgagaacagaatgtgttcattctcaccctcatctgtcccagttctctcactctgtctcccttcctccatccccgtctctctgtgtctctctctttctctctctcccctgcctctcacacacacactcttttgaaggtcagcaggcattcactgaatgtagcttccctaggctaggcaccagaaggaggaaagaaagttaagttccatcctcagggaattcccagcctttccagttgtgttgagggagccagttctcatgggaaatagttcaagggcgggcaggatacagtgtgattcagagtaaccagatcatcccaggaaataaaggtaatgagccctgccacagattagtaagaaagaattatctgaagaagtaggttttaaagaatagagtgggccatgatggtgggggaatagttggaagaaatgcctggggtttctttttcagcttagaagttacagtcataagagtcctctttgagtttatggtgagacgtgattgtgccactgcattctagcttgggcaacagagcgagaccgtgtctgtaataaaaaataaaaagcctttatcatcccaagtcatttagatttgcctttggtgggtgggttttctttttcagtactttcccattttgaagccctgggcaattcagcgattccttgattttgtcacttagtccctggcttgtgagtttcagagaggcttacagtgttctgtctgtttcctcaaagtttctcccactactaagggcagcaaatctccagcgaaggtgagtgatgggggcagcagcagtacagactttaagatggtgtcctctggcctcactgaaaaccagctacagctctctgtagaggtgagtccaagctcttctgatctgctaagacttggggagaaaggataaacagggtagataatgattttgttctcaggctggggcttactccttctgtcttctttttctcaggtgttgacatcccactcttgttctgaggaaggcttagaggatgcagccaacgtactactgcagctctcccggggggactctgggacccgggacactgttctcaagctgctactgaatggagcccgccatctgggttataccctttgtaaacaaataggtaatagcagaagtaaagcattttctctttctgaaggtttccacttaggtgcttcctctttctggaatcctttcctgaatccccaagctgaatcagatacctccatatccctataacacagcctccatgctccctctgtcgtaacacagattaccctgggttatcatctgttttcctctgctcagttgtttgaaagcaaggctgggtttgtctcctcatccccgctgcccggcacacagtggtgcttaatgaagagaaaagagaacacatgggaacagcagcgcctcctttcttctccatgctgggcactcgtaagagccccataagacagctgaggcagcttcaccccttcaaagtatgtccctacactgcattcagcctcaggaattacagagtcagaatagtactctctgcttttgtgtaattttgagggtataaaaattctaagaacagttacaaattacctcgtttctatcatcttcctccctgttttactgagaagaaagccaaaacccagggtgataaagtgattggaccaaggagtacagccaggttttctttcaacatagagtctgtctaccctgtcccaccctcatcccaatcatgagtctccctagatcttggctacatacttagttctctctctccttcacccccatgtccctaagtctggggtgataggagagttggttggcctgtataactcagggtgttctttgctgcatgaaaattacaacgttcttccagaaagaatttggcctctgacctttctctcttggctgccaccatctattccacacctatgggccaggcactgtctaggcactctaccatataattatctcttaattgtcacagcaacgttatgaggttaggcagtaatattcccatcccagtattaatattggttagcaaattgggtaaggggtcaagaaatttgcctgaaaccaccacagaacctcagtaattttgagagatatatgggatttcaaccatggtctgtttagctccagaggagatactgtttctcttctacatgaaactcatttcatgcagattcagcagatccctgtggccataggtaaattggtagtcccaggtgacggttcgtggacacgcataataagctgaacagagcacgattccagctcactctaggttctctgcagctgagcaatgaagagtggcctaagcaggtgtcttagagagatttggcttttagccactttaccaggggagtctctgaacacttgctgactcctctgcctgctcaggtaccctgctggccgagctgcgggaatacaacctcgagcagcagcggcgagcccaatgtgaaaccctctctcctgatggcctgcctgaggagcagccacagaccaccaagctgaagggcaaaatgcagagcaggtgggtggtagccaccctttggctgggggcttgaatctgggatattctggaagatggctcttgctggtttcctggtcttttttatttctctgggtgattttcgtatctttcctatacacacttgacccatttttttctacttcctacttggaagatttccttctgagtttccttacccctctggttgacaccaggaagccttgcttgctttgggtgtttatactttgatgctgtcaatatacgcaagccacctctacactatccaggtttgacatggctgagaatgtggtaattgtggcatctcagaagcgacctttgggtggccgggagctccagctgccttctatgtccatgttgacatccaagacatctacccagaagttcttcttgagggtactacaggtcatcatccagctccgggacgacacgcgccgggctaacaagaaagccaagcagacaggcaggctaggtatggaactagagtgtccagttgaggggaagggttggtggcggtaaagccagattccttggaggtgcaggacttaacggcctgtctccttcctgtttgacctttccaaaaggaaaatgattatccttttttcagaatgttgatggctgcattctacatctcattcaagctatctgcgtaggaaattcattagggggagtgggaattaagggggagtggaaatctggcagggaagttgggggccagccttttgctgaacaagacttaactcactaggtgcatctcctttctgcttccttggtcatttctaactaagccgtggcttgacaaatcattttccctacctctttcctcctgtcccacagaaccctctcgcacaaaaccatccgtctgtctagcatcatgccccctgcccttatctgtaatggtaaatcttagcgcctgatgatgagcactctgaagcttcctgagctaaagctcaaaagacctcagcaagatgccctgtggcagcccaggagataggagagagaatattgggctttccctcttcctatattttatatcttgccttcctctttctctttctcccaggttcctccggtttaggctcagctagcagcatccaggcagctgttcggcagctggaggctgaggctgatgccattatacaaatggtacgtgagggtcaaagggcgcggagacagcaacaagcagcaacggttagcatgatgcctgtggcccctcattcatttgtctctccactcatccccccaccatgtcatcagtggggtttcattgcctttaccttgtatgcttttgcattaagtttgctatatgaatgcttctggacaaaagggttactttctgttggtgttttcctatttgttgattggtttgttggtttgatttgatttaaagcttggccatcataccccactcccagctatccagtcaacagtggcgcttttgcaaactgcctgatgctaagtgttgtctgggttctgaggggttatggggtgaagttttttttcagtcccatggaacaatgcaggtacatcagaaacatctcaggaatcctaccattgaaagtcccccaagcttggtacatatcccacacagccacttctgtctgtggctgctccctccaccctgccctctgcctttattctccataatcccttggcacctaggcactcaggcacttttaggaggaaaccttcaggtacttaagtagccagctcagtgttggggtcccggcattgagtggctgcagtaaaagcctggcatcacatgtgtatgctgtggcactccctcattgttttcctgtccttgcaacatgtaagttacctttccaagatccaagaaaggtatcctaagacccgatatttctttgcgtataattactattatacagtatggttttattgagtaggcagggaaaagccttgaacttaggggcagtgactccaggaaggtagaaagggaaaataaagctgttattctggagtattttttctgccgagtctctttcccattacacgaaaagatgtcggctttttaaataatcccgctcatgagaggttgctctaattctcctattatttccccttttgtgagcaaacagaaacaaagagcagacctaccttccacccatctgaattttttatacacacacacacacacacacacacacacacacacacacacacacacaacagaagaagacttgaagtctatatacaggaggctagttctgactggtcacaggtctggattgtagactgtaggaaatgtaagcatccaaggagctgttgggaaaagcttacaaaacacagtggagaaaagcagaagagttgggaaaggcatccttttgtcctggatagctacagttttccccacccaaatatgggaagcttctttgcaagctcaatgtatgagaagtggaagggccaacctctagcctgtctctaaggaaagcagagttgcacccttatgtgatttttgtctcccttttatccagtcggagtctagccagtcagaggcgtctgtccggagggaggaatcacccatggatgtggaccagccatctcccagtgctcaagatactcaatccattggtcagtactacttcctgtttccagccgagcaaaagggatagccagtcttctggaatgtctgctgaatcccctgctcccagcatatataagcccagtgttttcccatttgttccagtaaaccctggtttctgtaaatgatgacaggtgtttgacaaccaaggcacacttttctttcctgtagtaaaggaaagaaaatggtgggatatcatgcattcagacagcatgtttttatggggttttctcttgttgtggtggttgtttttgagacagtctccctctgtcgccaggctggaatgcagtggcacgatgtctgctcactgcaacctctgcctcctgggttcaagcaattctcctgtctcagcctcccaagtagctgggattacaggcgcccaccaccacacctggctagtttttgtattttttttagtagagacgagtttcgccatgttggccaggctggtctcaaactcctgacctcaggtgatccacctgtcttggcctcccagagtgttagaattacaggcatgagccactgcgcccagcccagcatgtgttttaaatcttttgttttattattgaggcagggtctttctccatcacctaagctaagatacagtaacatagtcatagctcactgcaacctcaaacttctgagctcaatcgatcctcctgccttggctatctgagtagctggaactgtaagggacaggccaccatgcccagctaattttttttatctttgtagaaatggagtctcactatgttgcccaggctggtcttgaactcctggcctcaagccatcctctcacttcagtctcccatgtcttctttctttcttttttgttttttgacacagagtctagctctgtctcccagggtggagtgcagtggtgcaatctcggctcactgcaacctccgcctcctggattcaagtgattctcctgcctcagcctcccaagtagctgggattacaggcgcctgccaccatgcctggctaatttttttttttgtatttttagtagagacagggtttcgccacattggccaggctgatttcaaactcctgacctcaagtgatccacctgcctcggcctcccaaagtgctgggattacaggcatgagccacggccgaccagccttagtctcccgtgttttaaatcttggctcccccatttactgcttctgggacctgaggcaaacctctttgttaggtttccttgtttaaaataggaatgttcagttgttaggattaaatgagttaaaacatgtatagtggttagagaagcacacgatgaatgctattgttagcagcatttctcaaagtcagtcatacatagaatacattttggcaccctcataacacattcccatggaatagtattcttgtaggacaaccattgttatcctacctttcatcaggatttggggagatagatattattttcgtgttctgtattcaccttcttttacctaaggtcatatgatttgcaagtaccggagccaggattcaaacctaaggctgtcagaaccttgaagaatagtcaggatttgggtaaaggatgaacagcaaaggtcaggaagaaacctaagcagggccaggtgtatggggatcaggggttgatgagaaaacagtcacttactccccacccagaagatggggttgtgtcttgctgcttagctactgagcagaggttagaataagcccccagtgagtatcaggaaaagtaccagccatgggattccatctgtcataccatggcttctcagggttttaaactgccccaggacaagatgactaatttagaaggcattagaaggccgggcgtggtggctcacgcctctaatcccagcactttgggaggccaaggcaggtggatcacgaggtcaggagttcaagaccagcctgaccaacatggtgaaaccaagtctctactaaaaatacaaaaatcagccgggcatggtggcttgtgcctgtaattccagctactcaggaggctgaggctggagaatcgcttgaacccaggaggcggaggttgcagtgagccaaggtcgcaccactgcactgcagcctgggcgacagaacgagactgtctcagggaaaaaaaaaaaaaggcattagacttaaggttagaaagatttagtttgatgtcctggtgctgtcttcctcagaaaccaaaatgaggaaaagacagcctactttccaaggccagctgtcagaattcaatgacaaaagtgtcctaaaacatcctgtgtaaactggaaggcaaccatccaaagctccactgttgttacattaccctgaaataatccacagattctcttgaaactagtgaggcagtgactagactagcactatctggatctgcagtagcacctgtggcttttgagcaccttaaatgtggctagcgcaactgaggaaccagattcattattttatttattctgtttaatgtaaatgccatccaatgcaggtcctagaccttgtttcagatgttgctcggtgagtaccactcagtggccagtggtcccctctacttgttctgtatattagttggtgcgtgtggtctagaaagatctaagcagaagggaaattttgaagactttctgactctcttctgtgtgccctccagcctccgatggaaccccacagggggagaaggaaaaggaagaaagaccacctgagttacccctgctcagcgagcagctgagtttggacgagctgtgggacatgcttggggagtgtctaaaggaactagaggaatcccatgaccagcatgcggtgctaggtgagttgtgtcctaaaggcccaggtcccaacccagtggtctgctctggggcccttcctgccagcttgtttttcttccttccaggttactcctctccctcagtgtctctgtaatgagaattcaaaagagaagtgttttttctctgacttcagtataaaaaagattgaccttctcttttaatagttggtgtctttcactttatagacaaggggaatctttataactggttagctatcccatttttctttggcttcaaggaagttcctctgtgacttgattctaccatatttccctgcaagttctcattgtttcttttttttttttttttttttttttaaatcagaaatgaggtctcactatgttgcccagactgatctcaaactgctgggctcaagcaattttcccacctcggcctcccaaagtgctgggatcataggtgtgagccaccacacctagcctagttttcactatttcttcttccttatttatttttataatttgtttatgatggcaaagaggtttgcatgttgaagtttgcagagtaaaatgttacttctccatcattcctaaccctagtgctacagcctgctgtcgaggccttctttctggtccatgccacagagcgggagagcaagcctcctgtccgagacacccgtgagagccagctggcacacatcaaggacgagcctcctccactctcccctgcccccttaaccccagccacgccttcctcccttgacccattcttctcccgggagccctcatctatgcacatctcctcaagcctgccccctgacacacagaagttccttcgctttgcaggtacagggaacttttaggctgccaggtgtagaaggcttcattttaaacaggattgtttcatacagttaatccttagttgatgagagagagagagagagagagagagagagtgtgtgtgtgtgtgtgtgtgtgtgtgtacatacacacacccgtgcacgtaaaccctgcatggtttcccttggcctcaggatactcaggtttagaatagaaatgctcagattcacgttcacacctcaagggctggcccttggttttgactagtccttttagagccctgaaataaggaagaggaaggaagagagagttgctagctggttggctgtcttacagcttctggggcagatgatgtgcttaattcctgctgtcacttctcccctcagagactcaccgcactgtgttaaaccagatcctacggcagtccacgacccaccttgctgatgggccttttgctgtcctggtagactacattcgtgtcctcgactttgatgtcaagcgcaagtatgtgtcctggatattggggggtagaggggtggtgagaactccccaaatggtaactcgcctctgaagttactcttgaggccacaaatttcctttggtgacagcacttggaatggtggtggtgaggagggaagagacagctgtagcattgatggccatcatacctaaatactcctgggcttctccaccccatctgcatttttcatcagcaaaacagagtcacatgatttttgaaccacacagtttctaaagttctgttccatccgttgggggtagtacaggaggcacaggtggccatagaacacacacagcagggttccaggggcttccacaacactcctggagtcatccctatgcctctccttctcctcgtgcatgtatacatgcttacctgcttgtggcagaaatcacatgtcacaatctttgtgggcccttactcagtggaggtaagaaaaatttagagttggtaatgagtgatctacctctcccaactactgggcatttcccaaacaggtgtggagcagagatcaaagtgtttggaggatagaaggagcatcattgtgggtcttcttcctaatcacacaaacaaatttgttctgccacccttaatcctatcttccttccttttctacctcccaagatatttccgccaagagctggagcgtttagatgaggggctccggaaagaagacatggctgtgcatgtccgtcgtgaccatgtgtttgaagactcctatcgtgagctgcatcgcaaatcccccgaagaaatgaagaatcgattgtaagggcccaggaacggagaaaagatggcgggtgggaggtggggcctcctgcacagtagcgatggcttgctctagcctcaaatttagggaggtgctgccctccctaataggaattccccataggaatctggttttagataatcttactgagttgtctcctatcttctgggcctgccctgctggctggccctttagctaagctacccaacaattcccagacagacaggaaagtctttggtgtttataaggatatacctgctggctttgcaatgagagctttaatattgctatactaggaatgaccatgtatgagtggcctccaccaaactggtaactgctcactggtgattctgaagccacctagaggagatcagcagtttgtaatactgagcgtaggagctgatgagatgaaagacctattggagttgtttaatgattcctccccatctcttgtggtgtgggctctccaactgtgtaatcacaagaagtcagggagtctccctagacagactgtatgccatgttcttccaccaccaaatacctttagagaatttggactctgggcttatccctctctaataccacttttctcccctccccacttcacctaagcaaggcctcatttatttctctgatacctttcctattggtgttttctggaatatctgttaaccttgactattttgggacatctcctctgtcagtggtgcttttgtttgctcccagatctccaccccatttctgggctgtcctggcactctctgtttacctcttcatctgacactgcactccccagacactgcttcacagtctctcactcacacaaatgactggatgtatcctgggttttctgcacagctcttttctgcttctgctttcttatgcaggtatatagtatttgaaggagaagaagggcaggatgctggtgggctcctgcgggagtggtatatgatcatctctcgagagatgtttaaccctatgtatgccttgttccgtacctcacctggtgatcgagtcacctacaccatcaatccatcttcccactgcaaccccaaccacctcagctacttcaagtttgtcggacgcattgtggccaaagctgtatatgacaaccgtcttctggagtgctactttactcgatccttttacaaacacatcttgggcaagtcagtcaggtgaggatgaggcatagtcctgggactgtcttcagtcctgggggtctggtctttttgtgtcccatccttgtgctccttcttcccccccactcgcaaaccatgaccctgtataattgtgtttttctagatatacagatatggagagtgaagattaccacttctaccaaggtctggtttatctgctggaaaatgatgtctccacactaggctatgacctcaccttcagcactgaggtaggtcaggaaatcctaatcacagcacatcccagccaatctggaagatccattccaggttcaccttagaactagcactgcgtgaccttctcatagttctaaggaagcatcttgacttcttaaagctgtagcaggtgtttgtgagtgacatcacaaacaggaaaaccagaatttgcaggccatttcctagtttcacctttattaaaaaaaaaaaaaaaaaaaaactccagtacataattcctcattcccaagggtaggtctttgtagaaaaatcgtacaaatgtaagtggggggaaaatgaaggcagttaaggttactcttctcctaaattcttttcctaagagattacattccgttacatatgttagccattcccttttcccttttaccactgatagttgccttactctcttctgccttttttgtaggtcttagagccaaagagtattttcctctttcctacccaaagcctttccctataaggggagttgcgagctatgagtagtagaaaaagtcactgttttgtatggacttgcctcatctctctgcctaggacatggcaaggggtttagggtgtgttcctaggtatctaatcccatcctagatgaagtctgatatgtatgattggtgttttggttgttctaggtccaagagtttggagtttgtgaagttcgtgacctcaaacccaatggggccaacatcttggtaacagaggagaataagaaggagtatgtacacctggtatgccagatgagaatgacaggtaggggaaatgttcctagacctctagttgctcaatatgagaagaggtcggacttgattcatttgataggcatgttttgttttcctctgctatgacagagccacaaatgccttgcacaaaagacaaaacacttgatcaaaaatacttaactttgggcacggtggctcacacctataatcccagcactttgggaggccaaggtgggcggatcagttgaggtgaggagtttgagaccagcctggccaacatggtgaaaccccgtctctactaaaataaaaaattagccaagtgtggcagcgtgcgcctgtagtcccagctactcgggagactgagacagaagaattgcttgaacccgggaggtggagtttgcagtgagctgagatcgcaccactcttctccagcctgggcaacagagtgagactccatctcaaaaaaaaaaaacaaacccagcttaacttcactggacacagtggctcacatttgtaatcctagcactttgggaggctgaggcaggaggatagcttgagcccagggggttgagactagcctgggcagaattaaccagttgtggtggtgcatgcctgtagtcccagctaacagtggtagatgggagccagatgggggatctctgacctctacggttgtgtgagtttagaagtcatttggctttttggttatctcaccaggagccatccgcaagcagttggcggctttcttagaaggcttctatgagatcattccaaagcgcctcatttccatcttcactgagcaggagttagagctgcttatatcaggactgcccaccattgacatcgatgatctgaaatccaacactgaataccacaagtaccagtccaactctattcaggtgagctgctgctggcatccctcctcatatggtcctcttaccctaggcaacgctagtttgtgtgataccaaataaaccagtagtactcttagaggaagttgcatgtagaagacagtctacctatatctaactctttgttctcctgaagcatagcagacttctcttggccgtcttatgaatgaaaggagctaaagctcatcccacagaagggacttgcctcagataccaagtccagtcctgtttcctagattccatcccccccaccctgcttctaggagctttctacctaacactggcttcatgggtcccttcctacagatccagtggttctggagagcattgcgttctttcgatcaagctgaccgtgccaagttcctccagtttgtcacgggtacttccaaggtacccctgcaaggctttgctgccctcgaaggcatgaatggcattcagaagtttcagatccatcgagatgacaggtccacagatcgcctgccttcagctcacacatggtaaaaggaagggtttgtttctccttttcagtgcttaggttgagcttgcatacttgatgttttcaggaccctacccaagattgggaacacaaatgtggctgagtcctggaccttgggtaactcacaatttggtgtttctatggaggtgatgtttgagatgagatgtgctagacacagtgggggctggggagacactgtcaggtaaacagcaccacaagagagcatggtgtattccagggccagcgtgactggagcaaggaggagttgcagggagcaaaagtctaaagagctcagcagaggtccgattaccagtgactctgaaaaccaccttcaagtttgcactttagcctatgggcgagtgaggccagggtgtttaaggaggagtgacagggtcagatttttggttttggtgcctgatggccagtttgggagccagataaagggggacatactgggctgagacaagattgggagtcatcaagaagcagggagttggtttcttcagggaggggaggggctggtgggcaccatgggaacacacagatttggttatctgtcatccctcaccacaaactgatctttcttctttccttagttttaatcagctggatctgcctgcctatgagagctttgagaagctccgccacatgctactgttggctatccaggagtgctctgaaggctttgggctggcctaataaggccctgcccaactccgtggggttttttttaccattgttggacctggggaggggggagttaaaaaaagaaccagaaagaaattgtcaaaaaccaataaatgaaatccaccaactcaccgtgtgtgtcccagctgccccatcttccccagcgcatacctgttcctcttctcattctctccccgccgcctgtttcctcaccttctctcccctttccatgccgtccatgatccccaccccatgtgttttaaaaaggcagtagcctttgcagggacctgtctgtcccaactgtttgaacagtgtgctcctcagattctgtgttcagaaggatttgctgcattgagacttgaaacctttggataggggaaaaaattatatatatatatatttttttgttctgtttgcatttcttaatttgtgcttggaatgtgttgatgtgcacagctaatgattcaatgcgagacaagattggcgtctgtgttgtggaggtttcaaataaagagcactcttcataactcacttttcacaatggagtttttttcaaacttaaaaaaaaaaacaaaaaactcttaagcacatgctaggcatctggagaaaagatggattctccaggaaaccatccctgccctacccgcttgcccacctgcctccaccactggtgcaacttcctccttcagagtcagtttctgcagtcaggagagatgagcagttcaccaggaattgggggtgggggcatctgttttttttttttagaatgggagctgcacttggggatggtgatggtgttagagattgcagcccaggacaaagcatcaccttgctcaaggggaacaaactgcagcaggttgtacaaaacattcagagagctcacttgacccaaccgagggttttacttggtgagcctttctagtagtcttgagtctggggctcagttttagatttttatttcattaatgtttgtttatttctaataaattttaataagcgagtaatttaactaggtcgccagaagaccattatttttgtttgtctatttttgttgtcgtcactccctctctcgtcatctgtctgccagtctgttcacagatcaccttgtagtcccttgtggtttttactccatccagtgcttaaagctgatctaaggacttcgatggttccagccttcaaagaaaaaataatttaataaaaatttagttagaaaaaataacccca

SEQ ID NO: 5683 - DNA, 152057 bp, human; identical to SEQ ID NO: 5682
